United States Patent 9,487,797 (GENOMIC PLANT SEQUENCES AND USES THEREOF) - sequence listing, part 65

SEQ ID NO: 72283 - DNA, 31408 bp, Oryza sativa
  unsure (1)..(31408): unsure at all n locations
aactacactaacaaaacatatgtacttaagcgtcaagtgtcaaagtgtgtggttttctgtaacttggaccacagaacgtgtaattttgtgaaatttactcatatctgtttacttttctcaacgaggagattggtagctccacggataatatgcttttttttttaattttgttgtaaaagtcacaaatgatataaatttagaagttttactcccaagttatttttgattgcttcattcctacctctcaaatcaaccgatcagcgcgtgagaccttgtgtactgagtttcaaaagttcacaagctggatgatcaaattttattcgtaaagttgactgcaatagttttgtatagatcttaactaaaattctttcagatcaatgtgattcacgcagtattattttggcccatacctaatccgtaaaattaacggcagggattgtccgtggtttacagtcggaagaactgatatgtggacgtaggctatgcacgtctcgaatttcaaccattcagtgggagctagcatatcattttggtagactttaaaatcccctccggtgaattaggcttgggaaaagtccaccacctcaatccctaaccaagatcgccagatcggccaccgccgcccgcgactcccccgcccatcgccatgtccgactccaaccccggcgcggcgaaccctgccctggggccggacgccgacgcggcggccggcgagggccttgagctggcgcagttcgcggcggggtgcttctggagcgtggagctgacgtaccagcgtctcccgggcgtggcgcgcacggaggtgggctactcgcagggccaccgccacgagccgacctaccgcgacgtctgcggcggcggcacggggcacgccgaggtggtgcgcgtgcactacgaccccaaggcctgcccctacgaggtcctcctcgacgtcttctgggccaagcacaaccccaccacgctcaacagacaggtgcgttcgcgtcgttcgctcgtagtagggggattagggagccattcctcctgcgccggcggcgccgccgcacgcgtgtgccggcgggcggtgccgatgcggcggcgacttcttcgctggcgtcgcaggaggttcagtgaacctggctcggtttttgtttagtgttgactttgctctgccgcggaagttgtggtctctcactgggagtattttggaccgttaaacagatcagaaaatatgcggttttaaacacacctacgtggccatcatccgtgattagttgcgttgagatttttcacgccattcttggtgcagtacggtactcccagaacccagcaacggttgatggaagagaaagataaactcaactcgctaagatttatttttgtgaagaaactagcgggctcctttcaaaaaaagaaagaaagaaagaaactagtgcgcaattgtgtgaaatagatgcgatcaaactactggcattgtgaaatgagaatcacatttgatatgattgtggaaagtaattttgacatgaagctagtattggccttactatccaaaaactgcaatccggtggtaattctacccaataccactataccagtaggaaagaacatttaacttcatgccagattatgtaactgagaagtgagtcagtgaagactgatatattgagccgatcgagttcatcagctagctgtgcagcctgtgctgctatcagttttccacgagactaataactaagcatatcgtcctggtttttacccctgctaattaaccccggcgaacttatgcacgcgcaatgtatggcagggcaacgacgtcgggacgcagtaccggtcgggcatctactactacacggcggagcaggagaaggcggcgcgggattcgctggcggagaagcagaaggagtggaaggagaggatcgtgacggagatcctcccggcgacgaggttctaccccgccgaggagtaccaccagcgctacctcgagaagggcggccagtccgccaagaagagctgcaacgaccccatccgttgctacggctgacgccgccgccgccgacgccgccccgagcggcactcgccggaccgtgcgctcgatttgccggcgttccattgcacatttgcaggtgtgcatgtttactgtagtaataactaccggtatcgtaaactcgtcaaaggaacctgcaaattctaagtcgcggtgtacgcgattgtgccattgaaagtttgaaactgtgggagtatatatatctgtgttacaataaacgcactgcttgtcaaggtgcagtatagttatgctgtatttgcttcattacctgatcatcgacgcacgcgttatttccttttgtgggattaactaatgatgtacattttcagctggttgttgagtcagttagcagccataaaatagggccatttgaatcacaggatttatttagaaatttcatagaattcaaattctatagaaaatttttctatttggccctttgattcaaaggattgaagctttccaaatcctatgaaattcctatggaatggcacattgcatgtggattttgaaggaaatttagtaagagctctaaactcttggaaaattttctttgaatctatctctctcatctgattcctgcgtttttccgtgttttgcgatcatctgttttacacttcaatttctgtcagaatcatgtgtttttcctattcctttattttttctaccatgcaattcaaaggggcccgtcagccgaattgaggtggcgatggaccagaggcagactgtagttggcaaacattttttcagccacgtgtgctggtgaaaaggtgaacgttcgtagaacgatttgtcgcgcgacgaccagtggccacgttcgtcgaggtatcaaactgtactgatctcgaatttaatagccaaacttgactggcaaatctccaaatctcgcgcggcgctcctctccagtccacggtccagtcgctctcgctccccggaaccaggcgagcgatggccggcggcgacctgcgcagcctcgtcgccgtgtgcgccgcggtgaccgcggccatgtggtgcgcccgcttcgccgcgcgccgcctccgccccggcctgccccgcctcgccgcgttcgtcccggtgctcgccgtcctcccgttcctcccgctcgccttccgcgcgctccacccgcgcgccatctcagggttcttcctcgcctggctcgcggagttcaagctgctgctcctcgcctcggggcagggcccgctcgacccgtccctcccgctccccgccttcgtcgccatcgccaccttccccgtcaggcagcgtgatcccaccaagaacgccccgggatcccgccttggccccgtgacctccggcgtgatggcccgcctgctagcggccatcgtgtcgctgtaccggtacaaggagcggatgaacccgtacgccctgctcgtcctctactcgctgcacgtgtacctcgcgctggagctcgtcctggcgtgcgcggcggcggcggtgcgcgcggtgatggggatggatctggagccgcagttcgacaggccctacctgtcagcgcacctgcgggacttctggggacggaggtggaacctctcggtgccggcggtgctccgcccgtgcgtcagccaccccgtgcgcgcgcgcgtcggcgagggagccgccggcttcgcggcgggggtcctcgccgcgttcttcgtctcgggcgtcatgcacgagctgatgttctactacatcacgctgcggccgccgacgggggaggcgaccgcgttcttcacgctgcacggggcgctcgccgtggcggaggggtggtgggcggcgcgcgaggggtggccccggccgccgcgccccgtcgcgaccgcgctgacgctggcgctcgtcatgtccacggggttctggctcttcttcccgccgatcacgagggccggcgccgacaaggtggtgatcgccgagagcgaggcggtcgtcgcgttcgtgcgggacaccggcatctgggcggccgcctccgtccactcggctttgagtcttctttgaccggccgctcgcgcgtactgtagtagtagtttgatatgatgggtccatctccccatcaaaatccaactctacgaatactccagcaagagagtggatcagacaactggtgtctgtcatggggtcccctattcatcctatgttgtcctgattctctgacatgtttgtattggatccattttaaggaagggatcccagtgcatgtttgtctgttcgcttgttaataagatcacgcgtgcaacccggaaaagctaacgcgggcgtgcccgttggcggcgagtgtttccaataatttagcctaattaactaagtggttagtagataataacggtaattaagatatgattttcttttttccggaagattttttctactaaccgattgaaaactttcaagttagatttgaaaacttttgaagtcaaattttaaaaactttcaaaactcaatttgaaaattttcaactcgaaatttaaatgtgtaagacaaattttgaaaactttcaactcatatttaaaaactttcaactcagatttgaaaactttcaactcgagatctgaaaactttcaagttcaaatttgaaaaattttaaaattaagatttgaaaaaaatgaaaactttcgactcagatttaaaaactttcaacttgagatttgaaaacttttgactccgattcgaaaattttcaactcaaatttgaaaattttcgactcagattcgaaaactttccactcaaattcgaaaactttcaactcgagattcgaaaactttcaaatcagatttaaaaattttcaagttaaaatttaaaaacttcccaactcaaaacatttttgaaaaaaataagtgtgctaaagattaaaaaaaagtaatcagaaaaaaacgaaaaaaacgcaaaagaaaaggaaaaaacaaatcgcgaaaaaaaaagaaaaaatggctgatgggccgggaggcccgggagcagctggcgcgcgcgccaactagcaatcccctgtgcaaccagggccatatgggagaattgtttggaggctctgtgccaaacgtaaaattttaggcccttagatttcagaattgtaattctaatttgagtcattatttaacttttacaagagtttgcctacatctaaggcttccgtatctacatccaaccattttcagaccaagacgtgggagtattgtttttctcccatatctccatacagagctaatgagttttacagttgtgctctcctcttggtctcggtgcatagaccaaatatgctgatcaaacttgaatggattgagtatatgttggtggttatggtgtataataacaaatagctacattttataggtatctctcgctaaagatcaacttttgcagtgttcaaaaaactaaaaccataaagtcccactatcctgtaataaaatttgtctaaataattttggtaccgagcatgtgaactgagaatgatggtagtgcgtttcatgagccggatagcgatttcggaccaaaccccattctgttgagggcgacttggatcgcgaataactctggttttctgttaccaacggactacagtgatatccaccggcggcacttggatttggcggtgacgccatggagaaagaatatatcactttcaagtgagagaacggagttaaacactgcagcacattttgttcgcttgataacatgggctgtagtgagcagtggattgtaccatcggcccatggtttgcatcaccgggatgctttaatttgttccacggcgactcggcgagcgcccaatttatcaaagaaaacttgacgagttgattggcaaattcagcaattccccgtctcgtgccaatctgttctttccgtcgcgccccatcgaccggaccccgatgatggccggcggcgacctgcgcagcctgttggccgtcgttgccgcggtggccgcggccatgtcgtacgttcgcttcgtggcgcgccgcctccggcctggcctgccccgcctcgccgcgttcgtgccgctgctcgccgtcctccccgtcatcccgctcgcgttccgcgcgctccatctccgcgtcacctccgggttcttcctcggatggctcgcggagttcaagctgctgctccttgcctcggggcatggcccgctcgacacgtccctcccgcttgccgccttcgtcgccatcgcctccttgcccgtcaggcgacgcgcgcagcgcgattccgagaacgccccgcgcccgggccttggcctcgtcaccttcgccgtgatggccgcgctgctcgccaccatcgtgtcggtctacccccacaaggagcggatgaacgagtacgtcctgctgatgctgtactcgctgcacgtctacctcgcgctggagctcgtcctggcgttcgccccggcggcggcgcgcgcggtgatggggatggacttagagccgcagttcgaccggccctacctgtcggcgagcctgcgggagttctggggcaggcggtggaacctgtcggtgcccgcgctgctccgccagtgcgtgagccgccccgtgcgcgcgcgcgtaggcggcggcgtcgccggcgtccccgcgggggtgctcgcggcgttcctcgtctcggggatcatgcacgaggcggtgatctactacgccacgctgcggccgccgacgggggagccgaccgcgttcttcgcgctgcacggggcgtgcgcggtggcgaaggggtggtttgctgcgcacaaggggtggccgcggccgccgcgcgccgttgcgaccgccctgacgctggcgttcatcctagcgacggggttttggctcatcgtcccgccgatcacgaggaccgggactgacagggtggtgatcgcggagagcgaggccatggtcgcgttcgttcgggacgccggaagctggcccgccgcatccgtccgatcggctttgaccggccactcctagtttgattacgacgggtcactggcgcatctctcgttcagttcacggtacaaatttgtatattgatttttcgttagatttggagctacagatttttcatgtagctttagatttatgtatatagaaagaaaaaaattatttgattagtgctgctaaatttaaaattagaaattcatgatgaattaatacaaagttatactcgttctatattctcagtcgtagttttgcatgattataaactggatcatcctagcatgaattttgcttatattgatccattcaaccgttccattgctcgaccatgtatgcaacgcaatgattcgtgtggtggactacgccatcacttcacatgggactaaggcacggcgatctgccgtgctggagcttgatcaggttgtagtacgtcccggcgcggccgacggcgaggagctcgtggtgcctccctctctccgccaccctcccgtccttcaccaccgcgatcgtgtcggacttctccaccgtcgagaggcggtgcgccaccacgacgcacgtcctcccccgcagcatccggtccacggcgtcctgcaccagcctctccgacgcggcgtccagcgcgcttgtcgcctcgtccagcagcaggatcctcgcgtccttcagcaccgcccgcgccagcgcgatccgctgcctctgcccccccgacagctgcgcgccgcgctccccgacgcgcgtgtcgtacccgcgctccatggcgctgatgaacccgtgggcgttggcgagcgccgcggcgcgggccacctcgtcctcggtggcgtgctcttcggcggcgccgtacgctatgttgtcgcgtatcgtcccggagaagagcgtcggctcctggctgacgagcgccacctgcgaccggaggcgtgcaaggctgtagctcctgatgtcctcgccgtcgaccaggaccgagcccctctgcgcgtcgtagaaccgctcgatcagcccgatcaccgtcgacttgccggacccgctcggcccgacgagcgccaccgtcttccccgcgccgatctcgaggctgaatccggcgagcacggccacctccggccgcgtcgggtagctgaagtgcacgttcttgaactcgatcgcgccttttatctccttccgtttcttcttcttcctctcgttgtcgttgtcgtcgtccttgatcgtcggttcacggtccagcgtgtcgaggacggagcgcaccgcgtcgccgccttgcgccaagtccgacgtcaagctcccggcgtcggcgatgacccttcccatggtcatgagcatgaagaacacctggaacaggtgcgtgggagtgatgagccccttggccatgagcttgcctccgtaccagagagcgaccgccatgctgccggtgttgctgaactggcacaggcacaggcagaagccggagaaccacgagtgcgccacgttgtccttcttggggccttgttgcgcggcctcgtacaggcggagcatccgccgctgcgacgagaacgcggtgatcgtccggtggttcaccacggcctcgctggcgagctggctcccctgcacctgcgccttcttggccttcttggacatggcagccatgagcaccttcttgaagtagaagctcgcgatgatcagcggctgcatggccatcatcaccgtggcgaggcgccacgacacggcgagcgcgagcgagaagcccagcgacgccgtggcgcccgcctggaccagcaggcacatgcggtcgccgacgagggagcggaccttgctcgactgtgtcgccagccgcgcgcacaccgcggcgctcgagttctcgtcctcgtcgaaccacccgacctcgaaggagaggatcttggcgagcatctggccccggacacgctccgtcaggcgctcgcccatcaccgcgaagttgtagtgctgcacgatgttcgccgtgatgcagacgacggcgatgccaaggaagaggaagtagtacaacctggtcttggaacggatctggccatcgtcggcgaggaaataaacctccggcaacgagcctaggctgtacgagtacagcggcagcaccgcgccgaagacgacggcgccaacgcacccaagcaacgcctgcttccactccggccggttcatcttcagcaggcgaagcttcgagggcttcctggagcgcgccacaccgtggtccacgagcttcctcccaatctccgtcgagtgttcgaccgagcagaacgacggcgcggggctaggacggtgctcggtggcgctgaccgccgacataatctccacgctgcggaacgacaccatctcgctctccaccacatccacggcgcggtggcgctcctccctcgccgccacgggtggcgccttctgcaggtgcaccatcctggcgtacacgccgccttcacccccgtcgtccatccccaagagctcgtcgtgcgtgccggcctccacgacgcggccagcgtcgagcaccgcaatcgtgtccgccttgcggagcgtcgagaggcggtgcgctacgatcacggtggtccggcccacggacgcccggtccagcgcgtcctgcaccgtccgctccgactcggcgtcgagcgcgctcgtcgcctcgtccagcagcaggatcctcgggtcccggacgagcgctcgagcaatggcgatgcgctgcttctgccctcccgacagctgcgtcccgaactgaccaacctgcaccggagaaaaaaaaaatacaccataagattcagcgtgctgtagcatgcactgtaaaaattgctgttgcttgtgtacatgagtttcgtatccatggggcaacttgacgatgaactcgtgggcattggccatcttcgccgcggcgacgacttgcttcaacgaggccgtctcgtcgccgaacagtatgttctccctaatggaggtcgcaaacagtacaggctcttggctcactagccctatctggctcctaagccactccacattgagcgtgtcaatgccatggtcgtccatcgatatctccccggagtccgggctgtagaacctctgcagcagcgagatcacggtggacttcccggacccgctgccgccgacgagaccgacggtggcgccctcagagatggtcaggttgaagccgttgagcaccagcgtgtccggcctcgacgggtacgagaagtgcacgtctttgaacacgatctcgcccctgatcctttccatggtggctcccttcttctccgccccttcgagcggtgggagcatttcgatcatttcttgcatccggctcgccgccgccgtcgcgtcaatgaagtaccggaggttcggcagcgccatcatgatcgacctgacattagcaacaacagcacgaacgtacattatcggtaaaaatgtcacttgttttgaaatggagggtgtgtttgtaatttgaatgcttacattcccgccaaaacgatgcagatggaggcgacgaacacgtggccgccctgggcgtgcaggtggatgacgaggaggctgccgatccacgacaagaaggaccagacggcgtagatgacgcccatgctcccgatcacggcgcccttgatgagcccctgcctgacgccgagcgccgcgctccgcgccaccgcgccgcggaaccgctccaccgtccgccgctcagcggtgtacgacgccaccgtccggatggacgacaccgcctgctgcgctatcccgcccgcctcctcgtacgccgcgcgggcctccccggccgccgcggccatgcgcccggcgaggagcacgctcggcgtgacgaagaggaggagcgtgaacgggaggcccgccagcgcgagccgccacgcgaacacgaacgacacggccagcgcgccgaagaagagcgtcgcgttggccaggaccatggggagcttctcgccgaggaagtcctggatggcgtcggcgtcgtcggagacggtggagatgacgcggaacgtggtggcctgggcctgggcctgcggcgacgacggcgaggagggcgcggcgtcgaagaacgccacctcctggctcaggacggcctccaggtacagcctcctcatctttgacgcctgccgttccgccgttctcgtccagcacagaccctctgaagatcaccaaccaacattcatgttctccatgatcgtccaaagaaaattctcaccgatcaaacactacttctgattttttatcactgatcactaatttgtttgattcaaagttgctcacctaggaaggagcaggcacccactgcaacggcgacgtacagtaaccgaagcgcaaactgcaatgcagcttacgcgcaagaataagattcaggaaaggagttgcatatggaaacgtaaatggatggcacgattgatcaccttgtcgacggcgccggagctgaaggcgctccgggcactgccggcgccgccggcgccgccgtagctgttgacgatgtcgccgagcaccagcattgacagcggctgcatcatgccatcgccgaagctgcccagaacgcccagcgccatcaggcaccggtcgtgcgcgtcggcgtagcgaaccagccgcaggaacgacggcttctccttgtcgcccatcgggcctagtttccaagcgaactaaccgattgcgttcgaagcttaaccaaaatttctctactattaatcagctaactgccacttagtcattggctgtctgtcgtccaattagacggattaatccgagcttgtcacgtagcctgctgtcagagaaggcctttcgagtgaggaatataccaatcatatcgaaatctggtgagtacttccgttttgtcccgaacgatgcagccaagccagttcaaataacagtagagaagaatatgttatactccctccgtcctaaaaaaaaaagcaaacattggatttctcttatatgaaaattttttataatttgtattttcattgttgttagatgataaaacatgattaatattttatgcgtgacttgtctttttaatttttttcataattttttcaaataagacagacggtcaaacgttggacacggaaaccagggtttgtctttttttttttggatggagggagtacgatcgtagagtagatacccatagccattagcgtgtgtttatagcccctgcttgcagttaatttggtttgtatattccgccggccttggcgctagcttttgctcgtagtctttttcttcgcaaatctgatatacgaagtgcagctgttcccttccaagttccaacaaaaggggatcgagaagaagcgctggcgtttcactctcatcatcctaacttgcagttggcacacgtaaaaagggtgcgtgccaaatgccacgctgatatataactttcactaccccgcccccatgtcaccaccattcacaatcctctcgtacgtaacattaccaaccaggacgctggtcgcccacacgtacctggccaaagctgctcccttccttgtttcatcgatagccaaagtccctttcggcagcgtggtccgccagaatctgcgttacctgacctcatactttcacaggttcacagcccccggtgcagcgtccatcacccactgcagccgagtgccatgtgcgcaggagagccatttttggggcagtaaaggtatcacgtccgaggcgcaccccggctgcaatggctgcatcttcctggctattcatcagtggcgtgtgctcgtacgagcgacctcgctctgtctgcagcctgccggtcgctcgttttccggcccgtttttcgccgcaccccgcaacgccccgcacagaaagcgccgcggcgcgggcctcgcgttacggggaaagcgagcggttggttggccttggcggcctactggctacacgcgctacgccggcgaatttgtgaccctagtgggtacggtgtgggttgggtttggccacacgaattatcgttgtttgccttgcctaccgccgtcgcgcccagcaccgcatgcccgcggtgtcgcagccgggatgcgggaaagtttcgtggagaacgcattgagacgttttgcatcgttcacgagtccctcgctctatccgatatatagccgtaggcatacgcgatgggcaaatgcatatgctactacttccatcccaaaatgtgtttacgattagatttgacactatctaaggacaccatgtaacgatttatcgggaatttgtttggaaatcgtcgggatggaacacatttgtccacatataatgatgcatcgatgaatgttgctcgttcttgcgagacccgttttcgccgaggtcaaatcctctttagaaaacaaggagacacgaaaggtaaccaccctacggcgcctttctttcatctcgagtccaatccaacgccacccacatctattcgacgcacgctatatatgtttgtatcaaactgtggacaatgcgattgactgaagtctgaaaatatgcatcatgattacattgtccgttttctacaaactttgttacgtgactccttcaattgaagaacccatcgttttcccacacaaccaatgtagtactagtgccacccaaaaagacccgccccaatcatgcacgccctggcagggtgacacaagtgaccagcggagccgtgtcacctgatcagaaaaaccaaccaatccatgccatctcgagctcacgaccacttcatctgacaaccaccagcagcaggcagcatgcacgaaacgcggcatattatcattggcagtactacgaatccatatgatgcaacaaaaaaaagcgagacgtgctcttttggatcgtcttgatcgcccaaccacggcaggccaggtgttctgctgttggcctacctaggctgcaccaaacgagcaaagcaaacaaacgcacatgtgcgcgtggttgcccactgcaattgaagcggacaccaccgaagatggcttcgtgcggtgctgcctgtggtggctgcacacaagttttcaggtccctactcgatgcggtccttgaccctgctcgcgagcgcgccacgtacacctggaggctgggacgccgtggagacacggatcattcgattccgtggtgccacaacccgacagggccacaatgccatattgccatccaaggaaatcacaacccaacacggtgataccgacggccattaggctgctgcgtgccttgagctttgcatgctttttagggtctatttaaaaaatatagcttattctacaatcttctgctcttaaaaactcttctcaagcagttcagattttcatacagattttaaaaatatgcagttgtaggattcagaaaataagctagaatatagaaatgagaaacctagcttttctatattttcaccagctaaattctcaccaagtgtttctcggaatattaagccttccaaacagtatcttagtgaccagttggcagttgcttgcgatttggcaataatttatgccccaagacgccgttaggagatacgtaaatgtcgttgcaggacaggttcctttgcttgagcgaacatgaaacgaacatttcgaatgattggttgcattttcgctcgatcctcttgcctctggtcgcttttatcacctttgcgctagtaaaagagtgaacagtgcaaagcatatcaacaacgcttggagacgaagcatgtagatggatccaggctttccagttcgatctgtgtctctgcccccagttcttgcgtatgtcacgctcacgcaagaactaactgatcctgatgatacgctcgtatagtgccctaatcctgctcaagaagacaaccggtctttgaatttagtggccgtgttatctgttatgttatctgctgttgctgcttatctcgtcgctgagcatgtgcctgtcgccgtcgtcactgctcacctcgtggcactccttgctgattgcactgtggattttgtctgcagattttcttagcgtgacgctgatgttactgtgcagattaaaaaaaaaacactgtgtagttgctcgacgttgcgatcagcttgatatcatccatttccaatttgctgcttcttgagtaaacaagcgcaataggctgctcaatatcttccaatggcatcgacttgacactgatccattgatcgcctgttcatttcattgagttaactcattggcaactcttcttttttttcttttcggtgttaatttcaaacctactagaaatctccaatttgtctgcgtgtatgtaatgattctgttcaaaaattgttcatgtcacgctctgaattttgaaacccacccctgcgaggtaaaggaaaggctgaggagcatgccaaaagtgaaaaatgacaacagattagtttatgttgcattctccagaagggaacatatattctttgctgcttctccactcaaatcacatccctgacgaccgtgaaatctttttggcaaatctccactaaacacacccattgtttgacaaatctgctctgcaaatacagaacattttgagatccgagctgaataagctatcaagatggtagtcgtagaatcatattctagggtggctatggagctggcaatgggaccagaaagcacactgcacacatacccgtaacacaggcctgcttaaatcctgcttaattttggcgtaaagtgaagcaatgagagagagagagagagagagagagagagagagagagagagagagagtagttagggagcagcgattaggatatgatcctcatttgacattctatatattgcattgctttacatgtagcccccatgctcttttttgcaccatatatattcggttgagatttgtccaacctcttataagtcataattagcttttcctttactgcattaagtgttgtaagataatgttgtctaagtagtccactcttggcatcacatgcatgttggatcaaatggaggtagcttttgcagtatctcgttactagcaacatatactagttactcaaaaactttatataacatgatctactctctactttgctaatagtacaatcttgtctctcttacatgatcagccagtaagagcatttgtcctcagattgtttttctcaaggacgcttgtccttacctcctgccgtttcctccacagcagatttgcaagattttgttctccaatttgcagcagccttcgttctctgatgagcttgcatgttggataaaaaaataatactttctgcaaaatgagtatagctcaactgattaagttttttttaatagaacaagttcacttcaagttttagattgacatggatactcatatttgcggctatttattctttcagtgacagacaacatacccatcaacagcgagacatttatttcgttaatctctagatgtatcggtccaatctttccgagatgttcataatgataggacgcacgtctatatgtttatagtgtatgcgtatttgtgagcgtctatatttatattatgttttttgaaaaatatatcactatctgaccactaagctcaaccagtaccacacgctggttcagttatcactgaaaatttcgaaacgcttctttcagagccaaattgacaatgcgtggcagtggaccaacccacattgaattgtactatactccttcaaagttcacactaacacacaacacaggagaagatggacgtgtcaatttacggatccataggtgaagccataaaacgcatgcggctcacgtttcaagtcccgatacagtttgccacgttgaaacaaaaaccggtggttccatccgacgtaaacataacatcttacccatgccgttactggagccgagatgtcagtcacgttacggtcgtactcgatcgtacatgttttgcacgcatatttcttcagcgtatggtcctgacgcgaaccacttgccgaaccgtcacttcggagtccctactgttcatcgagagagagcctctcgtgtgcacgcacaaatggaattgcacagggctaattggcacttgacactttggtacaggccgcgatgtccaaagcaaaaggtaccatacattttagtgttaaattcatagcctcgtttgatggaaaaaatcacatcggtcccgattaattcatcaggttagaatgtagtatgaaaattccggggaggcagtcgaggcactaatcctggaccaaacgtgatctgtacactttgtaagtgtacagcaagcatcacgatctgagattgagaagctggtgtagaagttgatcacatcacacttatttcttcatttttcttttttttttttttgcaaagatcacacgttgacgcagcggcgattccaaccgggtggatcggacgacgtcgaccgaccgtaaggcggggcgggctcgcgccatcgaccgcacaccggtgcccccgacacctccgccccgggctgtccactcgaaccgagcgcgtaccgacaggtcacatcggggccatcctgaccgtccagtctcccacccgtacatgtgccggacaatccccagtcgtcagatggaggaagccgacccaagcctgcgcgtacaaataccccctcctcgcactcgaaccaactcctccattccacggagtcgcggccgctgtcacagtgggtggtggtgtctcctgatgcggcttctcccgcggctttgcatggccaccggcgacagcgcggcagccgccggcgagggagacagcagcaatagcggcagtaagcagcaggcagcggcggtgtcgtcctcctcgtcgactgtctcgacgtcgtcttccgccgcggcggccgcggtgtcggaggcgtcgtcgtcgatgtccctcccttcgctgccgtcgctgtcggatgtgacgggtagcatgagcgcaagcctcgccgcatcgttcgcccatgttactactctgtgccctctgtccacggcggcggcggcggcatcggctgccgccgtcgcggcggcggactactcggttcacggcggtggtggtctcgtcgtcgtcgtcgccaggccggcggctgtggtcctccacgacgtgttcaccatggaggcgacctccacctccgacatggcggatgatacttcggcggccgggtcggtcaagtgcgtggcgcaccttcatggcggcaaggccgccgtgacggggcaccaggacgggaggctgcggctgtggcggatgtcctcccgcgcgcccgaccggctccgcctcgccgccgcgctccccaccgtctccgaccggctccgccggttccccgtcccgtccaaccacgtcaccgtccgccgccaccaccgtcggctctggatagagcacgccgacgccgtgtccggcgtcgcggcctccgccgacggccgcctcctcttctccgtctcctgggacaagacgctcaaggtgtgggccgtcccgtccctccgctgcctccagtcgctgccggcgcacgacgacgccgtcaacgccgtcgccgtcgcgcacgacggcacggtctacaccgcctccgccgacaggcgcgtccgcgtctgggcgccccgggcgccggcggccgggccagacagggcctcgcgccgcccgggcaagaagcccgcctaccacctggtggccaccctgtcccgccacgcggcggcggtcaacgccgtcgccgtcgggtgcggcggccaggtgctctactccggcggcaacgaccgctgcgtcgtagtgtgggagcgggaggacagcgcgagccacatggtcgcggtcggcgcgctgcgcgggcaccgcagggcggtgctctccgtcgcgtgcgcggccggggacgccgccgacggcgcgctggtggtcagcggggcggcggaccagacggtccgcgcctggcggcgcggcgcggacgggcgcgggtactattgcgtcgcggtgatcgacgggcacgggagcgcggtcaggtcggtcgcggcggcgctcgtgacggcgcagaagaagcgtcgcgccgacgacgacggcggcgacgaggagtggagggtttgcagcgccagttttgacggcgaggtgcggctctggtcgctgcgggttgcggcggcatcgtagcaaggtcccggtttggcacgatttttgacgtagaaaagtgtgcgtttttttcttctttttctgttcgtttttggactcacggaagtttgacttgtttgagaatggagatactcctgcctttgtgtatatacgggagaggggagtctctacggtccactatatttttggactttccaaaagctgcttattagtagtgatttcaaatttgcttacatttttcttcagggagtgtacatttcaggtgtctggatttttcaaaagatacagttacatttctcatccttggatggtactaataatcttatggttctcataaatccccaaatgattgaaaaataaattattctaacatataaaaatttacaaatgacacgaaacaaacttataattaataaaactttacaaaactacgtgcaaaagctcttaagtagtgatttcaaatttgcttacattttcctacagggagtggacatttcaggcgtctggatttttcaaaaatacagttacatttctcatccttggatgatactaataatcttatggttctcataaattcccaaatgattgaacaataaattattctaacatgtaaaaatttacaaatgacatgaaacaaacttataattaataaaattttacagaagtacatgaaaaaaaccaaatacataaaaataaagtaaaaccatatataacaagaaaatcacagtaaagtgaaataaaattgcagcaattttagggtttagcaatgtcgtgcaattttaattgaaagaaatttttataactttcataagtctaaaatcttgtaaatcaattgtctttatgtgtgtggagattatgggtaccccatacccacacgacatggttatcagactagttataggggatagtttagatctatggaatatgtaacggatcataacttgggtattacgttttcttgtatattacggaatggcgtaaagttttggtttgataatagatttaggaagccgatatcgtattagttaaggtttctgtcttgtaatcctgtcccccatcctatataaggcaggcaagaggccctctagggcatgagattcacaactagatcgtcaaatcaatactacacttggtggattcaaatccccaaacaggagtagagtattatgagagggttgatgagagggtctgaacctgtctagatcttgtctccacatctatccacttttagatctcgtgcgctatcccgtttatattgccgaaatcctgttttgacaatgtgttttttttttttgcctttctttgtgtgctacaacaatagctgtgttatctactttgacaaatataagaccagaagaatagcgagaaagacccacctaattggttcatcagcgttaggctggtgtcctgttctgatctgtaactttccaaaaggaaaagaagctcttcaattgtcgtctctcactctagcttggctatcaagtgtcaaaatcgacatgaatggctcagtaaaaagaagtcaagaaacaatctatccattcaatttctcttcaggctgggctactgtcaaagcagataggagaatgtctgacataactatcatccacagaatacaaccaaattaccaaaatgaagtaactgaccgttcattttgcaccacgataaactccaaatctgacgccaatcgccgatctgccaatggataataattgcacatatagtttgtagtttgtgggcaacgcagcattgcagctgcatgcctgtaaagcgggcgtgtatcgctggggatttggagttggagatgagatcgatcgatctggagcaagcaaagcagcagagaggaagtgcaggctcgatcgctttcatgctggcgtgatcggattgggatcgacgtgagcgtgacgaaccaaaccctaccgatctcgctggatacaatgataagattctgtgcgcctctgtcctgcagacgagttggccacgcactgcaatgatccatgcacttagcagatgattatgactaggttttagctaatctgatgcttaatcccttttttgggtctgcactgttgctgattcgcacgatccgatgctagaccgatttatcatggtacctgctacacccttttgatttttgactcatgctctgtcagtgttaaggcctaacatatgtaaacattgcctgccagctcttgcctgctgctgcttgtcgtgtgtaacctgaatagcactgctgtctggcttttagccatgtcaatagctttaagcaaccgacctcactagcaagggcccgctggttacctttggagagatgcgatgcgagtgaaggactgttgtaaactgtccttgaactgaacattttgctgttccttcggttctgtttctgtgcatgatgaagccgagcagcaagggggtatctgctgcagccttttccccggagatattttagcaaaaaggcaggccaggggttggtggtgcctccatgagctgaacggcaaaccgacacacgccgataaacacaatatctatccattcgattgtatacggcagcttatatccgataagcacttgtattatagtattctagagctaagcttaatcaacccatgttgtagcagtagtatatctgtacacatcacccttgaggatttaaaaatcagtgtaaagtaatcccacttggcgcgcggtcgcagataacacgagcctcgcagttgattcgcccggtggcgcgaggcgtgcgtggagcgagctacatccagggtttacaaaatcatacagtcactatggttatcatatgtgatgttttttttttcagtttttaaaccatcacacggtttgataaatcctagctacactgctagtacatgatgacaggcgtgagagtaaggtagaatgaattattccctgtattttataataagtaactttgacccgacgtgaatatgtgatatatctagtattataaacttaaacaataaatctgttacattgaatcaatattttttttatttgatgatgagtgtgaatatcgagtactatgttacatccaattaaaactttttatattttaagatgaaaggagcaacgagtcagcgcgagtcgcgctaatgatccggcagcgttggcgcgcggtggtggcggaggagcagcagctcgatctcgaccgattagttaatcgcgacactgactcacgtctgcctcagcgcgccgccatcttcttttaatcacgtagccacgtaggtaggcttcgctagctcgaggagtcaaatgcaatttatgtagctggtgggatactagcagcaggttaggaggagattcattcttttttttttttactttttttgtaagggaatggattgttaatgtgggattcaactggtggtgcgtgcattggcacgtcccctgattatgcaggtcgtgtatagaaatatttcaggagaggtcctcatcgtggagtatttgaccagcaaatgtgacaatgtgaaaagatgatgcagctgactgtatcgtccaagtgtaagtcagcgtggcaggctggaataacctggttagtacaaagaaatgccatggatcaggtagggtaggagtatgtcataaacaagtggcaaaaccattgttctgccacccatagtttcaaattttcaatcaacgggaggaagttttaggtgcatgaacgaggcaccacgtattacactagtatttactactcgtacactgagattgtgcattttgtttccatctactagtacatatatactagtgtatgaattgacgtgtagtgtacttgtatacagtgtggcacatggagcctattaagtcttggaatattctggcattgttagcttcgtcaacacagcaaatggatcaactagcaagtcggcacagtacctagctgctcacaagtcagcacagtgagctactccaacaatggacatcctattgagtattgtcacagctcacaacgaacacagagattaagcatgcgacgtgatgtgatggcaaataatactcagtccgtagtcctaaaatctaaaaaactacgggcggagctagaacaaaatgaatgattccattcatttgttactttgatttgaatcttgatacgagtatctaaatttaaactgacaggatatataaacatatggtgaaaatagataaattataactaatttttcttttcaaccgggttcccggacaccccctaactatacatagctccgcgcctataaaaaaactaatccttcgttagttttaaaatattgctatatatagtatatgtatgtgatgtgatattttctagtaaaatgaaagaaatattacatcatatattaggtacatagtagtaataatattttaggacaaaacaaggtataactaaatttgtatcaaattcgattcgagattgttatattttaaaattgaaggagttcatatttagttcctgaatataatttgcattttcataaggaactcgtgatacagtacatagtagcggtttcccttaggccccgtttagttcccacacaaaaattttacaccctgtcatatcaaacatttgaacacctgcatgaagtattaaatataggctaaaaaataactaattacatagattgcgactaatttgcgagacaaatctttaagcctaattactccatgatttgataatgtagtgctaaagtaaacatttgctaatgacggattaattatgcttaataaattcgtctcgttgtttactgacggattctgtaattagtttttttattagtgcccgaacactccatgcgacacctatataataatcgatgtgacacgctaaaactttacacccctagatctgaacacccccttactcgttttttgtttgtcccctacacacggttggtgcctcttggcctgatcgattgtcttgcactctttgctgcggctgcggcgctggaattgatcagctcatgctcatctggtatttttgcggagcaagactctgaattgattttatgataatatttcaagggtacaaaaagaaaataattaagcagcacaaagttgatattttaaatactatttctaagaaacttacatataaaaaaaaatgcggacaccattctgtgacaaataatctataccggcggggccaaagctgctgaattggcagtagagctcctgtccaatttctgattgtaccttgatggacggatctatattgtggcgatgaaccaaacaaatccgacccgtacgcgtggcggtggcggtcggtgcacgcctctcctcaccccctgcacgctgcatttttcagcaggtccacggcgtgacagtctaacagacattggcacagaagcttccacccgccaagccccatgattggatggagcgagccggccagatattccgcttccagaaccttcacccacagaaacagatcatgctcctgcagtagctaggcgacgggagaagaagaagaaaaagtcattaaagaattgaagcgatcgatcgcgtttggtcaactgtcaccagtgctagccctgccccaggaagcagacaaggggagaaggagaggaggccccatgacggcgacgaagaagacgatgatgatattgataggataagagaggggccctatgcttaagtcgaacgcatatggacgcatggcacgctgttgttcggatctcgcaaaacgatcaaggagcagatctgacctgcgaaatggatgcgtcttagctacctgttctgcttgtcaagttgtcatgttgtatctccaaagtccaaaccaaaatgcactcgaaatagtgatcgcaatttgcaagcatggagacgaatggcttttagaaatcacaagagagagagagaggtcgcacggtttgggggaagtggtttctgaacagtgaacaatgtatagtacataatttgtttggacttttgactccaggaaagtttcattctttaatgaaaccctccacaccaaagaaaaaaaaggaaaagaaaacgaggaaggacgcaaggtttcttaaacaatcttcagaagttggcgagagaaactgaaaagcggtgggaaacagggaaaggggaagcagatgatttagaacagttttgctccttcaaaggggaggagttcgttcacggcgatgatagtcccctgaaaaggtcgttctctgccttttctccgaccatcctgactcacctgccattaaggaagcaagcaggcagcttaatcacgaaattagtagtataccaaggatgttcaatcacgcaagattaaacaatcctgaagttaatcagggcaatgctggccatcttcaaacagattaaatacgagcccctttacgacatgcgagcatgatatgggatgaccagaggaaacttgcagccatcgtctaggcgagttggtgattgacttgccagttcaatcaacaatttgcttttccattcaaaaaagaaagaaatgaaccaaaaaagctttacctttcctgcaaggtaaaccatctcgcgtcagcttggcggctagcaagggagaaaatggagggaaaaggctcgaagaggcctattagtagaatttatagcccaaaataaaacccaattcagtaaagggatcacctgaaacgggcccaccaaggccccccttgaaaccccttcccgccatttacttgccctaatcccctccccctcccggcgttttcccgctcgcggcccgggcgaaacggaagccacccgcgatggagaacgaggcggcgcgcggcggcgagaccttcgatccggtgagctcccccctccttttgatcggaataaatccagttttggggttgatgcggtacgttgacggggcttgttttggggatctgggggcaggatctgatccgtgccatcttcaagctggtgtgaagccgccggggcaaaagggccgccgccggcggcaatgccggcgacgaggtcatcgaggtcgaggtgattccttgatctggtcccagatccttgcctccaaatgattgttttctgtggccgttcttctttcagctactcctaatctgtttcagattactcttctttctgttgtgtatgtactctggtctgaatgtttccttctctaattgacagcctgccccggagacatcaaggaggaatcgtagtgccactggtaaatcaccttctgctacagtaaaacatgcgatttatgcgttttgctttgttacatctgattagtctccttagccactggtaggaactaggaataagcttgaccatgcacatctgttggtagtattcggtgctgttaaatggcagcaggttatcaacactagtggcagcatcagaagtttttacatttcttgcaattgccttttggagctgaatctcatcagtatcaactttgctaaattctcttattactagtaactattactttggagtttgggtaactttacagtgatgtttacctccgtttcacgggccctgtgggtggcaccttattttactttacaagcgaatcctgacaacaatttaagttgtgcaatacagagggcaacaagaagtctatctgatttcagcatgacaatcaatcggtccaggcgtccagccacttatgatgtaacaggatcttgttggcatactagtttagacattcatcagttagtctgtcctcttttatagttgcatatgctgcagcagtggacatttgttgatcatcttggttgtacaattcagtttttgttattgttttatattgtagcagatgggctctagacctctagtcctttcagggtttggtatatccttacaacagcaactaatgccagcaccaagtgtgccaaccaggctataacaatttgaccctgttggcctgttggataagaaattgaaaatagacctaacaagtaacaataacttgtctcaaatgtttaaggcatcctagcgaaaaaaacaatattatcagattttgtctctagtatttgttaaaagaatagctgtgagttgtgaaaaaccaagtcttgttaaattcaattctgtgcgcccaatcacctaatactgaaaaaagaatctccacccttagatttctgttggggtagtttaaatcttgaacttgaaattaactccctatcatcctatgagagccttcttgtgtggtgttgacaatctgttcaccttcacagccaacgccagtgcgcttaaagtgagctgtgaacttctacggatatttgtcacaggtatgtacctcttaaattgttctattgcctcatggtgttaagtgacatgaagtcaatactccatagctacagtgtaactagagaaattttcttgcagaggctgttcaacgttctgcttttattgccgaagcagagggcacaacaactattgaacccacccatctggagcgtgtattgccacaacttcttttggacttttgaggtacttcagggatctcttatctctagcttccaaatctataaggttgcctctggcagaaagatataaaaacacctaagcatatagttttaaactatggcatcagcaaaacggtttattatctgaacaaagcaaaatcgtctggataaatcagtttactgacttgatgtatacacatacaggatacaacttgtaccagctagtgcttttattttgggggagaaaagcttgtggtcagatggatagctaagggacccgagcaaaattcatactcgagaagcctgttaatgctagtaccacttgctgtgaatgcgtaaaaatgacctggggcaacaacttctactaggatccgtggatttctggataatcactgtactgcatctttacactgatacctgtgctggcatgtcctaaataccaccttctttgacaggcacgatcttggtcatgtccacactgcagattgcttgataatgttctactagtatctaaatataaacaacagaggcgtttgaacgagatgctttctgtcactactactacgagttcgctgctgacagatgatgggcgaaccctgctgatgcaggcgcatctacggtgatttggtgaatcttcaaccttcacgatctctcggtctcttccgaattcaggagacggaacacccgtatcgtatcgcaccggggcagagcaaccagccaacccgcgaagtagtactgagtactgaatggaaggtctggataggcaggccacgcgcgcacacccgtcccttcctgggcggcagccggcaggcacccgtcccccacccacgctaccagagttcgccggagaggcggccacctgtcgagagggagcttctccacacggccaccgcagcggcaaccacccccaccacctgtcctgctcccctcctcgtgccgcctcgtcctctttttaacgggtttctgacgcacggggggccgccgtcatgtgcctcgccgccgccatcgcgtccgcgtccgcctcacccgcccgctgcctgtcgccctcctccgccgcgctcccccgccgcttcctccaccacctcctcctcgccgagactcctccccggccaacaccgcccccgccgccggtgcgctgcatcccgttccaccggatggcggtaagcgttggtgctcctcccctcccctatcgattttctcctgtggcaatcccgattccgtggaaatttgtgcccggcgatgcccaaccggaacctgctccggatggctcctcgtgtgacctgttagggtaaagttgcgtggctaattttggggaatcacttgaaagcgcagatgtccaaaccagtgaatttcggaggtgtgctggattgctcagctgtttgctttgcccttgtgactaaaaatgttcaccttttggcgacctaacttcatatatagggactaccttaaagtgaaatccatgcttgaaatgaatcccgtatcttaccatgtccatgtaaatgtgaatttacattgtacgtcttgtgaattcctggttgctttccaaatgatccatgtactatagaattatgatgagtgaacatttaacttttgagctctgtcgttccccccaaaaaaaaaagttcaagcattgtggatttggttgttttcangatgcatgcactcttttcaagaacacccaatgtattagtttcaagctatgatcatacctgcgatggatgctttcatctgaccattgcttgcttgccatccagcaattctggactcaaggatcactggacaagaacaaagctcttgtcgaatacctgaagcaatatggtgctgttagaactgataaagtggctgaagtaatggaaagcattgacagagcattgttcgtagcagagggccttactccttacactgacagccctatgcctattggttataacgcgacgatatctgctcctcacatgcatgcgacctgcttggagctactgaaggatcacttgcagccaggaatgcatgctctagatgttggatcaggtattcaggttcattactgaaacaccatactcctgtagtcctgtactatagcaaatgcggttgtttttagagtgccctgttgagttttctagaccatgcagttgtgtgaacgacttgctgttatccattagtattagatagttgagatacaaacaattttctaactattgacacatttcatctgcatgtgtaactcttgtaggcagcggttacttgacagcttgttttgcaatgatggttggaccagaaggccgtgcagtggggatagaacatattcctgagcttgtcgctgcttcgactgagaatgtccaaagaagtgccgcagcacaattactgaaggatggatctctttctttccatgttgcaggtatgctaagctgctaactggtctgatactggcactagaattagtgtattactgaacgcatgctttgcttccatcttggcgaaatctaaaatgcaaaatcactatgcgcataatatttcttgccgttctcaacgctgcagatggcaggcttggttggcctgacgatgcaccatacgacgccattcatgtgggcgccgcggcaccggagattcctcagcctctggtcgatcagctgaagaccggcggccggatggtcatacccgtcggcagctacttccaggagctgcaggtggtcgacaagaacgccgacggctcggtgaccgtccagaacgacgcgtccgtccgctacgtccctctgaccagccgctccgctcagctgcaggattcctaaggtcgacggctctaggaggtcatgaaaacacatgtaaatatctcgacgctcagtctacttgggtagttgggtagtttgattagtgctaattagtttcttctaacgaggttgagtagatggtttggtctgagacgttcagtcatggtcatctgtcagatgctgtagatcgagcgtgagctctgagcaatactcgataataaccaataaaagtacttcttagcctttcatatacgtgatttgtttcatgctaggaatgggcttgataatttctccattgagaatgttgttagtttggaatttggatggaagagaacaccacgcgctacgcagagatgtttctgtctcgaacacctctgttccaagttcagttccaacacccacaaaatagttcttttgcacaaatagtgagaatctgtaaattatatactctccctccattttaaaatgtttgttcgaccattcgtcttatttaaaaaaaatataattaactatttattcttttcatatcatttgatttattattaaatatactttcatgtacacatatagttttacatattttttaattttttttaaataagacgaacggttaaacatgtgctaaaatgtcaacagtgtcaaatattttaaaaaaatgtaagtaactatttattcttttcatatcatttgatttattattaaatatactttcatgtacacatatagttttacataattttcaatttttttaaataagacgaacggttaaacatgtgctaaaaagtcaacagtgtcaaatattttgaaacggaggaagtacatccctaattataatactagatgtacatctcaagatttccatgagttttagcagtaagttggctctggcacctacatgtaaaaacttcacatgggcttgaagtttctgtacgagatgaccgcgtaaaacgggtcggacgagcccgccatcccgaacagcctcatcacggcgtccagcggcgacgccggcttcccgccggcggcgtcggagggcagcttcctcaccacctccggctccgtgaacccgtcgacgcactggaagtactgcgtcacgagctgcacgcggctgtaggccgtgcccttccgccacgccccgatcgccttctcgtagaacatccggttgctgaagctcacgatgcacactccccccggcttcagcacccggaagatctccgcgaaaacctacacgacacaaaacaatcaagagatctggagaagaatgcagcaatggcagattggcgttcaaaatgttataattaaaaaaatcaagataaatcaatatatgatatatatttttacaaatatacaagttaaaatttgatttatacaactggaaaaaaacaataaatttgaccatgaaatacgtgttcttttcgtcaaatttattatttttgtttcaatcggtataagttgaatttgaatatgtatagttgtgaaatga

SEQ ID NO: 72284 - DNA, 3735 bp, Oryza sativa
gacacaatccagcagtggaattaaaattaaaccatgcacatgcatatgatgccagaacacgctctctagtatatatttcctctgatgcattcctgcagctagcagtacttgcatggattccattctctacagtacatattcccttctcatttctccatgctactctttgttttcattttctcttcccaaataaaaaaatatgtataccagaagacattcctatatttcttttttggttcttgtatttatcatctgatagaatatacagtttcagtcgggctctgcgctcagtttgttcccttccttgcgcagccttgaggacagacacaagccccatccctagccttaacttttccattgcttaacgagaccaggcaaagtttccctgtgatctgcagagcatttaacaacaagacagtgattgcatccaggaaagtcacacttgtgtaagaaactgagaagaaaatgatggggccctattgggtactattattggttggaggaactaattaatagtactacagacgatcagaatatgagtcagttgcatccataaagacaagcaaatcaagcctctttctaacttccccggctagcttgcagctcttcttccccccttctgctccggccctctcatagctagatcctcacatgtactgctgtcttcctcaatcctgggttcagatgtttcacctcttctctatctagccctctttccatcatctttggcacctgcaagagctagagctgtaaaagttagttagtgtcatttgatggatccagcaaggtactggatcttggccaggaggaagctgggagatcagaaggcgcctctcttccccacccctcacatcaccatcggcgccggcggcagctccacctcctactacgagtcatgggaggaacgtgccttcgcggaagactccgcagggcatctcgggggctgcatctggccgccgaggtcctactcctgcagcttctgcggccgtgagttccggtcggcgcaggcgctgggcgggcacatgaacgtccaccggagggaccgggcaaggctcaagctctctggggttgtggaggacggcaccggcggcgaaagccacggcatgccgccaaaccaaaagtacatgatacaaccatgccctccccaaattggcaccctgcagcacgcctacagcccaaaccctagaagtggcagtattctcgctgctgacactaaccctaattccatatgtgatgttgtcgcgtaccctgctagatccttgcttcaagttgcagctgctagaactgccttgggcaaacaagtcctgaacgcccctcttgtctcatcgaagtcgccgtcggctggtagagaacatggtaagagggagacgttgtttcttggtgctgttcgattggcacaggatcatgacacggtgagttctaatcttgacctgcgtgttgggaaaaatgaattgaagataactactgttttggggtgccgatcaagaagggactttatgtacgataacgaccgcgcggatgatgaaaagactgttgaagcaagtcacaagaaaagaagaatcgatttggaggtaaaccccctgattctaacttcttcaaccagtaatcatcaacagcaagatggtggtgatgaccaacatcatgaaaagatactaaaactttatcgtagctcctcggttgaagaactagatcttgagcttagactcggggaagccccaaaagaacagtagatttcatatccactgttgtatctcaacttgattacaaatgtttaatttgtatttattcaccactcgtgtttcattgaaatgttggtttgcactatctgaatttatccttgttttatcctatatgttaattctgcttatttccttggaatgatttgaagaaatcatttttctcttgaaagggaactgtaatgaaaaaaagaactaaagtgacttgttatatgctgtgtaagaaggtactgaattccaatttaaaaccttacttgcattgatgcacaaaaattatcacataatttagttgcaaaactttctctggttaaccttatatattacactaattgaatgaactgaatttgccagttaatcaaaacatcttgtggctaatctcgaacaatgtcaaattagattacgctaaacaaatatagttgtattcgtgtttatatcctttgttaattctcttaccccccatagatgatatgtgggaatagtgtatattttgtcaaagataaccacatgaaaaaaaatcaaaaatttgtcatactctgtcacaatgtgttgaattgtagttataaaattttatctagtagagcggttaattttatcgtgcaaatgatataaaactaaagttacagaaatatctcccagctgtactgctggacaaagggtttttaaccccggtttataaccccctatagtcccggttatgcaaccgggactacgaatacaggactacagatacccatctttagtcctagttaaaataaccatgattaaaaatatccatttttaggcccgattggtgttaccaaccggaactaaagatggagccaggccagctccagttggtagattttttttctttttttcattgttttaactttgaatattcatttcactacttccccaaatcatccccaaatcgatcatcgcagaaaaaagtatcatctctaaatctctaaattgatcatatccaaatacatcacaaattctaaaaaaaacatcacaaatacttcacatattcacatcacacacaaatcaaatacatcacagattatacatctcagatccatgcaatgaatcacaaattctcaaaaaaaagaacaaaaacaattttgcgatgtcgctgccgcctcctctctggcagaggcgccggccgcccgccgccgcccgcccgtcctactcgctcgccctctggcctgcttgcttgagaggataagaatagagagaggaaagggagaggataagaaaaaagaggaggataaagaagaggtgattgctagaggataagtgctagggattatatactatgcaccgatttttagtcccagttggtatttccaaccgggaataaaaagaatagggggcatacacttttttaaccaggactaaaaacgatctttagtaccaaccagactaaagatcataaaatagctatgggcttttcaaccggggctaaagatgatttttagtctgggttctttttggaaccggggctattaattgtggttttcggctaagccaacaaagattagttctccagtagggttgatagcataaactttagatggcacatgtgttatatcgtggtcaatattatattatctggttcttattatgcatgttggcaaagtattctcagccattatccatttctttttattgctggtgtcagtttaaattaattatattagtgctctttcaccgtgtcgtctattcaacgcgtgcaagtatatgaatatcaaacaattaataacaacggataatcagttcattaaaactcatatgtgctcagcttctataacaacggatatctatccaaagatcaatataattaatttacagtaactatgtcatatatatctgaacttttcatattggtagttaattttcaatatcatggaaaacatgtctatttttcccctgccagctgagatttaccagcataatatataagaagtttcttaccatccacggtaccacatatatttttatgataatatgtccttag

SEQ ID NO: 72285 - DNA, 36372 bp, Oryza sativa
gggcgaattcgagctcggtacccagtcgggattttctgcacacagttattaaaattcacaggaaatttgtggaattaaaatgagtttgatacgttccaaaaggtacttgggctcttagggttgtgaactaacggagcagcgattagcacgtgattaatttattatttgctattttttaaaaaaatggattaatatgatttttttaataactttcgtatagaatttttttaaaaaagtattatttagcagtttgaaaaggaggaaagttgtgaaccattggtggtatagaacgcagccttaggagacgatccaggatttcccttgcgcgtttactggtcttgccgctgcagaacggtaactacaagtgcccgaaaactatatcaagcattctaaaaaaataaaatatatttttataaaatttactcctggttatatccaattgttcacggatgtcgtggtaaggtaaagggtccatttgcatcttagcaatagaaaaacggaggaatagagaaaacataggattttgacaaaaatacaagtgtgcagggacctgcgtagtaccctaaggtcctgagttcaaatctcctatggagcgaatttcagattgggttgtttgcggggctaagttccctatttcaatggccgtatatatccggttggatgtagaggccgggtaaaaaatacccttctctaaaaaaaataagaaaaaacaagtgtaaaatactctctccgtcccaaaatataagaatttttggacctgacacggtcttcgagatgcttctttgaccaacaatatctataaaagtaagatgttttaaataaaaagagttgcatattatgatagtttatttaatgataaatatggttgatcttcttttttgctattaattgttaaagttaaaaatgtttgacttgtcactatgctaataatgtttatattttgggacggagggagtagatgattgaaaaatacagaaaaaacacaggaatgatcgtttgattgcaccacaggaaaaacacaggaatgagatgagaaacatagactcaaagaaatttttttaagaggttaaacatcttgctaactttcctccaaaatctctgaggattacccattacatacgaatttaaaaagataagataggattcaatcatttatttcaaatgcttccatagaaatatttttcatatgattcaaatcctccaacttttctacttttcatacaaatcaaagggccctaagacagatgcaatctggaccgttcatgcgtggtgcgtgcagaggagcgctgagtgcagcaccaccagggtcccgaaaagcggagattccccccttcctcctttggctttctcccccaacacgtcattccttcctttcctttccttctccactccgccatccgcaaccgccacgcaaacttcctctctctctctcttctcggcgcgaatccagaaccttctagaaggagagggagaggagaggagggcccccgcccccacgggtcgccatggccgacgcgtactggaggtacgccgccgccgccgacgccgcgcgccaccaccaccaccaccagctgcccctctccgccgcccccgccgccgggatgcccgccccgccgcctgctgcttctcaggtcgccgccgccgggcagccgctcaagcggccccgccccgccgacttctccggttcgcctcgccacacctcactccctctcctcgctggcagctgctcgtctcggctctgaagccggcgcgggtgttcactgtttatagggttttagggtctcgcagttgcaatgctcggctgttcttcttcggtcgtctctgggttgtctcacttgcgtgatatcgcgtgtgcatatcgtatcatgcatttcgtacttactgtttcttcgctagactgtagtggatctcccgacgatgcagtggcatttgttcgctatcactgaagctgtccatgaaaattgcacgctctctcggttttggtagcactgtcgctctgaggacactgttggattttgcgtgtgcttgatttcgatttaggatgacacctatcaacaatcctgcttgtcctataccatttttcacttataatttagtactagttgtggaatgatttagtcgatttaggatgacacctatcaacaattctgcttgtcctatgctgtttcagttatattttagtactagctagttgtgcaatgatttaggatgcagtagtgtctcgaggactgaggcccatatttactactaccacttttttcccttgcatagatgtacctggtgctcctgaaatggctggctattactctcgtgatgaagaaaggccagggtatcgtcctgcaagagacactgaggctcttaacgcttcctatgaacgttttctgcgcactggggtatcaaaacctgttcttaacacatactatattcaattccttaaacacattgtcagctgacacttttttcttctttttgtactacagcaaattcaatcctatggagctggagctggagctggacctggtgctgaatctattaggcctgcggcaggtggcaatgctggatacccagttgaggatcgtccaatgatggctggtgggggcatggaagccagaaatattggctttggtggtgggatgccagagcctccccttccaccagatgcatcaaatacattattcattgaaggaattcctactgattgtgcacgtcgagaagtttctcgtatccttaaatcccatgcctttttctgtctatctttaatctttcatttgcacaaattgtgggtgtaaattattcataatatgcctccatctcttagctgctggtccttcaccttcccccaagatatcttccgaccatttgttggttttcgtgaggtgagacttgtaagcaaagaagcaagacatgtaagtgagctttttggtgctgtcacgcctggtctcttgtttcgttcttgttcatccatctaagtgctttgctgttaacagcctggtggggatccaattctactctgttttgttgattttgaaactgctagtcaagctgctattgctatggatgctttgcaaggtgagtcagtgaactatagtttgttgacactgagccatttatcaccttttgatctcaaatttcttttggctgcgtaatgcccaattaaatctgacagctgtgggtacaccatgtgaagctgttgatccatctctcctatcagtgtcttatgagtcatgatattgaacttgtgtgttttcttctctatctttttccctgtttttagttatctcattgtcatgcatgcttataatttggatgctttgtttaccaagatctgatagatgcttgtgatggttggtaatttggggtattttgctaaaagccgacagtcagtttctttatggttgaatagaactcattcgactgaagtatttgtccttaaaattggtgtggagttattggccaagcagctaaaagtgggctgtgaaaatcttgtctgttcctaatttatcacctgaacattttgcttcacattgttaccatagctgtgactgcctttataatgcgcccccccccccccccccccacacacacacacacacaagatgttattgcgttgtctggggactaggcctgtggaaacactctggcagaaaatggcatagatatcaccatctatctatattactagtagctcgctggtgcttctcaaatggtaatttccccttcacttgacaacaactttagcaagctatattaattcccagtacggttatgatccacttatgatgcttgtcaatgtattctaattactgtgattcctaataggtagctgttagatcttgtttgtaaaaaggaatagctgttccatgatcatgtcaggcatctattgcctattttttgtagcatgatcaaagtaatcctgtcagtggccatctaaaacttttcaaggtcatgtacgaaaatagagtaattcgcacctgcaatgagttagttctctgtggtgtcttgggagtgagaaattacatggtagttgactggtcattgaaccgttcgtttgattgcttaatttccatgttttaaatcatgaaaattcatggttaattttgcaggctacaaattcgatgaacatgatcgcaattcaccccatttacggctccagtttgctcgttttactggccccaggggaggttcaggacctggtggtggtcgtgttaggcgttaagttgttcgtccttttatcaggtgatttgacaactctggctgctcaatgtttttttagaaacaacttgacctcaagttcttcggtggaccagataacatgagtcaatcgcttttcctaccttgtaggcatgatcacatcgaatgttcaagtgaaatgatgatagttcgttggtcgctctagatatattactccatagtgctaggattggtaaccttctgttgttccaagttccaactttggtgccttggctttgtgagatgctttctgacattaactagttattaaacatcaaagctgaaaacaattcgtggcatcgtgcagatgtgatgcttatggccggttatattgggatatatatatatacttctggagacaattttgccgattaatgcgtgttgggagaattttggtgcacatcacatatttgtgtacaacatattatctcccttccgcgtggtgttatatttagtagtctgttctggtttctgatttgcacgactcggcatgcttacattgttttgctacttgtaatcctctcggagattctaaaatgcctcctctggagcgaaaggtagaaattttacagctgcttccatgactcagaaatttcacatgttttttgctgaaactagtttaattcccacaaaacccctccaaaattatgtggtaaatttagatatgaatacctttgaactattttgcttgatgtgggctatgtggcctaggcctgtttagattcaggggtataaagttttggcgtgtcacatcggatgtacggacacacatttgaagtattaaacgcagtctaataacaaaacaaattacaaaatccgcatgtaaaccgcgagatggatttattaagcctaattaattcatcattagcaaatgtttactgtagcaccacattgtcaaatcacggcgcaattaagcttaaaagatttatctcgcaatttacacgcaatctgtgtaagtagtgatttttttcgtttatattaatacttcatgcataagtccaaacatttgacgtgacagaaggtaaaattttgccaatgtgacggaaggtaaaattttgccagaatctaaacagggcctaacagcatggagcaggacgatcgcatcaatcaaccgtgttatcctgtacataataaataaataaaagataccatcgagccataaaaaatgctgaaagagacggcccgcttgcctctattgtaaggcttgtagcattggatcgaacgaattgtcctcctcacagcgacgcaattctcccaaatctgccgtttcattcgtccattagctgaaaaagaaactctacaatctatctataaacagaaggttaggtacctgtgtctcaattttctcactgatgcctacaggtccggagtaaaatttgccgcaccttggacatggactgaaccaaaactttgcagatgcaggcagatttttgcacaaaaagtcaagagtccacataagctactccacggctactagctacaaaggcaggcactctggctctctggcacactggcacagctcccaactcctcccattatccatccatggcgtcctcccatcaccaagaagtacaagagcaaggccatggagatggagaggaagaggaacaagataatagccaaatcacctctccactgtgtaagcacggcaaagcctagtcgtctcagctgttttctttttcccgccatggaacaccactagaagaaagcaaactgttctgttgcctgatgagttcttctcgtgcagtgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtagaggtgacatcaacgtgctgcagtaataacagtacaaggtgtcatgtacactcatgttcatgaacttgagcttcattttgtaggtgctgggattcgggtgggcgggaatattccggcggtatctggtggagccggcggcgatgtggtggccgtccaacctcgtgcaggtctccctcttcaggtaataagcaaatagtaattcacaataatttactctccacatgtgctataaatctgattattcagatatagcttgcctatgattggttaaaaggagttgaattgccacttgtaaagtaatctttccaccagtagaatacattttttttgcgtcgcatgatgtgtgcagccagttgcttgcaattgatgtgttaataaggtacagctaagtgctagactacccaaagataaccaaccaaccaccttcccaaatctcaaaaccaacgtcaacaaaaaaaaagatactttgaactttgaaggacaaataagggtttttattaagctggtgttcaagtcgtatgttgtgtgaacagcactgaatacgatggcactgctattcagcaatatgctaattatataaaaaatattatctgtcctatatcatggttttgtcattttcattcataataagcagagatatattggcacatcatgaattgtctaaaaagtagatattgacataatgactcaagcgaacaggaatcatttaccagtcaattcaataataaaacccacccagcatcatcttcatctgaattctacgcaacaattaggagatttaggcgacttggacactcagctatgcaagtgcatgctgctgcagaaaaccagaattccgtgtatttggagatatcctgagtaataaaagaagcagtcaatcaattttgacagataaaattcaaagaaagaaaacaagatatataaaatatcatatcacttcaattatagacgaagagcagctattaaaactataacaagatttttcgtcccaaaccaaggcataacaattttccatttacgaccaaggaaacaagatcagttacaaccagcaacaagcatcaactaaaccttatacaatatcaagattcatttgagtaaacccgactagacattttaaaacaagatgtttacttccctagaggcttcaatgatttgtcagaaaaacatggatacaatttgtctgcaaataaaaaaaaaggttcagcattttgttgagatgacacttataaatcataataaggcataaatctgtgttgctctgccaatgagtgaattcatctaaaactttcagtggcaatctgaaaagtgagcttaatagccatactggacacacttgcaaatgcagaatcaaattagcagtaaaataataactttctccgtagtcaaaggatggctaaaaaaaaactaccatagaaaagtgaataacagatttgctgcacatgttcatcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttccctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaaggtatcctccccttccttctccctctaggtctattatgtaaaattagatacacagataaatttgtgacacctgtgtccagtgaaatttggcagctaagcagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccaggtaagaagtaaaagcataaaggcaaatgctaatgcacacatccaagtgtagcacttcagcttattatactgtatgtgacagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtcagcttcactagtcacatgaataaatgggtgtattgcttgtaaaaaaggaggataagcagattatcattttattcagtgttgattatgtccctaatagcaattcaaaaatagcaggtggtgggcactttgatagcagcatttgtgtaccttggaacagcatggtggctcatggatacaatccctaacatatgcaacaccgagctcctccccccaggcagcccttggacctgcccttatgatcatttattctatgatgcatcagtcatatggggccttattggcccacgcagaatatttggtgatttaggcacttattctgctgtcaactggttcttcttggggggtgccattgctcccctcctcgtctggtttgcacacaaggcattcccaggtcagaaatggatcctacttgtcaacatgcctgtgctgatcgccggaatcagccagatgcctcctgccacttcagtcaactacacggcatggatatttgtagcatttttgtcaggttatgtggtctataagtaccgtcgtgactggtgggagagacacaattatctactttcaggtgcccttgatgctggtttggcattcatggctgtcttgctatatttatgcctaggactagagaaaatcagtttgaactggtggggtaatgatttggatggttgtccattagcttcttgccccattgcggaaggtataactgtacaggggtgtccagtggcaagtgcatagccaagtttcttctcatccacagtaccgccggcaatggtatctcaatcatcttaaggaggatgcaaagatcaaagaaccatgcagagaggctttaaacaactcaaaatgaagaccaaaaagaaaatgtccatatgttacaaggaagatgatactacaaggtgtaccgaatacaaaaataagtaaagttatttggtgcatgctaaattgttgccggtgacagaaaacagattatgataatagatgaactgaatttctgaaaccaacactgaattgaaagacagtagccatcgtccatagaaatagttaaagtctgaacatgattccacttacctgtaaaggtaacatcaggatcaccttagcctttaatcatcacaagaaccttgcaggaaaaagtaagaaattcagatgttacttttgctttgagggaaaatgaaacaatacggtcagcatgtaatcctgtatgaaacatggataatataaactgcattatatattgtttcattggaagtataaacagttctgattcatcgtcatgagctagcatatgctactagaatatggtgggaagtgcggtgctgttcacctactatcggcattccatgatttctcaactctataatacacacacacacacacacaccacgattgcaccagcttcagtgcagtatgactactcttacggttctcgctaggaaaataacagagaatgtgaatggacgggtgaatctacaaacgtactctttccgatccaaaataaacttagtgctggatgtgacacatcctagtacaataagtctagatacaaagatattcagattcatcatgtgtgacatccggtacgaggttggtttattttggaacggagagaggaacaaatacagcaagggggaaatcatggagctgttgcccgaatatacttaccacttgccatctcccgcaacaataggtgtactctgaggccttgagcaacacctggtggaatactggagatttggagtgcgtgatggcatcatccagggcgtgctacgcgccagcaagccgggtaggcatttggacgagcaccgtgtgagcgaaaccgacgccgcgccaccagtgtaactttgggaattgggagcacctcgagcgagcgaggccgcacgccgccggggacgaacaggagccagagccggttagcggaggaaggtcttcgcctagggtttaggaaccagaggcggctgccggcggagggcaaggggtgcgcgcggcgcaggagctggagaggtgagaagcgcgtgggcgtttggagaagaagcggatggtgaccgcgccggccgggggcgtgtggagcgcggcggcgaccgacgaggtcgccggcgcctgacgcggcttgccgcgtgtccttgaagatgggcctgaccgggccggccttttagagatgtgggtgggctggatgggctgcatttcgtgaggcctaatagcaccgtggaatacaattcagattagcggacgccaaaactgaagctcttcagagagagccaaaaaaagaagaagaagaagaagcaaactataacatctcttttggacgacacatcaaccaatgcaattcagttttgaattggataccatcaaaacaagagcaaaataacagatgaaagatggaagtataactttcagatgacacaaacttcaccatccatggagaaatataacacatgtttcatttcattctgattctgaacagagattacatgtagaatgaatgatgaaagaatttgattgtaataataatgttgtataataacagccggagacactaatagtgactgtgagagatgctgcccctgctaatctatctactgcttctttgctttctttcttctacatgcagctacattttgcaggggactctctctcaacagccaaaagaatatttataaagaattacaatctaaaaattgaattgaatttgatttaattgaatctttccacctatcaatctataaaacaaaaaactacacctttctttcttctttcttttctctgaatgtataaaagaattgtcatactgtatgaactaatcatcattaacaaaagaagcactgtaaaaaaaggctttgttctttctttctcttcacctaatcaccattcatcgtcagcttagctttgctgagaatgtgatgctgttgtggacgccgacacggtgctgcctcccgcgccgtcgcccgccggcgtccacgccgtcacggtgtacagcggctggtccagccaccggagcgtgagcgcctcgccgccgccgctgccgccgccgccgtgcgcctgcacggtgtacttgtccggcccgaacatcctcgcgatcatgcgcccctgcatcgcctcgcgctcgccgatgccggcgttcttgaacccgccgccgtcctccatgcgccgccgccacccggcgaagctctcgtggcgctcgaaccgctcggggccctcgaacgccaccgcgttgcggatctcccgcgcgaacatctcctccgccttggccctcgcggggctcgcctccggcagccccgccgcgtccaccgcgtcgaacgccgcggcgtagtaccgcagcgcgcgcgcgaaccgcgcctcccacctccccgagttgaggccgccgccctcgtgctcgccgaggaggaggatggtggcgcccgtgctgcgcgctagccccaggaagtcggtcagcgcggcgtcgtcgcggagcaggcggtgcatggcgaggacgcagttcacggccacgcactcgccgcgcttgacgtggagcatccacaggcggacgtcctcgagccggtcgaccacggcgtggaactcgaacgccaggccgagcgcggcggcgacgcgcgccagccgcgctcccgtctcctgcagctcctgcctcgactcgccgactccggtgatccgcacgtgcgccggaggcaccgcccgcgcggccaggctctggagcaagcccggccattggagcccctgcttgatgtcgaagtcgatgacgtggacgcgctcgtgcccctcgaactcgcggaggaggcgctcgttgagcgtgaagtgcaggaacctcgggatgggcgtgatggcgttgagtatccgcagcgccatggcgtcgtcgtcgccgccgccgaaggcgtcgtcggtgagctcccgcggcgggccgatgtcgaacatgtgcggccacatgcgcacgacgcggagcgcgagcgcctcggtgaagtaggcggccacgcggtgcatcggcgtgggccccgccggcgaggccatctcgccgagccgggccaggtagtagttggcggcctcgtggttgccggcggagagggagtcggcgcacgcggtgagcgcgcgcaccagctccagcgcctcccgctccgcctgccccggcgccggcacgccgttcctcgcgtcgaactcgggcggctgcggcggcggcatcatcgccgacgagccgccgtccgtgcccgacgaggacgacgagtcggacggcgacttgctgtactcctccttcttggccgcggccagcgatggccccgcggcggccatgccgtgcgggaacgccgccgcgctcggcaccaagaagaccttctcctcctccgcctcctctccttctcccgccgccgtcgcttgcatcgtccctgcaatggattgatggaaccatacctcatcgccgtcgccgcccatccgcgtccgcttggcgcgaacaatggggccatactcctcgaccgcgtcctcgtcatgcgcccgcttaacggcgcggtgggcgccattgccattgccgccgggctccggcttggcgccccaggacacggactgggtgaccggcggcgcggggtgcgtccggaaggagcaggtggtggcgccgctcctggcgtcgccggcgacccgcggggcggcgccgtcgccgcggctgccgcgcttggagaagccgcaggggaggatgtcgaaacgctgcgcggtgctcatctgatgcctcgacgacgagaacgagcaacccgccaacatcccggagacacgtcactcgccggaacgcgacgtgccaagaagagacctcctcctcctcctgctcctcctcctcctcctcctcgtcttcttcttcttcttcctcctctgtttctcactctgatttctctcacactctctctgtggtatctggctaaggctttggtggaatggaaatgtatatgattcgatgtacaaaagaatgagcagataaaaaccagatgatcttgttgttcttccaaagaatttggtcagtaaatcaacaaagaaaaaactgagaaaaaaagagagagaaataatgtttgtgagatcagatgggggctatgtgtttgtaagtatatatgcaggaaagaatgggtggcttcgccttagaatgcttagtacaaaagaatcaaagaataggatcaagaacaaatgggccctaaaacatgtagaaaaaacaaatcacgaacgatcggacatgccggggcagagcccgcacggcctcctcatcggcgacgacgacgacgagcagcaggcggcgaatcccaacaatacctccattcgtcaaaacaacaaaccaaaagaaaaatcaagaaccctagtagaacatcctaaaatgatggatgcaatgcgaatcaatggcgatggagatggagatgcagcctacaaactacgctatcctagtgatgatatgaaatggaacctactcttgttgcctcaccattaccactcctctctcactaacctctccggtggtggtggtctctgctctcactctctcactctcactcacctctccggtgtggtggaagggaagggaagaagaggccgggaggggcaacccaaggggaggaaaagagtgcgggaggcgcgaatctcgaggcggctcccacgccgtcggatcgcgaccggacggtgcgagatggggtggtccgggatgtgaccgttgcctgattgcctccccccctctctggtcaatgtgaccgttgcggtcaggtgcgacgcacgtgaccaccccccctaacgctgtcacgcacgcgtggacgcggtcacgcagcacgcccccgttcttttgttaccgttgggctcccaccacctgacacgcgtgtctgacgcgtgggcccccgcgccgaaccgacggcccagatcgcgtgagccggacgccacgcggtgcggccacgtcagcgcggcaacggacgctgagctgtacgtacaggctagtgtacagggtggggtacggtgtgctgtacgacgtactacgtggctgtatcctgcgtgtctggtgatgatgatgtttgtgtgtttgccaccgtcggatcgggacacgtacgcacgcatgcgtgtcccgtgttttggcgtcaatgcggggctcagttaatgatgtgccattgctgtcagaaaaaaaagtgtcattttggtacgtgacaaaataccgggtgttttacttgcagacagctattgtcattagctgggttagctgctggtatatttgttttggctactaagtaagctcgagttttgggtttgttttgatcttgaaatgcatcattgtgttgtgccaccacttttgagtcttaatttgtttcttcctcttacttgaaattttgtgggaaattacaagaaatgcgacggtgatgagtagcatcggatcaagctgtacaataaccgttacaattgaaatgactgtttagtacaaccgttatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaatccacaactgcagttcatagggtccacgtctaactactggagttactcataaattcatatccaaagagccatttgtatttcatacacacagcacctctctaacaggacgtatagtagcagtaccatccaggaacattatggtaacaataaatgaagtttcaatcggatgttattcctggcgcgagcttgaaatcttcaaatcgaaatcttaaaggcacatttcctaaatgtgtgttttatactaataagaatttaacttctcctctctcgtttcatatgtacgcatttcctcaattattgaacgatatgtttttataaaggttttctatagaaaaatattaaaaaacaaaattaatttagttttaagttttttatataatacttaatttattatgcattaatgaatggttctgtttgacatgcgcagcgagaagtttccaaccattttaccgagcacaccctaatttgctttacctaggccgtgtttagttccaatttttttttcaaacttccaacttttctatcctatcaaaatttttctacacacacaaatttttaacattttcgtcacatcgttccaattttaaccagactttcaattttggcgtgaactaaacacacccctagctaaccggagaaagtgtgaggtccaaagcaatagccgttattccgttacaggctttattacaggtcttcttatcgccggtcgtacgttggcccacaatcccggcccgctcaaatcttagctctaaccacgcggcccaacctggaatttgggcccactacacaactggatgttgggcctgatctgcgacaggtgccggcccatatagagtggatcgcggcgcatttaacctccttttccccaattcacggggcggctggcttgacgcgtcatcttccccgcgaaaatttcaaagcagccgaggagaaatccaaaatttccccccaaatctttcccggcacggcgccctcctgctccttccctcgcaagccacccccgccgccgccgccaccaaggcgcgaaatccaaaattcgcgcgcgcccgccgctataaaggcgaggaggggatgcctcctcctccacacccactcgccgagccaactccaatccccaaaccaccagatcgaatcgcggttgccgcggcggaggcgaggaggaagacgaggatgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggttcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctgatcacatcgactgccatagtagtattaaagtagaaatacatgttctcccaaagtgttcgtatggtttcttgttttatttgttctggtttgacatgtactcctgtaatgaatcaagtaaaaagtttctcaatacatcaactggtcattgcctgtatgcggtgtgttcgacgaaatgcttattagaactcatgccattctgggggcgcaaccagggcgttcgatgaaatgtctctgagcataagatgttccaagcgaaggagattgtgttggggaaatggattatggatcgcttggctccagccgcacgcgcgtcgcctgttccgtttctgttcaccaatccccttcccttcaatccttcccgaaagacgaaacgagcgccgcgccggcgactccaaccaaccgtccaacagaaccaagagttggagacttgctgacagctgactttagcattcgttttcccctgttggcctctcctacacatgaacacatctgttttagagctaggagagagtttaagagaaagggttcagatcggcgattcttgcagacaaccatggtatgattttcttgattattacataggagtacaatacaactaagggtgtgtttatttcacgccaaaattgaaagtttgattgaaattggaatgatgtgatgaaaaagtttaaagtttgaacaaaaagtttggaactaaactcggcctaatatatttttttgctgccttgcaaggttctaaagactatataatatatttttaggtgtttttttaagagattagagcttgccttcttcatgtttcgttgacacgttttcagattccagccgatttgcaatttgcaaatcaaggtactactatattgtacatttgtactactgttcttggtattatgtcagtcaggaagtatttatctagaagtgaaaaaggaaaaaaaaaaggaaacgagtagatgagttaactgaatcttaatgggagcaatcgagaagttctttaggaataatactgattcctttagaaatcccgatgaattggctttagttgttttcaacgagcaaattaatgacagttctagagaataccaataaggcaatagcatcaatcagaatgaagatgtcaataacttgagtgagcatgaaacctaacatgattcggctgatacaaattctgtgggtgttgatgaacaaccaacttttgctattgaatttttgatccaagaaattggggtaatcttgataataaagcaggagatatctaaataccgatttcagggtgcaatctctaccgaatcattgggccacgtggccaaagctaaaagcaagctcacatctcgttaaaatgtgccatgtgtccagaagagcacgttccattccgcacgactgtgaagactctagataaaacaaaggaaaaatccagagcattccaaactcggttgaaaatcacaccaaaacacggaaagaactggtgaaaaagattgcataccgaggaaacaatggagaagaaaaaaaagtgtctaaaaaagtgccccaagttttttaaaggaattttttttaaatctaactataatataattgtaatataattccactataactatactataacaatattataacttgtatataaggtcctttttagttggtgaaatgaaaatttttgggtatcacatcggacgtttgaccggatgtcggaaagggttttcggacacgaatgagaaaactaatttcataactcgctggaaactacaactatactatactatatattgtagttacactgcaactatactatagtaatatttgaaagtttttttttccaaaaaatataaacagcgagccgatgttagctgtcgtaaaccggcgacgaggaagacatctacaacagtattttccggatccacggaagctatttccaacgagcaagatccactcactcaacggatcaagcgaagggcgtcgagccgtaccagctgtgatggtccgcgagtgtggacgcatcaaccagccggtgagcgtcgaggtcgaacacgtccacgccatccacggtagcaacgaccacgacctcgagctcgaccacatccaggagaaagagagagggatgaagaagggcccaatgaggatacccagatttggaggatcaagggacgagggcgatgttgcctctgctaccatcatcttcctctttttctccttattctcgcaagcgtcatcttcctcaattgctcatgcctttctcccagcaccgacgcggcaatccggccttgttctcgcaagcgacatcttccccaacggttgtcgcctttctcccagcaccgacgtgccaatccttgttctcgcaagtgtcgtcttccccaaaggttgtcgagctgagaggtaaaaagaaaagaaaatattaaaacatgaggttttatcaacacttatcataaaacaaacaaatgataaccgtaatattgataagtatatgttaaatattataaaaataataggtatatttgttaaaatattattaaaataatgtgagcgatgatgattagatatacttacatgttgatttgtagaattaaataaattatagatgatgttatacgctagcatgagtttaaatatataaatattgcttttatctgtagtgattgggccacgtgtcctctctcacatggtagataaatctggagaacaccaaaaggggaaaaaatgataccaagagttgggcagttgtgcgtcgagtgcgaaggaaaaaacagggttgtgggtccaatcaatggcgtgcccacatataacttaccggtgtcacaggacaccgggtaaaattgttaaattctaactaatttatgctattttgattagtatactagtgaataattagataactactatgtagtggacctcgagtaatgtagtggaccccgggtaatttttattctagattcgccgctggctccaatcctcccttgcagatgaaaggataatctaaaaggatcgattaggcaatcagcaaatgcctctgtcaatggagccaatggtggccacctgctcaaaatgtatacgttcgctgtgtgtctaggagtacgagggaagagcatggctgtggcagctccagtcctctcacgcagaggaaggataatctggaagtatctatatatcaggggaaggagcaaatgcctctgtcaatggagctcacttgctctacatgtacatgttcaaagatagagtattctatagtacatttgcaaaaaatgttagaatgcatatacaactactcatattcatatatatctctataagtattttcgaaatattgagctgcatatcttaaatgaaaaaaaaaactattttatctcttcgaaccaattcaatggacactactaaaaaaatctatcatgagttaataacttaattgtaatttaaaaaaaacaaaggaataactaatggcatggatggaaaaagggagaaaatttgatgattttctcaacaatatgatctattacgttaaactggaactcaaaaaattccattcaactaagatttttttaaacttttatgaacaatgtgctaattaataacacaaaaataatatatacgggctataaatcatgcgcgccaggtgcgcatgattttctagttttagtggaaatggggcctacaagagaagaaaatattgttttttttgttgtgttcaacttatgaaaagtattattaggcgattggaaattggaatgacagttagtatgacttacggatgtttttgttcaataatataatgaattattatattcactattgcaaaaaaaaaagttatgagggcctctatctttatttcacccaagggcttccaagaagttaggactggccctgaataaaaccttcattggaatgaatggatgaattttcagtgtttgttttgtgagaatcgaactaatttcgatgatgatcctgtgaaatcttaaactattttctcactaattacttcaggctgtgtttagttcacatcaaaattagaagtttggttgaaattggaacgatgtgacggaaaagttagaaatttgtgtgtgtagaaaagttttgatgtgataaaaaaattggaagtttgaagaaaaacctttggaactaaacacggcctcaatcttcgtaaaatttctccgaaattcgtcaagtccaaaggctgcatgccttgctgaattctgtccacacaacaaacgctggtctcgtgtcatctccacatcgccggagaagaagacgatgatgacgtcgacgacgatggcgaggcccacgacgttgctggcgtgctgcaagctctacatctccgagagccgcaacgacgccgccctgcgcgccatcgagcaggcggcgcgcggcggcggcggcggcgccgtcgtcgtcaaccgcttcaccgacgacgcctacaaccgggtgggctacacgctcgtcgcgccgctcaccccctcaccggcgccgccgccgctccggcacgccgtgctcggcatggtcagggcggcgctggaggccatcgacttcggcgcccacgccggcacgcacccgcgcctcggcgccgtcgaccacatctgcttccaccccctcgcccatgcctccctccgccacgtcgccgacctcgccggagccgtggccgccgacatcggagacgagctccaaggttggtgctgctctccactcctcttctcctcaattttcacttcaagaaacaatctaatggcgagctcgccgctgccgaggccgcagtgccgacgtttctgtacggcgcggcgcaccgggaggggaggacgctggcctccatcaggaggcagctcggctacttcaagcccaactcctccggcgaccaatggcggggagcgccggagacggacgccctgcccgtcgcccctgacgccgggccggagaggccgccgagatccaagggcgtggtggtcgtcggcgccaccagctgggtcgacaactacaacgtgcccgtccacaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgatttttcccaggataaaatcgtcgacttatacttcagatcagcagccaacactgagggttaactgcagcgcgagtgaaaagtaaatctttacagaaataaatttgatatgatttcacagaaacaagctctcaaccagtggatcactgatgagttctaagttccaactcaagaaatgcaatcacattatcatgcgtaaaatttaccaaaaaaaacagaacaaacgaattgattcaacttaaacttcggtctctgctatatatatatatagagattacatctcaactgctggccagttgattgaactaatcatttgcatatcttgggctacttaactcctgactgattaagctaaacctttagtttgtaccgtgatggccacttgattgaagcggctagctatctctctagctaggctcagtgaagattttgcgagggaagctgagattttagaagaaactgagagtatgtctaaattttcagtgaaattccacgtttctctccattagagttaagtgagttttttaaagaaaattgttactatttccactagcaaggtatatgagacaatatatcgttttccaagtgttgtcactagttaccaattgtttcttacacttgccatctcataaacccactaacctcgcgttattaggtacccatatataaagaaaaataagcgatttaagcatataaactccattgcttagctcttaacattatagcactccctctctctctctctctctctctctctctctctctctctctctctcttataatagttgtataataatatgaaagggaagaagtgttattcgagttctcactttttcttttttctttttacttcaattcagcagactgatttttttatgacacatgatgtatggtatctcgttggcgtatctcagtgaaaactatcatgatggagaggattagaaaagtcagaatatcattggtagtataaaaaaacacatggaggcaactggaaaaggcacaaacaaatctaaccagacttagtttggactaatcagctcaggtcacagggagctaaatgcttaggcttgaacaacaactacagtaatcctcctgtccacttgtgaaacacaggtagaggagatgtagatccagaaaaggcattcttctttaactaaggctgagtttagatccaaagtttgaatccaaatttcagtccttttccatcacatcaacctgtcatacatacacaacttttcagtcacatcatctccaatttcaatcaaaatccaaactttgcgctgaactaaacacagcctaacctcaaattaaacaatcacaatggactgatccccagaaacatttcgatatccagagtcttcttgtgcattcatagaagaaaatattcagactttttgcagatctgaaccagcctttgtcagattgggaaaatagctgtttttgttgttgcaaggatagattcttacatacataccatggttggtggtgtcatgtagaagtagttagtttcagaacttgttggccggttgttgcctaccctgtttgtcactgacctggttagatatctctgaaaagaatgaaaaaaaaaagtattagctttgacaaacgcacacacccatccaataaaaaacaccattcgtgcaagtacaatcctgtggtctgtcattctgtaaatcaacaagaacatgagcagcaatttttcaacgagaacacaaaagatttgcgtgaataagagcaacaaaaccaggccaataaaccattcttgacacttgacaggatacagtgacactgtgttgttgcacatggtaatggcaatcagctattgagctcaccaagcactagcatccatgacactatgacagtatgacatcttgcagtttgcaacaggtgtccaccttccatctcaagcaagcacctttcaaccacctcccctctcttcctcccttctccacacgatctgaattgcacaacagtgaacgaatctgaactatctgaccgaggagatagcaaatttcagttcttgatcggtgattgattcagtgattattcccaaatttccagtagctggcaaaggggaggagaagtcagcggccatgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggttagttacttttaccgcgtttacttctcagattaacctggtgatgatagtcactgactggtgggcccagtcccgagtggagtttttccttgttggttgactggtggtcaacgtaatctcgaccgcacatctctgatctgacggctagtggtagagtttgactggttgaggttgatattttacaatcgagtccctattttattttccaaaatttgtttgcaattcaatccctatgaaattcgggctgctatcaatatttctccaccacagttgtgttgttttcatgtttttttttactgtttcttgatcatcagcgcgtagatcagtgtacactttttggagcttgtgttgtgtaccagcgagttaaacacccatgattgtgtttcctagtgctggtttgtttgtagtgaaaaatttcctgatgtagcgagttaaacacccttgtttttttctatcgtatttttgccaaaatgtaggggaaaaaacccttttttttagccctgcgaaaaaagtatggttttttttctactgggtaaatgcctgtggatctccatgtagtcatctgtgattaacaccttcaccagttatccttgccttatctgtttgttaattgttggattaaaaatgccactaggatagttgaatgttcacaactagtactagacatagagtacatggatgcttcgaggacagacagcaaaattagatatatttggatcagcttctggatgtggatcaaagctggttttatgttaactaagtaccctctccatgtgtagagtcggtgtgagaaattgaaaaaagaaacaatggattaattgatgttaggtctgagtcggtgattgatatctagtttggtaggagagttcgatagaagtgtgcacatggaattgtgtactgatgagagcttatttggataagaaaatactaatcatagtccaactaaccagacggcagatagctttatctgaactcaactgtgcatctttggatctggttgctcgtactccctccgttcttaaaaaaaataatcaaaaatcaagtttttaaattagaaattggttttctttcaggacgaagagcttaccttactaattgatcattcttgctacctttgtgttcactgtaaagatggtacaagatgtctgatgcgacatatatatccagctatcaacactattgaacaaaatgtccaagacatgattttcttcccccttgttgttggcttgtgtttcttggctaacttcaaccggagtacgacgagtttaacactagtatcgtttacccttcggcctgtaatttaatcatcataaataaaacgatggttgtataaaacgcgtcaaataagatttctcgtaaacaaagttttttcatcagacaaatcatccttactcgggaaacactcatgcatgagtcaagctgttggctatgacaattgatgagaaatgcccaggggttttccggctagctccacagggtggtgggctagacgacttgggttcagagcttcacctcttctaattatttgatattaggtcatttcctaatatccgtgtcttctttgctatgacaattgacaaatcaatctgatgctaatgtgcactgtctactactctgaactctgaagtgtgaacgaaccacatgtgcaggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacagtacgtgctttgtaactccaccacctcaaatttcacccctgcaaaatcaaacttgtgcttaatttgatttggaagccaccaagttgacaggctttttcgaagttaaggacgagattcggtcaaacttttgaaattccaaccatccatggataatacctcaaatgcttattttaaaaacgaaagaagaaaaagtactaaagtagtatcattgtatcatacttattataataaaaaactagcatggtggcccgcgcagattgcgcggctagtatcattatattttctctcatataatagcatatatgttttctcattatattattcaaatatattaaaatgacaacataattttaaattttgcaataactttacaaaactactaatgtgtaatattcatattatattttatatatgtttagttattaattatttttaatatcaaattttagttatttgtaaattatatatattcctatatggactctagacttgtcttttaatatttattttttctaattccgaattttctgtaaattatatttctatataggctctatgctcttcttccaatattatttatttttatttttgaatgttcatattatattttatatacgtgttagttattaattatttttaatatcaaattttagttatttgtaaattatatatatatatatatacatatatatatatatatatatatatatatataaaatttaaaaataactatatatatatatatatatatatatatatatatatatatatatatatatatatatatatatatatatatatatatatatatattcctatatggactctagactcgtcttttaatatttctttttttaattctgaattttccataaattgtatttctatatagactctacgctcttcttccaatattatttatttttatttctgaatttttattatttctaattgtatttctatgtggactctaaactcatctttcaatattctttaatttttagttttgaatttcagttacttctaaattgtatttctatattgaccttaaactcttcttcccatgtttttcttaatttcgaattttagttatttgcaaattatatttttatacgaactctaaactttacttttaattttcttatgtttattccaaattttatttagtttaaaatccctatatggactctatactctacttctaatattcctttttttaattccgaatttcttttttttcttaattgtatttctatatggactctatactctacttctaatattccttatttttaattccaaatttatattatttcctaattgtattcttatatggactctatactatacttttaatattccgaatttctgttatttcctaattgtatttctatatggactctatactctacttttaatattccttatttttaattccgaatttcagttatttcctaattgtatttctatatggactctagtctcctcttctaatattccttatttttaattccgaatttcaactatttcctaattgtatttctatatggactctagtctcctcttctaatattccttattttttaattccgaattttaggtatttctaaattgtatttctatatggactctgttttttctttttctccgattaatgtgagaatttctaggccatgagagcgaacgtagaaattctattcctttaataatataatagatttttggtcgggaatttcgaagtttgattaaatcttgttctaaacatcgaatatttatgatcggaggggtagctttgattgatcatggcaatatcaacaatggttgttgcatttcagacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccattgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgcatgtttatcacctgaaaatgatccaaacatgattccattcgaatgaaaatttaagatttgatttgattaacaatatgtagttttacacattataccttaaatctgtagtttcgtggtaaactcggcattaaatctgtagtttttttatactccgtcgtaaatatgtagttttacaatagtttggtcaaaatatcagtagttttacgaaaaatactcaaaaacatttataaactcttaaaaaaatgttggcttcgtttctgaaagttcttgaaaaatgatttcaaggtatgtgaacatggaagagtgcatcactcccctaccggaggtgtccgggcccggagacgtcgccggaggggaggtcaagagatggccggagaggcttacatcgccgccgccgaggatcgccggcggcagccttggaagcagcgtcacggtggacacctttatcaaggattctgagatgtggaggagacgagtcgatcgctacaagggcgtcagcggcgggctggccgagaaaggccggtaccggaatctgctggacatgaacgccggcctcggcggcttcgcggcggcgctcgtcgacgatcctgtctgggtgatgaacgtcgtgccgacggccgccgttgccaacacgctcggcgtgatctacgagcgagggctcatcggaacgtaccaagattggtaagctgaaaattcttctgaccaaaatatgttcagtgtcgttgctaatgcaaaatcttcagaaaacaattgcagaccagcatatgtgcactgctttcttcttcagtgtattcattgctgcaaaatcttcaaaaaaaaaaataaaattgcagactatcatatatgcacaggcgtgtaagcggattgacccgtgaactcacttataagctaattaagtggatcgatcaactggttacccacttatttggcgaataagtgagttggtgggtcagcccacttacactccagcactgctttcttcgtcagtgtatttgttgctgcaaaatgttccaaaatttacaggtttattggtctttaattagtatgtgaaaattttgcaggtgtgaggcgatgtcaacttatcctaggacgtatgatctgatccatgcgtactccctgttcacaatgtacaaagacaggtactggattttgcttctgtttcttgtgctcaactttgcagttgctccagccatgaagctagctgaatctattgctgttctctgcatgtcatcagatgtgaaatggaggacattttgctggagatggaccgtgtgctgaggccagaaggcacggtaatattcagagacgatgttgatgtcctggtgaagatcaagaacatcgcagacgggatgagatgggagagcaggatcgttgatcatgaggatgggccgatgcagagggagaagatccttgtgtctgtcaagtcttactggacagcctaagggttcgcaaaaatggcattcatcatgctgatgatcattttgagctatagattggaacattggaggcagatttatagaaacagatagtttcagttgtcccccctcttctagtacagatagtttcagttttctcctgtcttctttccatatataggttctttattttcttaaaattctctcatattgttttagttttatcctttccatttcatgccatatggagtagcttttttttatttacattttcgttttctcctttctctttccttccatatatgtcttttcttattattttatctgtcaatttatctgacgtaaacggatattaaagaaataggcaccatttttgttaaggtgtgaacagtcactggatttcggattaacatgatacggagtatacatttattacgttcagcttctttacggtttagaatgcggttaaccagaattgactttcatctggtaaaattaaacatgccgctaaacaagggaccataacaaatagagtgaaatttggaacaggacagccaagtttgtccccaaaagctcgattggttgagcagtctgaagatgagaagcaaatgcagattgacagaggacagatgatcaagacatccttaatacaatctagaagttcgtatggtaatcacagtatggtacatatgaaagaaatcaactgacctaactcgatacaaacccaacaaaagaacaagggggtcccaaagtggcacccgatcacatcaaacatctctgcctcgaaggacccagtattgtcaagaataacatcagccaagtgtaaaataataatacacaaggaaaagaagagccgcgatgagaaatgtgtacattacaaaggcagctgggttctgcttttaacaaccatgtccgtgccctactgaaatctcagttttctccttatacttcatggttgctaatttacatggataaactctccagctctttgagaaagcggtttcaaagatcatatacattgctaaccaatctatcactcgtgaacaaatatgtttgtagttcaattcgtcaggcttccttacagaacaaaccacaaatcaatttgagagctggaatcttcctgtcggtttcctctttcgccatccctgaacaaacagttcaggacaaataagcaagccaacatttttccagattttcatacgaattgactgaatactttggaagaatgcacttacaaatattgcatagtaaaagagtgtgagtatcgcaagagccacaaagccatactggaaaacattgtacctgcatattcagatgttaaaatcagaacattttcaaaagtttgatgctccaatatccaccacatggatatatccagcttattcgagcaaacaactgtaaactgactatggatttgcatgctagatacatacttgtagagatacttaattccacggagagattgcagtgtgtggccaaagatctcctgagctgcagttgcttgcgcataataagcaaaagctgtggcacagaactgaatcacactgcaaaagattttagatggcctcttagtggagaaaattaacagataatcagcaggtatgcatatgttatggaggaagcaaggttgatgaaaccaacaaagtcgcatgtcaacatgttgaagcgatttttcagctgcactaggcacaagctaagctacgtcaactcaatgtttgctttacaaaagttcttcatttacactactgctaaccgttaaaggacacactgattttatatatagaaacaatttcagatatatgcaacaaattcacaattaatagacgctaccttgtcagcatggaaaaagttccaatatggaagatggcatcataatttacaaaaataatagcaataaacaattacatctaaaagaagcctcagtagcacacctgatggagcaaagtaggatgagtccaacattaaacaggaacgagttcatcaaagttcctccccatctgaaaaaaaatgcgttatcaatgattccaaaaaagatactacatagaaaaggaaatgccatgggatatgtcaaatacttcattgggtgaatggtgatgaaaactaatttcaaacccagcatcatttccccagcaatcactgctatgaggagatagaaacagaagaatgcaaaggcagcagtcccaagcagacctaatacagaaaacagaatattggtcaagctactgtcatcaataggacgagttcagaacaatgtaatgaacagaaatataccccaaacaccatccaattttacgaagatttcattcaggaaggaggacaaaggagggtcaatcaacaagtatatgacgatatgtgcaacccaagcaatcgatataattaacctgagatcataagtagctattagaagacaattgcagataggttggactagaatagaagcaaagtccgtacaactatttacacatacccgacagcaccaaataaaagttttccaatgtaaccaagaactgtcaaagcccaggtagcctcagcctgcaccatgatggatgttaagccagcaataaaccaaaagaaacaatgtaaataggatttcatgttcagttacctgttctccttgagggtacatctcttcaagagccttcatgtcatcttctaaaagtactaattcctgatgattaaaagggcaggcaaaacataataagagcattaatagagcattacagaaattattggcatgtggtacacaaatggacacgagtgttctgattagaaaggaaatggaacacaaatgcttcttactccacactaatctcaaaaaggtaagtttgttcactgagtgaggctaaaagtttgaatggcaatgctcaccttcccaagggccttgacatttttgcgccattttctgcccttcttcccacttttctcttcttggtgaagggcttcagctgctttcttcaattcccgagccttcttacctagttcagttgcttcctgcagaaaatatgttcagtctcaatccacattgaaaatttcaaagtgataattatatgtagtagaaaaatatggttctaatgaatgctcataattgaaaagaagtatgtgagaatataggcacctttatatattgtgagcgtgtaatgacagcttttgggcgccggacaaatgagaatataagtcccaatggaaggcaagcaattccaacaccaccaaatatctaccaaacaggaataggaaagttgtaaaaagaaaccagcatgattgcagcagaattggatgttggaaaggatccatatttcaaattgtttctagtacagcttacactcaataaaagacataaagctatcggtcacatgcagaccagtagagtgaatagatgtagctatacagaaacggtgataaagcaaaacatgaagattgaagtaaaactcactgtgaagagaacagatccaacgatggtagcaagagcaaccacatattcagggaaggtagcgcgcattgtccaagttgtttgagagttagcaggtgcagtgtaagctgcgcactgaataaaacaaaccgtaaagcagtttagtcgtagataaaatgccaaaagaaaggtgtcgatcaaatgttgctattggatggggagcacataacatcattactataggcataagaaagcataatttgattgattgactaacctgcttgggcgatgtactgatgcaaggttgaccagttgagaaactagtgaatgaatttggaaatgtctcaactgctgaagaaagatgcctgacagtgaagtccactttgccaacaagtcctgcagcagaacaatgaaagtgaggtcatgtaaagtgaaagcatcccaaacccttagaagccacggtgttcacaagaccactttttttttccttgaaaaaaaacccttttttttgcagagggcattcaagggacctagcaggagttcattttaatacatcgggtggaagaaagaaacaaggattatataagaaacagcgcaaaaacaaaactaccaattgtgaagctacagactactggtcgataagaaaacaatttgcgggtataatgtggaccggggagatatactacacaacaagtgcaaagctcaaacaggacaattcagatctggcagctgccttcctggtttgtacagcattgattgctcgaaaataagtactaattgaaaagctcaaagcttgagctagtcactccaagtgaagccagaagaattaacactagtaaccaaccaactcaagattcaggtagaacaggtcacatagcaaattcgaacagattcaaaaatcccactccaatattactactagtctagaaattttagcatgataggcaaaggagagcagtgatccgcaccgtataggatgccgaggatgaggccgcaaaccaccgcggagacggcgacccacaggagagcggaggtgagcctcttccccactgacctgcaggaagcaacaacacacggatccaatcaacaacattcagtgagagtttagcagcagatgcgcaatgggatagaggaaagagtggaaatgtatatgtatactacttacttgtcctggtcgccctcgtagtagaacatggcgaaggggatgacgaggaagacgaggacggcgtcggcgatgtagacggcgagccagagggtcttcatggggagggtgagggagcaggcgccgctgtagatggcgcggcggcaggcctggcggttggcgacgtcggcggggagcatgaggatggagaggagggcgacggtgatgccgaggacgacgacgagcttggggaagtaggcctggttggcgtcgtcggggtgctggtagttgatgagcaggtagacgctgacgagcaggacgaggacgctcaccaccgccgccacgatcaccagcgccacgttgaagtcccccatcgcggcacggtaccagatctccgctactgcgcccgcccgccggctagggtttgggcggcggcggcgctgcggccaccggcggcgtgcgggatctgggggatttgggggggaggaggagttggggttggggg

SEQ ID NO: 72286 - DNA, 652 bp, Oryza sativa
tcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactat

SEQ ID NO: 72287 - DNA, 9074 bp, Oryza sativa
  unsure (1)..(9074): unsure at all n locations
tcgctcccgtcgagttgacggtggctctcccttcccgccttgcatacgcgctccgtctgctccgcctcgggcccctgttcgcctctctccgagcagaacgcacaacgtccttgctccgtgcgcgtgaggggggcacccacaggacacccaccacctgttcgtggaaatgctcaacaccggatgcgtttctctggctgtatgtgcgggcggacttacaccatcatcgcatattcgcatgggcttcgccaagtgcggatgcagtgacaagcaatgcagagttgatgtctgttcgcggaagtgaaggaaggagaaaatcatggtgtggcgcgaagcggggtttgttcaagatgcaagaacagtagttggtgtttgctgttaccggcacgctaacaatagttgtgttctaagatgcgccggctttatttcctttagccccgccctcgacagcctactgtcaacatcaatttgtaatttgtaacttttctctctaaatcttgatgtactccctccgtttcacaatgtaaactattttagcattttccacattcatattaatcttaatgaatctaaacatatatatctatttagattcattaatatcaatatgaatatgggaaatgctagaatgacttacattgtgaaacggaggaagtaattggttggccatgtcttcggccaacccggctaaaaaatgttttcacccatgtcaacatatgacaccaactataaaaagatatcccttttattctctgtagtatcaaagaaaaagcagggtatttatctgtacattcttttattcttaatttttgtacacatatgataggacatatttcaacaggactctagaaaacaagaaatcaatggtactactactgtacacatacggtgttctgtgtattattttacaagctgcaatactatagtcatccaattgccttgaataaccatctggaacttgacacttgctctgtcatattcgtccttgatcaaattcaaacaggatattttcgaaatagtccaagattaactagatgatgttggagaccagggaccatgagatggcaactgcaaaatggaggtgccgcctggtatgtgtttactgcttaatataattttgaaccactgactctcaggattgcaattcggatctacggttaggcacttgcactgatttgtcgtgatatttccatcaggactggcctccaagcatactctggttccgttattggtgagttcagttgaaacatgcattcctgaatttgatagtagcttccactttgaactggatttgctgcaactggtgccaagctttgcattctcaccaacagacttcgcctggaggcattgtccagtttgtttgagtattaactcgtatcctttggtataattccaagcatttgatttatcacatggacccaactcaagtgcctctgaagatttcaccaagacacaaagcccagatagaggatggaatataacattgtaaggctgttgactgtttggaagcccgggacctggaggatggaatattcattaatatgtatagctcaaggaaatacagtgcatattgttgtgaccaaacttttagtggacttttacaagttacatagcccctttgcttactttcttgcacatcggcctgtgtatccatccaagtgatttcttttcaagggacacgttattctatgatgagggctaaaccaatgtgtgcatactagttaatgctccgatttcatatatgttccaataaatctgttccaacacaacccaaaaaggtgaaaaactgaaaagcggtccaattcaaccaatgaaatatgcacaggttttttctgttggttcagcaactgaggattcattataacttcaattttaccagagagctccatttttaatgtgattatcaaaacgtagaacaacagcacagttccagaaatcttgagagttgtattactaacaacgttgctatgtaagaataaaactgagataggttaagtacaaaccttggaatggtgattgcagagcattaatccttttaataaagctggggtttctagctgtacaccaatcccaggatagcaatccataagattcatcataagctagagtaccctccctgatataataactcccttgcagagcccaaatagcccagtccagatccatttcagctgccacggttaagaagcaggtaagatagcgattgtcagcgacatgtgtcccagacatgtcaaacccaaactcggagaaaaacagtggccagccttgctgaagtaggaacagtccttttttctttatggaatcaacaaccatcccacaagcatcgttttggttctgagatccccagtttccatcatctgagaaaccataccagtgctgctcaaagactaactttccagtaaatgttagctgaatttgatttgggaccaagaaatccagagtattgtcgaagttcaggcctgacaaaataacaagaacgccagggtttgccgcatgcacaacttcagcacccagttgcatgtacctaagtttggaatagattataaacgaaaattttccaatgatacgagtcacacataaaagccttttcaatacttctataagcaaaagtaagactcagtgtgtaagtaacaaacctgaaccacaaactaacatttttggagcctcggagctcgtttcttaaactcatgcccacaacattttttgtgttcctaaacattgttgccattgcactaaggcctttcaaccattcttctgggccaaagtacttgtcaccaaaaaagccattaccgtcgttttcgctgcagcaccatcctggagttgtcatttggttatcaagtataaccattatattgttcttggccaaagctgacaccacttcctatggttattaatttaacagaaggagtaaataatcagaattcaacacttgatagcaaaaatctcgtttactttatttcatttaatgtttagtacgggtaaactctcccagaatatactcctgagtatgtgaacacatgttttggtagattactaggtcaactaactagatacatcattgtaaaatgagagataactaatacatccctggtttggatttttttttttaaaaaaaggaagcagaccacctaatgaccccagttgccatctatcgtcagaacatattttacaaagaaagaatttatctagctagagactttcaaggcacccttatcttggaccatcaatttggtgactattaggaataatgtcatcttcacataaactggtttggaagagaaacaaaaggaaaaagggaaagctactcaaacaattaccattggtttttcctgaaatagaaaaggacgatcagattgttgattatgcttaaaccttcaacttgaaattgattgttcttattaaataagcaaaaaaaaaagaggataccctaggtttctttggcaagtcttgtgaaaagattgtgacgagatcatctgatttcaaaatcaataatctgcaaaattttgacttcttagcaagttgtttttgttaaattaaaccacatgacctgcagttggtttagctataagtcaattgattcattgcatactgttgcttccacaattaagccttatgcatcataatagctatttcttcagaaaaatgtaaaatttacatggactctgacttaaatgtttaaatgagcccatagctttcaacaacaaaaaatgtaaatgttcttctaggtacaacgttatctactccctccgtccacaaatataagcatttctagtgtttaaatttagtccacgaatattttctataaacatttctagagtatatttccacattccaagttttcaaccatccctcatagttatattccccatcccggtgaatcggatggtggcatggggattcaaccagggtacatgaaagtggtttcaccttaacctttacttaatttctcctacaactcttggacggagggagtattttcttgcactctatcagcgaaaatactgcttcctccgtttcatattataagactttctagcattgtccacattcatatatatgttaatgaatatagacatatacgtgtgcttagattcattaatatctatataaatgtgggtaatgctagaaagtcttataatctgaaacggaggtagtagcatctagcggtaagacacggtaaaatttggcgccatctcgaagactcgaactcgctaacaatagaaacagcttccatttcccatggtggttgttaaaaaaaaaacagccatttcttagaactgccattaataataagtttacttaacaacttggagaaaccaacgttgtcatttactccgtgtttgcttattcgaagagacgctcacctggaacacatcgatgaggggcaggtcgaggagtccggggttgttgacccggacgccggccacggactccggcataccaaggcgttccagcgacgctctcagcggcaggttcgccagcgtggcgttggtggcgaggtaggtcggccaggtgagcctgacgcagtttaaccccatcgccgccacgcgcgccgcgatgtccccaaggccgcggcgcgacaggccctccgccgccacgggctccaggtgcgacgcccagttcgcgcacgccagcttcacgcgccgcccgtccgcgcccaccacccaccgcgacgccgtcgagagcggcagcggcgggagcgacgcggtggcggtggcggcggcgagcgggagcagcagtagcagcaggagaagtggagaggaagaagccatggtaacaagtgtggccaacggtggcggatctgaggggggtttaaaaggaagagatgtgcctatgacagatggggccggggaaatggtgggtcccagctgcagtgtcacgtgcggtcttccgctctgataattagcgaaacgtgacagccgcggctcgtgcggttaagcggttggggcccaaagcccaactgcccaagcggactccaatggcgggcgccgccgacttcccagcggcggcggctctccccgcccccccaccgcgctggcgacggcgccggagttgtgcattcctcgcggcgtggttctctgcaacgtgcgagcgtcacgctggggtgccctcctcaagtcgggcgcgctcgccacctcgcccgaatccgtcgatgctctcctcgagctgacgccaccgcactcccggcccatggcaccttcaccgcccacgcgctccgcctgttcctcctctgcccctgctcgcctctctccgcacggttgtacagcatccctccctcgtcggcgctggtcactcggagccggaggacgccctccacctgttcgtggaaatgctcgacgccactggccccattctgcaccagcacagcacactgtcgcttgcacctctcgagcccacctcgaggatgtgcgctctggatttaggcgcggcgtccaggcttacaccaccatcaagcatgggctcatgtttgatcgtttgctggctgtggggatgtcacggcatcacttggtgcagttcgacgccatggaggacaacggtgcggtcacgtgaaatacaatggttgcggggacacttcaagaatgcaatggcggacgtatggtgatcttgagttttcttgacaaggcgccgaggttgttcgatggaatacaggtatgcagtggtgtgatgtggttgcatttgctctgtttggattgcaatgatctctggatacacagttacgcacatacgggcctatgtctggaggcacttactcttttcattgagatgcagactaccgtgctgttgctgaacccaaatgaggctactgtaagtcagtagtacataaggaggaagggtcttcctcttaccattgttcttggacttggcagtgcactggtggacttatatgcgaagtgtggatgcagtgacaatgcagataagcattcaaagttggtggctgcctgtgaggaactcagaggaacaccggggctcttctcatccatgtgtgaggccaatgttaaagcccacggacgtggcattcactggtgttctcctgtcttgcagttcacagctgcttagatgagtaggatcgcaggcattttgttagcaatgacccgggattatggcgccagccaaggatcgagcactatggctgtatggttgatctgttagtgcgggctggactgatcgatgaggcatatcagtttatcaaaaccatgcggtagagccaaatgcagtaatttggagtgcactagtttctgcctgcacagtgcacacaaatgttgatagtaacatgcaagatgcactgaggcatccactggacccaattagtcaatcacactggactgatccaggatgcattcccattgagttggagggtgcattctctttgagttcttcgctgaagacagtgaccatcccacccccacccccagctgatgacggagatatatgcgaaagctgaggagatgattgtaagtatcattatggccaggtacagatgatgtaaggctcgactttgatcaaaatgagaaggaagcctccgttacacatcacagcaagaagttgaccattgccttcagcctgatgaaactgcgtctcggtgcaacaattcagttatccaagaatctgagagtgtgcttggactgccactctaccacaaaggtgtacaacagggagattgttgtgcgtggcaagaatagatttcaatcacttcaaagatggttcttgctcctgcaatgagccaatgattactgatgagttgctatactaattctctctgctgagctttcttttatataggagtatataagaggcgcacctgatgtcctgatttattcattggagcagagagtaaatagtactccaaaatatcgaatatcgtttactgttggagtagtacatgtaacaacaattatcgtttactgttggaaggaaaacctgctaacctgctagtataaggggagaaaaagacttggaaggtactgtaacatcaagccatcaattggtgtgaatcgtgtgcagaccacatgctactgtgttacgcatgaattcaaatgagaaatcaacctctcaaattcgtgcttagcttttacggaaggaatacagtttgcattttgaatcttgaatactccagtcatcccattacctttcttaccaattacaacctccgattcttaatatatgattgagttgactttttaaatttgtttactatccatgttttttctaggaatatttgtgcaaatagattaaacatactagacatgtgtaaagtgttttgatgacgaatgtactggtatttttttcgctctaattaaataactaattgaataaatattgttggttttagttcaaggaaaaaaaaaactatcggtgtcatttattaaaaaacagacgtagagtactttacagcaacccttttttctgttttagtttatggagtataaatgaagtaacactatcaaaagtcaaagctgtcagcatttcgttttcttttcatttttgtattatcttttccatgtcatcgaaagattaaacctgctacgtttacatcgacaaagaaatgaagatttcatgttgctctgatcctaaacaaaagtagttagcacttggcagtcactagcgagtaggtgggtctgtgcctagacccacctgtcagtaactcaatgtcaccgagaatgtcacgtgggaatgtcaccgaatcccaatctagaagggtggttgaggggtactaaaaaagaaagaaatttgaatgtgtgtgattgatgggataaatagtacttgaatggtagaaagacaactaatttggaacggagggagtacatcattcgtgcattaactaattaaaacgataatgcttataaactcttatcggttgagccacagctaaagaggcagcggaaatatgaacaaaataatcaaagaaaatttatgaagaaaacttctattattggctgtttacaacttccctctcttaatacgaaacgtacgcaagtattttgggtattaaaaaaatatattggctgtttaaaagccaagttgaaaaattggttatgattaagaaaaaaaccccaaatgtaaattaaaactatatttcaaaaattaatatttaactgcagcaaataagcaaacaaagagacaatggccgtgtttagttcgtgtgacaaaatttttttaagtatacagacacacatttaaagtattaaatatagattaataacaaaacaaattacagattccgcctataaactacgagacaaatttattaagcctaattaatccgtcattagcaaatgtttactgtagcatcacattgtcaaatcatagcgtaattagtctcaaaagattcgtctcgcaatttacatgtaaactgtgcaattggttttttcctctacatttaatactctatacatgtatttaaatatttgatgtgacaaaaatttaggaggtttgaagggaactaaacaccgccaataattctgaatttatgatagaacagtacaagtcaaataagatatctcctcctgacatgacatatgtatagatagatgaacttagccgccctagagacaagctagagaacagcaaagacagcaatgtccatggcgtctctccaagctcctgagttccttgcgtcctgcctcctcctcgccaccattctcttcttcaagcagcttctcgcgccgtcgtccaagcagcgcgccgcctcgccgtcgctaccacgcccgagaggcctccctctcatcggcaacctccaccaggtcggcgcgctcccgcaccgctccctcgccgcgctcgccgccaggcatgcggcgccgctcatgctgctccgcctcggctccgtgccgacgctcgtcgtctccaccgccgacgcggcgcgggcgctgttccgggacaacgaccgcgcgctgtcggggcgcccggcgctgtacgcggccaccaggctctcctacggccagaagagcatcttcttcgcgcccgacggcgcgtactggcgcgccgcgcgccgcgcgtgcatgtcngaagctccttcggccgccgcgggtgcgcgggctccgcgacgccccggagcgcgaggcggccgcgctcgtcgcggc

SEQ ID NO: 72288 - DNA, 8191 bp, Oryza sativa
gtgaaacggagggagtagctagttgggacttgggagaacttcaaaacatatgctaaccattatcgtttcaaaagaaaatcctttatttttgaaaattacatggagggaacgggtacacagatacaactaaattgtatatagtggtcactactcattagattaaattgcaccagtaaatcgagcactgaaagaaatataagtgtgaatgcatttatattaattctactgatagatctgctcatcttgttgaaaataaattagtgtttttgttcatgcagcgtgcaccaaactgaccattttcctttttacttttgaaaatgcaaaaacaataaacatgttgcaggttctgctgccatggacaacggccattcagtaggtgggagtgataactgtcaagaaggaaagggtcagcttacggcgaaaaagatgcttttcaaggctgccgcaagccatgtactcgtaaacaagcagtctatgagagccttcacagcaatacccaatcagttcgactagatttggatggctaagttgcccaaggtagttgacttctgcctggaaacaaataataaaactataagtatctgatatatgctgtttaatcaaacactaatcagtataaaagtactctttcaatgtccttgcttaaaatcataaaatgtaaataagtcaggtaatatagaaactacaataacaaacaactattatgatcattaaattgaatcgtaaaatctaattagctgatgaaggctgatagacttgtgtatagttcatcatggtttcaaaaaaaatgaaataaagcaaggatacttaccaaccattccttgtcaccctgaaatccctctgggtttaattctttcacagcaacttgtgtggatggaaagcccgctctaacattttcatcaattacacctttgtaaacaacaccaaacccaccctctccaagaatttggtcaggccggaagttttttgtggctgctcttagttcattatatgtgaaaatattaacatttccgtatccttcgatttgcaggtcctccacatcttttggaggggcaaggacacttgctgtagctttagaatcagatttgcatttccttaacccatctggcccaccagcttctgcttatagaattaatagaaaagaaaaaacatcagggaataatcaattacatacgaacattaagagctacaatgtggcgtgattattttgccttagtactttagttttttaattcatataacaccccccatacagctcctgctgtgcagtctctgtaatgttgttgtgcattatgtcaaaatgataatctgataagcataacatcttagtttgtaaataccactaacctacccaaaatggtgttcatcttctaacttaagaaacatgtgttccattgtgtcaagctacaatgtcattttgcaatagctctacagcaacaaaagtattcattgatcatcctccacgttcaagtggcaggttaatgtgcagctaaaggccatgacatgacaaaggaaggtcccaatttaatttggtatctcaataaaattctagaatagctccaaacacgcatttgctgctcatggtcctatatgcaggacaacatttgtcatctcttccagtctctgaacaagaatcttctatgcagaacagaccatttgcatctaagttatagggttactcgatacttccatccaaccaacttaaaatcttctagcagctttgccaatgtagttcaaaccaagttatgagctaaatttgacttgctgcagtttgacttttcaggaaccgtgactgcaaatttcatagacaacataccagtacatcataatatcgtgtcctctaccagccatcaaagagcaaagtttgtaccatgcaagtttcgtctttgtcaaagaaaaaagagaaactaagctacagatagaggcctgaatgtaacgatgtccaataagataaaacttttagcacttagagaatggcattcctcacactcgacactcagtcacagaagaatcaaacatcaaccacgcgatgcctaaaaaacccgaatttgcaacacgagttactacatgatatagccccagagacaaaattgatcctgtcggaactctgacataaacgagacagcaattctcgctcaaaaaccaaatcttctgaagctgaatatacgctgaaaatccatagcccccaatacgcccaaaaacccaaccgcacgactaaattcacaaccaaattacaacaaaaacttcacttccatgcaacatgcacacagctactactactactacaagcaaaaacacacatcagagactaagtaagatatatatagctcgaggcaagaaagaacacggacgaacctgtcttgccctggagccggtgctcctccagcgagaagcatccgcccatgggagcccccaacaccgcgcctcccactccaatccgccgctccccctactcccgcctccccatcgccagcctcctgccagatccactcccaagaacacacaccaccaccagtccaccaccaccaacccaagccccgcgcaccaacccggaaatttcgcccgcaccgactccgccgcttggttgggcggaattgctccgccgccgccgccctccgaccgccggtggatggatggattcgcgcgcaaccgtcgccgaaatttctggtgcgttcttggatgcggcttttcttttttcctttgttttactttgggcgttggagaagacgaagaaagaaaaaaaaaacaagaaaaagaggaggatttggattagctgtgccagagggaagcgagagtaaaaggaagctgctttggattaataaatgcagcaggggaagcaactggggagctgagctgaggcttggttttttttttcctttctttttcttttctctcttgttgctttatggttggattggagaggcttggagtttatgggggtttgattaatgtgctgcatggttgaaaagaggatttggccgtgacagtggtttagtttgggttttagttaggatggtttttttttctttttttgactgatggcatcatggttaattggttattaagtgatatatggccatatgagtttatttggtaaaaatatagcatcatatttttcacttaattttactcatttttttctttatgtgattgattcaaatatgcgcatgtttatgtttttgacagattgtttcaaatgcttaaatttaattagccaaggaaatatcatatacgtgacacgtctggctaaaattagggtttgtttagatcccatgacaaaatttttcattatgtcatattgaatgtttggacacatatatagagtattaaatattaaaaaaatacatagattacgtgtaaattgcgagacgaatcttttaagcctaattgcttaatgatttgacaatgtagtgctacagtaaatatttgctgatgacagattaattagacttaataaattcgtctcacagtttacagacggaatcttaatttgttttcttattaatctatatttaatacttcaaatgtgtgtatgtatattcgatgtgacacgtcaaaactttacacccatagatttaaacacctcatttgacacgattaaaagacacaagaacaaaacaaagctaggtctttgtaataaatttatcaatgagtttccgagggacagaaatccctgtgctgtgcctgtgatgcccttttgagttttttgacaatggcacctgaaatggaagactagcaacaccaccagaccagaccgtcggttgcattttgcattgcgaattcgcaacacggccggagagaggtttgtctcctttagctgttgaacctactgcccaaagactccaagaaacggcagaaaaataccccaacacggcaacagcaaacagcaactccacacgaactctacaactacaagttcgcaaaacaaggggctgtttccttgtcccggttcagcgcatgtccccgattccaggtgctcctcggatttgtttttcttttcatcatcaaaccaatcgatcgatcgccaccaatccatccatccatccaccgtgcgtatcaatcattttcttggccaccatatgtttggtgttctgggagacgcaatttggcgtggaaaaacaatgtgattggcatggactcggtacgcctaaatccgaaccaaatccaagacaccacatgggggcgcgaggcgtacgtccacatgggagcagagccatctgtattgtagtactactagtactccccgaaccattttaaatgcagtgaccgtatatcttattttaaaaaattattaaaaaaataaagataataagttatgcataaaatattattcatgttttatcatcaaatagcaacaaaaatattaattataaaaaaaataaataagatggatggttaaacgttagacacggaaatttgtagatgcacttcaaatggaacggagggagtagcattgcatttgctatgctttgggaacgagttgttttgtggttgcccaaagttgcgagatccaggtttggaaggttccatggaatgatttaagaaatggcattagcgaggagaggggatgcttttgagtgggcggcagcatggcatgaatcaatcaaccaccgtgtcaaagtgctcgccaccacccccgtttctccactcggttttgtttgtgcttagcggaatccatttctgtacgccttccaatcacatcctctgcccactaactccagcaggagtacacaacttgttattacaagtgtgacagcttcatcatcatcattgcaataactcgaaatcttagaaaatactggtaattgcggtggtagagtagatagatacgaaaccaatctggagttgtactttggtgaggacgcgggaacggaggattttcggggcggaaaacgcccaaaaaagaggtcgccatccactccaccaccacgcgcgcgcgcacgcggtttgtctctcgcccttcttctcccggtcccccgcgtgccgacccctcctcctcgcctcgtctcgccacgcgcgctcgttctgcctcgcacgacgacgtacgccacctgccaaagcgccaacccagcgccgaaccggcgccgccgattttacatcggagaccttgatcgagcatttcacgtctgccttgtaaaaaaaaaacgtactactacatttaaatttaaagatttattagttgttttacttttaaactttggaactaacagtttatttatcgaggaactcttatacaattgctataaataaatgcaaactggatagttctgattgtttcgctgacgaagggcatgtagacctctcaaaaagcacctatgtagttctatctcttctctattttttaaaaacttacaaccaacaaattaatcaccttctcatgttctgtttatggaggatgtgaaccaacgcatgaacaaattaggatcaaagatgctagtggaagacaaaggggtggtaaagctaacaatcaggagtaatcgtatggcacagaggggcacactgtggcacacatagtatatgtggtagaggggccatcaacgactcgatgttaacgccaccgtggcagtgatggaggggctcacgtgatggcctgttgcggctatgtgacatgggacataggttagcgtctatagtgaaatggggttggtgctaattaatatggtagagcacacctagctgaatatcgagcggtgcgtcagtcgatgtaatacatttgacagagatacaagatgacgactcgatgaggcataggtggggaggagcacgtggacataatgagaataatcctacaatgatacaggttttagtgtagatgctacttaacaattcttattcacgggaaccgaaagattcaattcgtactttgtagggctggtgttgctgctgtctgcgtaggctactagtcttttatgtaccagtatctcaccgacgaaaaatgagagataacatactttttttctaacttttttttttctaaaacaagactatagtttaaattcaattgatttttaattagcaagtgcatatattgttatgtccatgcagcgtgagagctacacatgaaagaaggtccacgggaagaactagaattcggcattataaagggggtagcgcacgagacctaaaagtggatggatgcggagacaagaatttaaaaaggttcaggccctctcaatgagaggtaataccctactcctatttagggatttgaattcgtcgggttgtagtattgatctgacgatcggattgtgaatctctgcccatgccccttggagggggctccttgcccgccttatataggttggggggcagggttacaaaggaaaaacctagccggacacgttatcagtatcctaatctattactccctccatcccaaaatataagcatttttggaccctgacacggtcttcgagatgctactttgactaacaatatctatagaagtaagatgttttaaataaaaagagttgtatattatgatagtttgtttaatgataaatctaataacatcaactttacatgattgatcgtttttattgttttgttattaatggtcaaagttaaaaatgtttgacttgtcactatgctaaaaatgcttatattttgggatagagggagtacatggtagtacccgattggggctttataccctgccttggaatacaaggcaacatagcgaccgagtcctactttattacatattctatatacatgatctatcccctgtaaccagtcggatagcccagccgtgtgggtatgcggtactcataatctccgcagaaagcgtcggtgaaggatggtggattgattttgatcgggtggtgggggtcaggggtgtgcttccattcgcgcagggaaggggacatcatgcgtgcgagaatcgctcgagagggcatgggagtcaggttgagcttaagatggacgagggactgtaaaccaccgctatacttctaggccttaaggatttattatttcttacatttatagtttggaactaatggtatattttctagatcctttgtaacacactgacagtgtaagcttcttttttctatttaaagtttggaactaattgcgtatttattttatatcctttgcaataggttggtattctcgtagtattatataaactttgttgatgactatagcttggggccttggccaactatatgaaatgaagcttaacttagcacctctcaaagctggcttcgcttccattctatccattaccacttattcatgttggagatatgtaacaccctgaaaattcgaccaacgaaatcaaaacaccaaaaatacagattttcaaaaactttttaagtaataaattgcatcatgccgattttattcgcctatttcattggattttgatctcggaatttattaatcgcggataatgaataactaactaggaataaaccctaaaaatcaagttggctaaataaataattaaaatataaattaaaataaatattaggtgggattggaaatatataaaatattatcgcgaccatattagcaataattaaattttagtacgatggaatgagaattaaccctaattaaaaattcaaataaattatataaaataaatatgagtgatattaaattagggtgaatttttagttagtataacacaaatatggagtaaacttcatttatgcaaaagttagaatttataggactatatttaaatagaaaatgggctaaaatcgggataaataggaaaagttactgttcattgcggcataggtgttcgatcgtggtccccctggccccgcccccttccctgccgcgtgtgccgcgtcgcccgcccgtcgcgcgcgccgccgccgctgccgcgccgtcaccgtcgcgtcgccgtcggcctcgcgccttgtgccgccgcgcgcccgtcccctcgcgcctgcgccccgccgcgcggccgtcccctcgccgtcaccctgcgtcgctgccgcgccgcccattccatcgcgctgagccccgtgccgccgcgcgcgtcgcgtcgccctgcctgtcacgccgctcgctcgccacccgccgagtcgcagtcccatcgccgcgcgccgtcaccatcgccgcatcgagccccacgccacccgtcgcgtcgcccgtctcgagccccgcaccgtcgccggtcgcatcgccgctccgagccccgcgccgccatcgcgtcgccgcccgcgcg

SEQ ID NO: 72289 - DNA, 3467 bp, Oryza sativa
attcctgcagcccagaaacgcgctgtactgcgttgcatgcagcgtgacacgcttgaccagactgcaataaatgctgttaggtgagcacagctgtgatcacttatcccatgtatgtggcgcagacttccttaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatggaaaagttgaaagtttgaagaaaaagttggaaactaaaccagcccattgaagtgaaagtctgggttcttatacaacttcaaattatttttttcttaggtcttaacctacagtgtatttagtagtactcgtaaaactaagaggcttgaatcagtgtttgttcagttttcttttttactttaattacgtgtggttgcagttagaagctaacaatgaaggtttcgtgactgcagctgcgccgcagcaacattaccctaccaaatagtctcagtaaaaatttaaggaatttaagttgcattggagttatacaattcttagcttctattttcatattttgtgtaataaaattttattctatgtgataatttataggccgtcaatgtagtgatttttttttttaactatccttattataatataataaatagatgtaaagtgagctacctcaactggttatattcgttagattctttttttagtggaattaactcactaggggatgctcgcatttacatttacttattgtttcagtggtagatgatatatcctcgatagtgatgtgtcattcaagcatactcttgtatctcacattcctaataatttccagatgggcagtgaaaacaaaaccatactccaaaaacaaactgtcaacaaacggacactgattcatcttatatttttccatcttcttgttgatttcctgtagaactgtaccaagtttgcaaggacatcatcatctatacagaaaagtcaaaaacactcgagcaacaacaacactgacacatcgattatgatgtggatcttcctcttcccagagaatggtttcaagtttacaacacgaacttttcgtcgcggcaggcatctcacattacaaatgctttccacaacgctcctctctacatacaattgctagtcggaacagcaagaaacctaacgaggtagagttcttccgccatcagaaaaaattttaacaccaactttgactctgatcgatcttgacaacaagatggatggatggcaatgcgaaatcgccggtagcgaaaacttgaatcgtcataaaaaacttctgtgtgacttttatatcttgtacaaatcctcgtccggtggatcctttatgcttccatctctggaaggggatgacaatgcctccaggcctggctgctggccatcagagtctggagatgggatgtacagcttgcattccaaagacggctcgctcttgctccggccattccctggccgtgttctcctgctctgaggcacgggttttccatttaccggtgccggtgccacggtgaccgtttttgctgctggttgttcttgttttatcttctccggctcgacgctctccgtagggtcctttgcaacctcgtagagtgtcactgcacccgtcatgcagttctgcaagagtatgtcttggcattcaggcatgttttgcacagcctcaaaggtctcaacaacctggctcatggtgggtcgtcctttgggattctggctcaagcatcggtacgcaaggcctgccacctcaatggcagccttggtggagtactgcccttccattcttggatcgataatcctgaacagcttccgattgtgcacgaggaggggacgtgcccactcaactaggttgtgctcacggctaggccggctcttgtccacagccctcctgcctatgatcatctcgagaaggacgacaccaaagccatagacatcacttcgtgctgtcagatggcctgtaacagatcaaactggttagagtaacaatttaacatacatgatgtcagctacaatgatatgcatattcatacttaagaacattaaatgcactcaagaatgaacgggttggcattctaaaaatacagggagattccattgctcacctgtcatgacatattcaggagctgcatagccataagtacccatgacccgagttgatacatgggtttggtctccactaggtccagttcgtgctaggccaaagtctgacagcttggcattataatcctgcagaggtgacacagagtgagactgcggcagtatcataagataatcgtcaacatataacatcccaagatctgaaataagatatttagatcagtattccttgtgcagagttgcatggtttaattggatggatgagggcacacataatatctactatttaaagtggaaccatggaggaggaccagggacaaataaatgattgatcaagtgtttcatttgtaatcgtccttacatactttttgctgtgtcacactaataaattgagaatattaaaaagatttcagtcgaaatatcagtggtaaacaggactgtgttgaagagcaagcgggaccagatccaaactggtacgttattgagatcgctgatgtttagaatcttactgctgaaagaattgaatcattcattcatcagaagatttagtagctttgaccatgctggcagcaactgaaaccaccatgacggtttggagggcaagcacactattctatcactacttcagaatcttggattctgtaaagacagttatgggccttatggctagcatgtaggctaagttatccggttaactgttagttctgtcattccaagagttcagaacaatgtaggaaatggaatcttgtctgggttggaaagaacaaagttgctagagcctgatgagatggaattcctataacaagtgattgaaaaagggtaatgatatcaaagtattcagatagtagatgaagtacaaaccgcatctaacaagatgtttgatgttttgaaatctcgatatataattgatctctcagctccgtgaagatattccagcccccttgcagcacctagagcaatcttcattcgagtagaccatggcatattaaggcaaacccctgttatcaattatcatacgagcaagaagataaatcaacaaaagtgtcctttagcatggaaaaatacatgttctctcaatagatcaatcaaaggtgagcaagccatgcagcaagaaaatcgtttcttcttttttcactagtagcgtagttagcatgtgcatgcagattgtagaatcaactaaacagttcaactcagacaaaatcaactggccaacttgatgatacggccggtaaattaaatacttcctccgtttcacaatgtaagtcattct

SEQ ID NO: 72290 - DNA, 71693 bp, Oryza sativa
  unsure (1)..(71693): unsure at all n locations
caaaatccacacgctttacctttggagtttggagaagagatgaacgaaaattccaaacatggacacttccaagaactgagcagatgatattacagctttttttcttgaagggaattttttttctgtttgaagggagatattacaagttttcatgtccaaaagcctttcctttgtaagcaaattgactgacctacttcaatagatgaatccatgtatttgctgacctaatatttcgagatacggagctatcctgcaacagataattagaccagcattattatgctgatcattatcgttggaagactgcaggtcgttgccaatggctgaaaaaaaatgatttattttttttctgatgatgcaaccgtggagacgctaagctgaggtcaggtcttcggtcgcatatggtagccctttgatcaaatcttaatgtttagatgtcatcatcaaagaagaccttgacttagtaataaaaagggaataatggtaattgcaaaataaacagatactaaattaaaatcaaagtaatggttcacacttcacaaggtgatccagtcttttattgcttctcttcctagttgggatgcagtgcagtcataaacaagaaaatgactacacgacctggtttcaggaaaataaaaagaaaaagaaaaagaaaagaaaaggactagatgtgatgcgctggaagtatagagataaacatgggtaaaaatattacagcttgtaagtaagaaaaggcactctgcacaagtaggtagcgtttgaaatagatttacttgttggattattgttgctgattatctacttcattattggaataaattaaatattttgataagtaaatttaacaaaatagtttagaacaagtagtctaagcaatgtttgacacttagcaatacaatagaagattttttttttaggaaaatgtatttctaaaagcatggagcaaagaatgcacatggtgaataagtttgtaacacctgtgatacagttagagaccaggatttacatttaacatatcatttttcagaaatcaagagacaagatgccctctccatgacaagaagttatccggagtgattcatgtagaagaaataaaatttaccatagcattacattaattgcatatgttttacaaaacaaacaatattacagtatatgtaacagttggacccctacctagcctagtccctttcagtcaagacaactactggacagtaaaacacttgcacacagagagagagagagagagagagaacgacttgccgatatataaatactcattgagccacccaccctcttaacaaagaattcgtccagccttgggaagccgagaagaggagagaaacaagagacagaccgccgagatagagtaactgagtaagcatctcgatcttggcatgttctttcttcttcccctttccatcaatgatttctcctcttgttttcctcatcacnaactcntgcagagacctgttcttcaacccaattctgctcttgttatattgcctggattcctttttttttttggttcttggaagcttctattgccgctgcttgttcttgagtgccctctgcaatttatagataattttcttcagtttttttatccaaaaagagttcttggattagttgtaaagaagaggttaaatcaaggaaggttgcatcttgttcttgactgattaattggtgtgccatgatctgcaggtaaacgggttcttgcctgacatttgtcttgtccgggtggccattcatggccaccgtggggcagcctgatgccatgagaaggatcaccgttcactacgtgaatccgccgccgatcgccggcgccggagaagcacacgtcgatggcctcgacgacgaggttcttgattatgtgattggtgatgttcttcaggatcaggtatgcatttgatccaacctttccatcattattagcatactgctcttacaggcttgcagaatgatgagctttagcatcaaacatatgtttctaagcctttgatatggcctctttactttagttcaacattgtttagtaaactttccactgtttctctgaaacttttttgagaataaacttatttgtttttctgaacttttttctaggagggtctgtatcaatcgatattgtatggcaaatacggggatgacatgagaggggcaagaaacactgctcttgcccaatctgatggtttacattactactatcacggagagaacagcagtggtgaagcaacaacctcgagaaattcagaaatcgaccaacagattgagtatgacttggtgttcgctaggcagctgcaggcaatggataatctgacaattgagacacctgcagatgaagatgatggtatgcattcattctcgttcagtttttgtaagcacttgatgtgcataatgattttcagtcgtggcaatcttaatcttttcacctctgaaattttgttgcccatgttggtttgattcagatataagctgcgtaccctctccatctgactctgaaaccgatgaaccggcagaaggcaacaacgaagaggtgattatatgagctgtttcagaattgcaattattcagcattgttcgtttcagacttcttgatgcaaagatacacaattgcgtattcactaaaaagatgagctgtttcagaataaagcctttccaaatggataatgtataaacatgtactacgaaaagttgagattcctatcatttgtttgcaggctgccacacaggatgataacgatgatccagacaacatgacatacgaggttagtgttatattcacttgtatcacatttcttctgtaaaagaggtttacaccatctatgaaaaagttgctgattcttattctttctgtaatccagcaaaggcaggcacttgtggaatctgtaggaaatgagaacagaggtttatctgatctgcttatctcctacttggagacatggaagtacaaatcaggctttttcccaaggaaggcaaaccatgataagtatgtctaccatttcagttttcaatcaatcacatactgatttcttgcagaagataatccaagcatgtaactgatgacactctgattaaaatcttcatcatggcatgcaactgatgatttcctcctcttttttctcccaaaattgcagctgtcctatatgtctatccgctttcagacgccgagaaacactcattacattggcttgcaagcatagttaccatgaaggttgtattgctagatggctcaagattgacaaggtaaacaccttcttgggacactagatttgctatctgaattgtgtacctatcttagattataccatttgtcaaagtttacatgagcactgatatgcactgtccatttcatataacaagatggtctttgtctttcagtttccttgagcttcttccaaattaaaagaacttcatgggcttgtgcagtggaattcctgacatttttgtttatgaaacaggcctgcccagtttgcaaatatgaagtgtttggaccttcctagcgtgtgaggaggcgatcaacaaggctgaccaactatgactcgatgagacggcatatagtggttgcagcatctgctctgcagtattaattaaaaagggaaaccttaactcccaaaaaaaacagagaagggaagaaaaagaaagcaaaaaggaaaaaggaaaaagaaaaagaaaagacaaggagaaaagaaatttgaaaacagagatgcttcgtcaagattgtgcatttttttcatgtttttttttggctgtgtacaagcgtaattttgacctgatcgactcaaggcagtcgctcgaggcctttaatttcgtaaagcttcatatgcatgagtgtgcaattgtgtgcctatagtagtatagtacatgttttctgtttgaaacggagtcaaagatctctctcctgccgaccacccatctaaaagaaggccatgtgtacatcaatacatgtactgatatatactccctctgtccaaaataaatcaacttttgtacatgtcaaaatcttcttgttcaacttgtacaaaccagaacatattactccaaaatcacaaaaaagaacatattactctaggagtactcgtcctaaataatttgtgctttgcttggcttggtaccagcaaggcagcaacaagtatgctatgccacttcacttactacctgacaggcagtccagctatgatatctctcgtttatagtgggcccatctggtagtggcaggctggcagctgccttacgtgtgacgccagcgaggcagcgggcatgggtggcgtgcccgagaagagacacgtggagtcgaacgagacaaagcaaaaacatgggctcacatccccaacgtccagaagaagccgccgctgcctcctctcatttcggaactctaaagcctcctcttatttcccacttctctcttgccgtcgacccagcgaaccctagccaacgagatcggtagctagaggcagccgctatagccatggatgtggtaaatgcagcaaccttggatgtgttaaccaaggtttcccatccgatcagttactgcacggttatcgtggtctgtgcttaccgcaagggagcggtaataggaactgcccagtatatcgacttagttaaaaagaataaaaaaatatatatttttggttaaatttgtctggctttcttctgttttgcaccgtaaccgctgttacagcggtgaaggatacccctcccctgacggtaagggaaaccctggtgttcactaggcactaggtggtaagggaaactctggtgttcaataggcaccaggctaagcagaccaatgcgtaggcaccacagatcagctagacagacaaggtggtggaataaagcctaataccagaagacgtctttcagaacaatgttaagttattaggtttgcatagttacataaacagtaacaaacttttttctgaagaagaatcaatgctatcacaattttaatatactgcctaagtaatcacctcacccagatcaacatgctattaccaaaaattacctacttcatggttagtgtggcatatgcaattgcatgaacgctggcttgctctaacgcatcccattaatataagttaaaattggataataaagaaactatatttttcatgtactccaagttcgaaacaaaccaggccaacatcacaagcaaaggctttatggaaacactagttattgaaagtttcgtttggtggaacaaaaggaatagacgaaattgaacggatgaacattgcagttaggaataggatgtgatcagaaaaacaatttttgcgctcacagataatccaacatgaagtcaattatgctcagagaacaaacgaatcatgagattcagtcacaaactttgcatgcccttggcagttggccccctaaagagaaaatttggaaagacaggagatatcaaaatacctgagaaattataatacattccaatagcagcatgtgctcttcttccccctttctgtttggaaaggaaaattttcaatcagctggtgatttggatttcaaacatatcacatctcgttatcactgaatcaggaaagatcggagtgattaccaaagcaagcaaatcccataaattgataaatacgacaacccccttgctgtcccctccacatcggaatctctcacccaactcaagagcaaccgcagccatggccgacaacaacttcggagagctttcggtggacggtgagcccggccaaccgggagggcgcggtcgcggtggccgcggcggccgtggtggccgaggaggcgctagcggcggcggccggggcgggggcggtggtggtggcggtggcggtggcggcggagccggcgggaaaggagggaaaggcggagccggtgggcacggcggcgccggtggcggtggtggtggtggcggcgggaaaggcaggaaaggcggggccggtgggcacggcggcgccggtggcggtggtggtggtggcggcgggaaaggcaggaaaggcgggcgcggcggggacggtggcagcggcggggccggtgggcgcggaggcgacggtggcagcggcgggcaaggtgggcgcggcggggacggcggcggcgttaggagctgcacaaacagcagagggacccagatgctaatgcgaattagagagcgggttgttaatgcgaatattaatttatatagtgagaagttaaattttttgtataactaaatttaacaaacagtttgaaataagtcgtataagcaatacagtagaaaattttcttctagaaaatgttttttaaaatgtgtagcaaataatccgtttgaataatttgatggataatctgatgtattaagctaacagcctaacaatatattgtttggatcattaatccgtgccctactatcactatctcgaatcttaagtgagagaaagaaagagacgaaaaaaattggaggcaatccaatagctagtctattttagattgatcaacatattgcgtcgggcgtccacaaactgtgattgtgtatgcatcccgattttattagtggactaaaatcacgcattgaatcctacatgtggaaaaagcggtctcccagcgttatattttgatcaatccagcgttatattttgattaatttcaaatgtttgggttttacttacgccgattaataatctacaatggaggaagtacatgttagctctaatactattaaaattggtagtgcttcaatttctaaatttaaatttaataagctctgttttttctaagctaaaaccatttgattccaactctacaacatgtggaataaaacccttccaacctgacctgaattaaacatagtcgaaaatcaaaaactctgtatacagcagattacaggcgggttttttctttcaggaactatttcaaatcccagaaaactcgtgcaaaatccttccattccaggattttggagtaaatcctactataaaaatttcttcgctgaatcgacaatcatatggcattataaagatacaaaaattaaaataatagtactaccactaaagtaaataatagtaatcgccagacgttgtcattcagcagtatgatgggcctcgatgtgtgctagcagaagcagctctggttcgatctcagcattccaagccaactcacttaccagcgcacataacgcttaaattacatcagtgtatcatcatcatcagaaactgtttcagacaccccaaacaaaaactccacatacccaaaacaaaaaagaacaagacgagaagctagaatctacggcagtttccatcatcaccaagaagccaagcaggcaagcatttgtcacatgttccatgagtagccaccacctgcctggtcacccaggaacagcccactctcctccagttcagtactgatcagattcccaagattgtcaagatcatccaactcatgcagagcatcagccttgggggtagccgcatggccgccgctgccaatgccgccgcccgcagcagctgcaacttgggggttgctgctcactgacttgaagctgttacttctgctggggaggatgctggctgtattgttgatcacactgctaggacctgttgtaaccattggagtcccacccttcaccgcgccgttgttattcatatgatccccgctagcggcgctgccggtgatagccgttcctcctgatgcaagaccactgttagcaggagcatgttgaagttgttgttgctgctgctgctgcgccaagacacggttgttagtgttcttggcctcttgcagcaactgatggagcacatgctgctgatattgtgggctcacacccaagccctggaggctgctctgctgaggcataggctgctgaaatgaggccggatgttggaactgcgcgagatgcacctggtttggtccacggaaggatctagatgcttccagctgaatgccattgtgcattgctgtgggacctttaaacatgcttgatgcctcctgctgaagcaaactctggtttgcgactgaacttctaaggatattctggtaattgttaagtgcagcagcattctgcagaccatttccaatgggattctggtaattgttaagtgcagcagcattctgcggaccatttccaattggtccaataccgtgcgtctcattcgcatgggtgttcatttctgttttgacacccatggctttgaggttagtctggtcattaggaaggccagcagctgccattagttgctttggctcgtgcatgttttgtactggaagttttgctgcagtttgcttgggatagctcttcagaccctctgcagatgaacagggaaaacattaaacatttcaaagcataaaaaaattgctgaattttacagggaaaaagggggaaaaacagctgcttcgctgttatcactgtattatctaaattggtatgctgttataatctagtatccagcaacaataataataatttaccaggtaatccttccatacggcaaccacacaccaccatagctagttcaaaaaccatgtttaccaagtgatatcataacaacaagtatatgatgttggatttggtttgccatggatatgcttttactatctagccctgtaagcattttccccaaacaatagaatatctctcaacacttcagaccaaaagaacttctaggcttatgcttattaccattttcatgcaaaacattgnnnnnnnnnnnnnnnnnnnnnnnnnncattatataatattgagcgcctagtcaaacaatagagaactgagtggtgaatttgcataaaccatacctataggaccaagcttgttcttgtggctgaattcaatcaggtctttcatgtgattcaccacctctgatatctgaagaggacacaaattcaatgaagatgctgtgtgcagaagtatattacaggaaattctggataatattatagcaaatgttaaataacacaaggagaactcgtgaaaatatggatactgttagcagcgagatattaataactaaagaaaattcaggagcttctttatggataatatcacaaaaataattaaataacctacaaatgctatgcttacctgcaagcagcgaacatatcttttagatagaccatgctcatttaaggtgtggtggtctatatttttcgctagctgtcgtgacgccgtcacaaacctaaagagcgtaatggggtgctgagatcaattagatcataaataaaaaaaactctagatggaatttttaaaaaatcatgatttgtcatgccagaagaggaattaaaattgcatgtcaaggaactagtggcatagttggctcactaacatgttgcaaatgttctgtgcatcactgtttgagaccccagctggaccactttcagtggcaacagtttgatatttctgggcaacttgcagcagatgagcaacctggaaaaagcacatatgaacaatgagataccaagtcaccaaaattggagtacaccaaagaatggcagagaacaaaatgtgcagaaaaaacagggatgtttaccatcaggacagcactaccaaaataaaaactagacaaggacggtcaagatggcttaaaattcgaaattatcttgtgtttttgcatgtgcagccctcaggaagccagtacataaattggaaaattaaacaagaatctaaatagatgttggagcagtctagcaggaaaaagaaggggctttttacaacccagcctaccaagattcgcaatattcatccaactaaaccactttattaaaattgcttacatacgtgttgacaactatcacataagaggtgtattgggtatattacagcagctaatctactatctgctctctattgatcaaagtttaatcaaataaaacagaacagcataaatctacctggggtgaaagaaacctgcgagtgatatactcatcatgtcgccgtgaacagaactcccaggacattatctgcatattttcacatgaaaacagcagataagaatgatcctaaactgtccaatcatttgcaacatctagatattcacaaatgcaagctattacaaataagcctttaccttcagttctggtgtgaatatgattctcaactgcccctcgtgtatcacatgcatatgttcataaatgcttttctgaacaactttagtatgttccagcagcattagtccattgggcaaccggaattcattggccatgtcaaggaataagtattcatctataacaccatggtcaaatctaatttgacagagtctaggaagtatttcataggtagcctctgccagataagattgaaacaataataacaaagtgagatcaacatcatacaatggaactgaactaatgaaaaaagcaaaaaagatcatgacttcttatgagaagaacacactagtactttaaaaaaggagcaaaatacaaagtagtccagggaaaaatatgttgtgaggtacattttgaagaaatggcaggtgcaaactgcacaatatatggtaacatatactatgcagaaatgcagaaccagaactacataacaatactaggatatcaccatgtagtttcaagaaaaatattttctgccagtctgaccaatcattccaagtatattcaagacagacaaagcctcttgagatataaacttcataggatactttcttttttgctcgtgatggctaatttctcatatgaaagatacactcaagataatacagttttatatatttgcattttctgtcttgagatgaggaggcaatctctatagcacaagacatgtaggaatattgagtttatctaccaaaagtactataggcacaaaacagtgcagtaattgatcttccataaaaaaagacaggagtgggaacagagcaaattgcaaggttcattgttatgataatgaagctggataaggttccaaaaaagtagtcaactaaccatatcctttgcccccatgtgtattacaaatgtcacagcgccatgaatcctgaaacatggagaaaatagtaatttaaaaggtgcaactacgaatttatgcttcacagtttactaaaatctcaacagcatcagctatctcagctctcagtagaacgatcattaaaaaatgaaaatgcaatgctaactatttcaaaatattcatctatagaacacgctcatatggattttgtttctcactacaatcacaagatacttgactgtcaaaatatagtgttcaatatccaagcaaagtttaaaagagatgctaatcaatattgttgtgaacatcacactgagaagtattctgttgaaacaggaaagtaaagggcgtcaatgtacaatgcagatataaagatttaagtgtgaaccgtgaactgaccggagctgtgtgtggaacagcacctgaaggatttcctcttttctcatacgaggatacacaccatctttctcttgctcgtggtgcaaaatattcatcaataagcttcctccagtatgttattggattattctacaagcaggtactccagtaaatagtaaatcttatagccaagaacatgtgtcttgcaataaatgtttacaacgcagaacctcacctctggtcggtgacgcttatggtataagtattgctttaaccttcgagaacaaagcccattctcgacaggagtcctaacaggtccagctagctgcattccaggctgcgctagtggaggcctcaactgtggctgccgaggtatgccaacttgagattgttggatctgtgaaaatggttgcaacatctgatgctgctgttgctgctgaatctgtgccagtttatgctgatggatcaaggcttgaatctgagggttctgttgaccctgcagatgaagagaactctggccttggagcagttgctggattaaattgtgttgcaggatatcatcttgcctaatatcaacccttgacttcttctgagcatgcaatgcaccagcagcatcaataacaggttgtgatgttacactagaagaccttcgcttctgcatctgctcttggggaggactttgttgcacaatgggaccatcaataactgaagatccagagatgttattggatgaaaacgacattggggaagcaggaaggcgcatgaatgaatcagcattcatgctcgtacttggctgcaactgggcacctccggagagcgatgagttagcatccgtcaccaaagagctaacaccaatgcttggcccagaggaatttgtagtgctaatagggatactaccatgcatatccctgggaacaagtccaaggttggagcatggcgccccagacatggaggttaccagggttcgatcccaatcatcactttgaagaacctgcaaaaggtgaacatgaattattaggaaataaatcatcaaatatcttactggataagaactgttaacagcctaatgcgtgagaactgagaaatggtcagcagtaactgaagccaaacagatgcaagtagtaatgagattttagcatcatgaaatttctcgattcaatggttgaaaaaacagaaaacagaagaaggccatttttcaattctctaaccatactacgctactgcaatagcataaccagaaaatgaaactagaatccaacaaatggtaaataaataaaaaaatcgtctttgaaaagaaaataagggacagaaaatatagcatgaaacacaaattgcaaaacagttgatgctggttatgcagggtgtgagctgaaatttactcttttggttgaaattagccgagctttagcattctttccaccacacaaaaaaaaatatttttcccaggttcctctcatacaagtacaagaatggagcatataccaaaatgtcttccaggtcagatcaaacaacgaaagaaatgaaatagaaatcaagttcacatcagacaaaatagaatactgaactaacttcacaacaaaaggctccagggcaacgaatcgagagaggaggggaggggaaactgccacgtccggggaggatggagagagaggacaacgaaggccggagatgtgcccgcagccggatcgccaaccctagcaaagtagaggagcaggagacgaaacaaggagaaaaattcccccctaatctttgctccgtagcagatggataaaaaccctagcccaaactcgccccccaaaaaccaatcgaaaaaccgagctacaaagattaagctaacactcgaccaagaacagaaattccacctctacacccccaaaattaccacgctacattgcaggaatcggcacccatcaacccaaaaaaaaaatcacccaacccctcctctcacaacccaaccacaaatcgccccccaaaaaggggagcaaaaacaagaaatacttaggtcacttcccgcggtccgagccatcaacccccccccccccactaccaaaccatctctctcaccttgagttcgtcggctcaatcgctggccctcccaaaccccaacttctcctcctctaccttgcagctgcgatttttttttcttttttgctgcgaattttttttttctctcctcttccgcttcttctcctcctcttcctgcgcctgtaggcggcgtcctcgccgacgagcaaaccggttaaatagattcgcggcgcccgggacggtggcgaccggctgcagccggtgggccgggcccacattgaccgccattgaccggtctccgtggggcccacgggaggcctccgggccgtcggatcggccgcggagccgcatcgcgaggcgggtgtgtacacgcggccgcgcgtgattggctcccggtgggggcgggggaaaccgggagacgggcaggtcggctcctcgctacgcgcaccccgctcgcgcgcgcgcgcgtacacacgcggtggtggggccatcttgtcagcgaccgtgtggcttggcgggtgtggaaacctcggtgctttgcggtggaaggctcgggtgatctttttggccgagcacgcgggtagctcttcgtggggcccacacctacggttcgtggggcccacatgtaagtgagggtttatgcagggcgggtggctgcgttggtcgcttgaagaaataggaggggtcttttccaggacaggaatgacttggtaacactgactttatcgtcactgaacggtgggtccattgatgtatggcccacctgtaagtcagatctaacatgtgtgtgggtatggctatgcgtgttcggattaacggtgaagtttctgccctttaattttcaaggaccgactgctcactgctttgcctaggaagtggaattgctccatgcacacaaaaggctacacacaagggtggggggagcttccttttgtggctgtacaaagggtgggggccagcagaggctgtgctgagtttgactggttttgcattgtctatgcaaggctggaagactatcataataggctttcctttagcttgattattgcagcttacatagcctaaatcattgtaatgggggcataagggattttttttatgtgggaaatacaaaaggatgaagattgaagatgatcaatggttgttgtggttatagaacatgtattttgtgataaatggaatacaattatggagtgtaggttgtcctaaaaacgtgattcagcatagacagaaaagtgatatcttgtctagagcacaacttcggatagtgagaaatatacggcggaataactggatagaaacctatccaaaatacatgaaacggttattatatgcttttatatctataagatattagtagacttgtctagcacgtcggatctagtaaaatatttagtatactatttttgaaagaaatcagataatcatgcttggagtggcattccaataattttatattattatttctaccaataataatataaaattattatattattatcttgtactccctccgtcccaaaataactcaacttaagatgggccatcttaggacaacgaatcttgacaaatgctttgtccagatattttgggacatagggagtacatgactatgctatgcagataattcttttcaaatcgaactgggatgaattttgaacctgtttagcctgtttttgaccagctttaaaagttaatgtacatattccaaaccagcatattaatcgcttcagctgatggtttctagcgttgtgatggagtgcattccaggttaaccgcgttgctaaaccagccaagccaagccaagccatccctggttacttgattagtctgtgtgacgtgtagcggttgcatccttcgcatggaagaatacatgacgaggatacaagtcagcggccactatataattttccatcatgtgcatatacgaggttcttatcgtgatctaccgcgatatcttgattatatttcttgtaatttgactggttttttcaaagaaagagaactcaatgtcaactcatctttttttttcccgacagcagccccgatgaactaaggcttccttcgaaatagagtatggagtgagcttaattatcaaccgtacgcaaaattaaaaaaaatcattagcatgattaaattaattaagtattaatactagctattacaaacttaaaaaatattaatctaattttaaaagaatttttatgtatatttttttagaaaggaaaacacgattaattgtttagtaagcgtgctgacgttaaacgagaaagttgcccgaaatatgtttgatcaagtttactcaaacatttaaaagaaaactcacatgatgatttgctttaatttagtaagtacgcagtacatgtgaaactaattaactatcttcatatacaagccctgaacgatgcattcacacggatcaattaacacgagccgcgtcgagtagcatgtatgatttctgatattgtacaatcaaccttgaccacccaaaaaaaagtcaaaaagaatccaatttgaagcgacacgtctcctagctaacaaaacgcagcagagagaagagtaacagtaacacaccatgaacacgtaggtacatttgcgttctgtatatatttacggaattttcaatttggtttctcgccatcgccaatccaagacactgcgaccggccatcttaaatcgggcaggaaatcgacaagtaattcgattttgatagctttcagtttacgttccaccgcgacgatcgatggattgatgatgaaataatctcgatcgatcactgcatcatgcatgctgctgagtccaatcaataatcggagatcacctccccttcatgtcggcgagctgcgcgaacatctcgccggcggcggtggtggacacgtcgggcacggtggagacgccggagccggaggaggtcgccggggccgcgccggcgccgtcgtggtcggctggcttgtcggccccctcgggcgggttggcgtcctgcagctggagcgcgtactcgaggttccagagcacgtcgcccatggagatcctgtcgctgccgaactcggcgaggcacttctcggcggcctcggcgaacttgttgagcgactcctggttcaccgtcccggcgagcttggggtccatgatcttctcgatgaggcccttccgcttccactgcatcccccactcggcgaggctgacctgctcgcgcggcagctgcgggtcgatgggcggccgcgcgcacagcgtctcgaggagcacgacgccgaaggagtagacgtcggacttgtccgtcagctgctggcaccggaagtactccgggtcgaggtagccgaagctgcccttgacggcggtgctgacgtgcagctggttcatcccggggccgtccttggacagcccaaagtcggatacctttgcgacgaagttgtcgtcgaggaggatgttggtggtcttgacgtcgcggtggatgatcccctgcgccgtgccggtgtgcaggtagtggaggccgcgggcggcgccgatgcagatctccagccgctgcttccacgtcaacgccggcaggtccttgccgtagatgtggtcgcggaaggggccattgtgcatgtactcgtagacgaggatcatctcggcgttctcgtcgcagtagccgatgagggagacgaggtggcggtggcggagcttggacagcatctggatctcggtgttgaactcgttgatcccttgctccgactgcgggttcccgcgcttcacggcgaccttggtgccgtcgtcgatctcgccgatgtagacgttgccgaagccgccgacgccgatgatggcgctctcctcgaagttcttggtcgcggcctggatctcggcgaaggagaagaagcggccgaggccgagggtggaggagaaggtgtagccgctcttgctggacccgcccttgctggtggtgaaagattggccggtgtggatggggagcagccacgacgagaagctgttccggcgctcccagtcctggggccgcttgtaccacttgacggccatggctcccaggccggcgaacgcgccgaacatcatcgcgaaccccaccgccgccacggccttgcggctgccgctgccgtcgtcggccttcttcccgtccacgccgaactcgccgtcgaggctccccaccgagttgctcatcttgagcacctccacgccgctgagcagcgcgtccacgcgccccgtgtcctcccccatcggccccacctggatgctcagcttgtccgtcgcgatcgacgagttgacgacgatgtccttgtagtacgccgccgacagctcgccggtcaccgtcgacaggtccagcccggagatggccttgcgcccgttgacgaacacgttgaagtagaggtcgttcatgctcttgctcacgatgtccgcgaagaagagccggaccaggtagccgaacgccgggtccacctccatcttccacgacatgttgaagctcgggctccccacgccggcgtccgccatcttcgcgcagctcgcgtacacctgcgccggcgccaccagcttcgacgtcccgtcggggaacttgatgttccccaccggcaccgacacgtccttcaccgcctccttcgactgcacgtacggcgcgtccacgtcccactgccgccccagcgtatccttgtcgggcgcgatggccgggccgccgacgttgatccggtacaccacctggtacgccgcctcggcgagcccggtcatctctccgacgggagcgatccccatggccatgtctgtgatgagctcgtcgggggcgttcacgacctcgatggcgttgatgaacgcggcggagcccttgagcgggtagaacttgacggcgaggtggttctcggtggcgttcacgaggaactccttcatgaccggcttgttctcggcggtgaagctgtggaggaggacgttggtgtcggtggagacggtgaaggtggcggtggtgaggtcgaagtcggagttcttgagcgggaagaggtagaggcggacgaagtgccagcccgggacggtgagcgggaagctgtagacggcctcgtcgcggaagatccgggcggtgaggtagagcggcgagggcacgtcggcgtcggtggtggcgaccttgatggcgtccttggcggagagaaggctgttcgactgcgcgtccgtcttgtacaccttgccgccggtggtgacggggctcgtgctgccgcagtcgatgaggaagttgtccttgggcgtgaacgtcgacggcgtcggcgccgtctgcgcgccgctctcggtgaccggccgcccctgccccgacacggccgtcgcgagcgccgccgccaccgcggcggccagcagcagcgccggcgggatcatcctcccgcggcggcgcatggtggtggggtggcctacgtggcacgcaagacgtggcagtgtattattggaggaggcgcgcggcgccctctcgccctctctctctggttggtggggccaatcggaggagagggaggagggggcgtggggccagggagtctagaagagggtggcggagaggtgggcgggttatgtgggccaatgagcgcgccaagtttagtttaagcaggccgcccctacggttgggcccgcctcgcgcgctccaccgctcgcaaattctcgcatacgcgcgccgcgtcggccgcctattcttagcacgcgacggcttcgttcgattgcaggtggaggagcaagatttgtaccgcacacgaaatctaatttgcaggtggaggcaactccggctcggacgtccgacgtttggggaaaaatcgggcgctgatgtcagcgcccgatttacgtgcaaaaactactttaaattaatttttctcttaaattacttatctaaatcatgattcgatttcaccattaaattcgttgcaattaaatcttcaaaataagaccacacatggatatattccgacgattttttttagcttactgttgaattatttttaaatgttgcacgatgttccaccaggtatatcagaattgtttcactaaatagatcgaaaatgtttcactcgtttaaatcgggtgttgtttcaccttatataaaaataagggccatttgcttatttgaccctgttttgaaggctaactaccaatttgaccctctttttttgagtttgcttatttgaccctgcttttcgaaaacgaacgatcggtctgaccctgttctgttaaggtgagttgacggtgttaagttaggggtaaatagtctattttgcccttgcaacgaagctgacgaccggcgatggcaacgaagctgacggaggcggagacggcgacgacgatgctcttcccggccacggcgggcgcgagtgcgggcgtgagctcgctgcacggggccatcccggcgcttgtgtcggcggggctcggcgccgcggccgacgagtcagcgggcgacgaggccagggacatcggcggggccggcggcgaggccatcgtcatcggcggcggtgggggccttggcgagcaggcactggcgcatgtcccctccgcgcgcataccgccgccgccgccgccccctacatccacaagctgacgccggcgcggatccgcctcccctccgcgcgaatcccgccgccgccgccgccgcccctacctccacaagctgacgccggcgcggatccgcctcccctccgcgcgcatcccgccgctaggcccggctcctctcctcccttcgccggcgcaggcctccgcctccctccccgcgcgccgatgcagatgccgccagcgccgcctctgccgcaggcccggctcccctcccttcgccggcgccggcctccgcctccctccccgcgcgccgatgcagacaccgccgccgccgccaggcccggctcctctccctccccgcgccgcatgccagcctccgcctccatccccactgcgcgcgttgacgccgccgccgctaggcccggctcccctccctcccttcgccgcgtgctgtcaccgccgccgcaaatcgctagcagaagagagagacatggagactcagagacatgtggatagggctagagatggatatggtttcctcaagggtattttgggcattatgaattttaattatatttttttctttttttaaaatcaaatcttaacggtgtagtggaaatagggtcagacggaagattcatttttgaaaagcagggtcaaataagcaaactaaaaaaagtagggtcaaattggtagttagacttcaaaacggggtcaaataagcaattgtccctaaaaataatgtttcagcaaatagcgaaagaatgtttcagttcactgcaatatttgatccatacataatgaaacattataagtacactaggtgaaatattttttggtggaataagaaatgaaatgaattcccttaatagggggtttccaaaatatatgggttttttgttgcaatgaaatatttcagttcactgcaacattggatctatacatagtgaaatattgtgagtacactagatgaaatattttttgtgaaataaaaataaaccaaattcccttaatagggggtttccaaaatatgtgggtgatttgttgtaacggcgcgttccataatgtcaaaatacactacaatatttgatccgtacatagtgaaacatcgcaagtactagctgaaacatcgtaaaactactagctgaaacatcaaaagagatcatatgcaatattcaaaaaaatatcaatagaaaagctaaaatattttttatcgaaatataatcatgtgtggtcttgttataaagatttaattgcaacgaatacaacggtgtgatcggatcgtagattggataactagttttagagaaaaatcgttttaaaaggagcgataggaggcgcgggcgcccgaggcgtccaatttttcctctgccgtcgggcgccggcgtgcagcactctaagcccatcgcagtggcggtcgaggagacacgccggtttagcccgttgtttttcgttgggccgtggactagtggtgagcggtgaggtcataacatattgacatagccaatccaaggtttatttttcttctttaaattttgtttttttaagaaaagacaagctgccaatttttattaaatagagaaggagtaaacggagagagctacaaatcgaacgtccgacgttgtaaaaaaaatcggacagtcaaatgtttcggttgactgttggtgcaacattaagttatacatagtgaaacaaaaaagtcagcctatgaaacatatagaacttttgtgaaacataacaataagaatacatggtgtaacatatttctatcacatatgaaacattgagtttttattgtctgaaacatatgttttttttcatcagaatataatcatgcgatatcttgttgtaaagatttaattataacgatttcaacggtgtgatcgaatcgttcaacggataagtagtttagaagaaaatttttttttaagatcactaaatacttgcatcatgcatggtgtgggggagaaagctaatagaatagcataagagagactaggggcaatagcgtctcatattttttcagtgattggtgaaacattgagttgcacatagtgaaacaaaaaaaaattcagttattgaaacatttaattttttttatgaaacataacaaaaacacacattgaaacatattgctactgcgtctgaaacattaaatttaatggattgaaacatatatttttctttcatcggaatgcaattatatgatatcttgttataaagatttaattgtaacaaatataatgatgtgatcatatcataaattggataaatagttcaaaagataaaacattttgaagaccatcgtatgaatgtgtggagacatagggtactattagtagtttgttcatccgatcttttcttttcgtcggacttatgatctcaagtattttcgaggttatgtgggccagcgagagcgccaagtttagtttaagcaggccgcccctacggttgggcccgcctcgtgcgctccaccgctcgcaaattctcgcatacgcgcgccgcgtcggccgcctattcttagcacgcgacggcttcgttcgattgcaggtggaggagcaagatttgtaccgcgcacgaaatctaattagcatataattaataaaatattaataattataaaaattaaaaaatagatttatttgtattttaaaaaattctatttagaaaattttaaaaaacacatcatttaatagtttgaatagtgtgaatagtgtgctaacggaaaatgaagaagttgaaaattttggagttgaagaatggaattgggcaaatgggaggtagaaatggcgctgcaaatttggatcggttgtattcagagatttcatcagttatttcttcttcttctaataatgcatgaacttggacagcagacaacactggttgatggagcaagcaccgaacacatcacatggatgcataataagttcgattaattaggaacccgtgtttatgttttgtgtttgcagtggtccaaaatcctatgtttgcagtaacgttactattgttcagtaggggtgactgactattatcttgtttgcctccaataattacacagctgaattgcaatgacggagtcgatcgatcacctgctgcaaattctgcggttgtttggcccaaacaggctcgaatcaatggtcattagtgatcagggaaactggagatattaatttcttgtgcattaacgatcaaaacaccgaagtagctaaaaattcccgtttatattttatacgtcttgcacgttacaaccaataacacaacagacactaacatcgaacagaagaattaaaacaatacgtatagaacaaaaacgcttacttcctccgtttcacaatataagtcattctagcattttctatattcatattaatattaatgaatctagataaatatatatgtctagattcattaatatcactatgaatgtggggaatattagaatgatttacattgtgaaacggagagagtacataatagtactgtgtatacgtacggtatatagtagctagctcctaataggagtaataagcacttagagaataaggatagataagttaatccacgcatgatatcttgtttgattattagcatccgacattgaaccacctcctccttgctggcttccaccgctcctccgccttcctcttctccttctcgcacgcacatttcgcttccttcagattcttcatcttcagataaaaaaaatatccatcaaattaattcagatttatatatttttcgaacaagagattcagatttatatcagatcgataaaatgtgtattgataatgcacagtttccagacttttctttctttgtacatttctgcaattattattagtactaatctagcgagcttaatgtgtgtgttgctaatgaatgcgattaattaatctgtaataatcatgtcaccgtggatgtgttcggtttggtgcgatgaagctgccgcgcgcccttgtacaggaaatgcgcgccgctccagctcccgccgccggccgcggcggcggcgcaaaccggcgcctggtgtttgcacggctccggcagcggcggctccgaccacgcgcggtcctcggccggccgcgccaccgccggcacgctcgagccgccggccgccgccgcgacgtccagctcgcagctgagctgcctgatgcgtgactcgagcaggttgaggcggtccatcaggctgcccttcgcctgcacatgctgcagcgccgccgccggcagcgacttgctgtgctggtggtgcgccgccggcccgccgtcgccgtcgccggcattcgcccgccgctgctcctccagctgccgcaactgaaacaaagatcaaacaacgacatggtgatcactgatcaatcgacgaatggatcgatcgacacgcgacggcgacgctctctcgcgctcacccggaggtcgagctggtcgaggcggccgaggagggtctccggcggagggagggcggaggcgctgatgaggacgcggcgctccgagccgaggagcacgtcggccatggcggttgcacgccggagcacgcagcggcaggtacggtttatatagaaggccgcgcgcggcggcgagggcggagccaagatcgggtcgtggactcggctccgcaatctggcccgcgctcctcgcgcgcgcacctttgacttggacactgtcatactgggcctggatttgttggggttgggctttgtatggccctcgtggcaggcctacatgccaggcccaatttgaggcccaccgagtagtcgtaattaacaggagaccaacaaaacatgatactccgtatctctttgaagaaagagagcagagttgatgaatgtcatgtcctgagatttggtctattttttttcacgaacgcgtaaaataattgcacgttaatatattagaggaaaaatagtttttgatacacaacgcaatcagccagatcggcttatgctaggggaatgaagaaaagcaaaacaaaaattgtagctaggaaggaaaaaaaactactacggcggctatgaaactccgattggtgggaaggggtagagccacgttacattttcaataaatctccaaaagtagcaatgcacgctaaagaccacagatgatcttccaagcagatatactctagaaccactgagaccgaagagagcgtagaatcgaaaactctggagttccgttccttccatagtgccaagagaccagaagtatcagagagtcgaaaccggcacggagatgctcagataaagcaggccctagaggttggccaccaatcctgaagccgactgccacaagaggaagagagagcggtctagccaggaggcgacaacacacggaacctgacctgccgagcgaacacacagtcgaggatttggtttagagaatgtctctattgggtattgtaattggaagataaattgcgtagcacgtaaattagctagacatgtttttaatttaatcaattttttttaactaggttcaacccctggcttcttattaaacgttccaaatgtcatccctcaaaaagaaaaagagagagagagagcagagcagagaagagttgatgatggttggatggtgtggtctggaacataagaaaaagtcagaatcagatgattggtccggaggcatctctctctctgttgccaaaagcaatttctgtggtagcaaaccatgatcatcatgcttcttgttctgggagatccactgcaaatttccacaaccccacttcacaatgtacacccattgcttgcccttctctctttaccgtttttctgcatccatacatgttttctaagtggtagcaactcatattcagctgtgtctggaattgcctaaacattttgaaaatgcttcaagcactgaactgctctctaccaaactcctgcactactgcatcgcctcttgctttgaccatcagaatgttacgaagaaattgcaccccttaagctccacatttcacgccagttgcttgtacaccttttttttcaaagcgaaaattgcagaagcaactgtcgtgaaatgtagagcttgacaattgttaaaattacatgagtacaacaatgtccactgtattaagctctacatcccaccggaatatataatcaaaactcgggagagaaattagcctgcaggactgcagtacaggactccactccacatgatcagttgttgtaaccagactaattaagcaaggcgagctaatgagcagcagatcgagcacatggtaatgcctcgctaaaccgatcctgatcgatccatctgcttttatattaaagagatggcacaagccaccagacgatcgaactacctggcaattgctccttctctctctattattatttttttggccattaattgctaactgaatactcaaggcaaactgtgccaaatgatttaattatttgatcacttatgtttaacactccaacgatcgcataccaactgctagtactggtattataaaccagtattaaactagtactatcatgcatgatgatggaagtatgggccattcaggtttcaggtttacgtgcagtgtggctatactgtaggacgaacactcgcaatgatttaaaccgacacttgtggtcaattcaaacctgcccaggatcacgcaagatctctctaattttaattagttcgtgctaagaaagtattatatatgaaatgatttttggttgctctgaaccttttgtgtcgtattcaggcacccaggctgtcttggaagccatttggattccatgggccacaaatataggcatggacagcatgtgaaacttctgccttttaacaaatccctgcaatccaaaggcgattaaaacactttctgaaaagtattttctaacataaatacaataactgtctttttcacacaaacattttctctaggcccatgattcaaactctcataaactatggactccatctcgaacaaaataatttctttttcaaaaaaacgaaaagaaaagaaaccggtatgaccgcataacaatagtcagttacatttcaataaacaaaagtaaaaacctagacgggttacaagaaaagggaaaagaaaaccctcgccgaacaaaagaactccatatagatttcatgagattttttctatttttctatattattctcgtgggaatcatacatttaaaaaggaaaattatacgaagtgagtgagcgagttggtccgtgtttggacggaagtagaggctatgggcagcatgaccaatgacagggaagcggcaccttccgatcactcaggtcatccattcatccattcatccatccatccatccattcatccatccatccatctcaatatatagctaatctgtattttctgtgtgcttggaagcagctttggagggctctattattgtctttagcctctctgattgatatgactccctaaccatatgctattatgatttatgtcatactggcaatgtacatacgcctctatatatattcccatatgtttagcttaatttaaatctacatgatttagcatcggtgtcggtatagctacaagatatcgtaagcttagcttttgatcatgagccttgttgcgactaataggaaggttcatcagtgatgaaatgaatagtgaggcttcgttctggcatccctagggggcgatctcgtctgtgtctctttgttggtctagcggcggtcggtcacgcttaacggcggtcgatccggtgctagccttctcctgggattatgtgttggcgatgtcggtgtgtgggtggttgtatattttttcctttttcctggttacgaccctccagggttgtaatcttgtaatttttttcctgctctatcaatagaacttcgcaccgtctcgtgcgagtcgttcaaaaagaatagtgaggtttcgtgaagaacagttgttgggaagaggaagaataagagagcaatgctttacatatttcaaaaagtgtttcgaaaaacatgcttcaaaattggatattttttccttgtgtagttctgaggccttttttatctgggaaaaatttttaggattgattgtcacatcggatatacggacgcacgtttaaagtattaaacatagtctaataacaaaacaaattatagattccgccagaaaactacgagacaaatttactaagcataattaatccgtcattagtaaatatttactgtagcaccacattgtcaaatcatggcgtaataggcttaaaaagttcgtctcgcaatttacacgcaatatgtgtaattttttttgcctacatttaatattctatgcatgtgtccaaatattcgatatgacagcgtgaatttttttgttttggaaactaaaccgggcctggatttctggtaatcaaaattggctcagtcttgatcctatccatattgcctggttaaatatagcattgcctagatggaaatagaagtgccataaaaatgcacggtgctgacaattcaaaacaacaactactgcatatttgaaaaaccaactaactaaaacgtgtcaaatgatctgaatggaaaattcagagcagaacaattaagcgatctcaaaccaagattaagtacagaataatcaggcgtgcgtttttgtttctgtaaaatacggcaatgcaagcgtccgaacacaacacacataaaaccacatttagtagttaagaactcatagaccgacattaactaatctctgcaacgaataaaaacaacaaaacgaaaaggaaaggaatcggacaaagaaaggaataagaggagaaccacagaaagcaatcgccaaagaaaaggaaataaaaaacattgtgcaaatcaaaacgtggttggctgcatttcgaatcagatacctgtctttttttcatcagaaagcaaagctgattaaggagaagaagaacttgagaaggaggagaagagaggaggaagaaaggaagcagagacgaggaggtgggttacagcgtctctttcctcggtcaacgcaggcgagaggagagcgttgacagtgccagcgtggcatccccaggtgggccccacacgcgcgacactcctgactgtcggtggagctcagactgtctgtcaccttgtgccgccggcctgcgtgtttcagactgttgatgaagagttgttagacaaaaagaaaaaaaaggaaaagttgatctcttgttattagcaacttgttgatcttttttgtagtagtattttgaggagaattcagtggctttggtttactaatccaatctctcaagctgacttgattgctgtgcacatgagcatatagtagttactacttcagtttcagttaaactaagctcaccctccaacgactaatgcacagcaccacgcacatgtagcagtgtcatttaaaaattcagtaacagtttctgaaaactaaaaaacaattcagtatcagttgtgattacaagaacacaatgcaactgatcctgtatgttttattcattggattatatttttgacagtgcacaaaaacacactaataaggcacaacaaagtagcactgttagggtggcggccattcattaaagattgactcgtatcgctgaatgccttgtgttcctgattggattcaactgtttactttccgtgctccactgtttgggaatcaatggttaattatggggatcattagcatgatgctttgctttcttttgtcatcagacttgtatgattcaatgatgatatttttttcttaataaatggaatacaaactagtaattgtcaggctgatcagctcacatccagacagagactgcatactggctgatactgtcagctgtgtttgtgtatgaatctcatacagacagcagcagtttactcagctggttggtaacaaatgtacaccaggttacaataactcttctgtagtttttgaactataaaccaaaaacgacatttagagggagtgacgtccctccaaatatttttttaagaaaaaattatgagtgtatcgggaattgaacacgagaccttggggttaaaactacataccccttgtcattgtactatgaagtgcatctcaatttggaactatagttttatagtttcttttgtttttgaactattaaccaaaagagatagtactctctacatttgaaattactgaacattttagctttcttttaagtcaaacacgtctatctttaaccattaatttttaataggttcgtatagtctaataacatatgaattatatatatgttatgaaagtctcatgctgaatctaaaaatatacttgaaatttattatgttaaaccatacaaatttattaagaaaaaaaattgacttactagaatgacgagtagtttaaaactgagggagtagcttgtttctaaaaccataattcaagagccacttcaattcatgcatcgaaaagctgattgccagcactactgtagctgtcctgcaaacctgcaacagcaaatctagctgtgataaattctgatatctgaaccattgcacttcacttttgaatcatagaagatgaattccacaagcatgattcatgtcccttaacttgtgccttttcttttttctaggatcatgtgatctctttatttattattcctctccctcctggcacacaaagccttcctatgaccactactattgtattactagattttaaacacctctaaataaattaaaaaaacaaactcttacatttttcaacattattatttggcattgtcatgctgcctgctgacctagaatttcacaagattttcataggaaacaattcatttccttcaagatttccacaaaattcctctgttccaaataagaccatgccaatgccaacctcaatggccttgccaaaaggttttgatcatataggcaagtttatttttagttgttttttaaataaaaacttggaaaaaaatatcctgttatgttggacagttcaaattaatcaagagcaatttttttccggtagttggatctagctaactaatcacaaacaaattattttcgcaccttggcgcgaataatgctcccgcgattatttcatctgcatgtgctgcgtattctccactgatgatcagctgctgaactgtaccagcactgctaatctactacgctagctactttgtaactgtttttaaagcgggtagttacatcgttaatttttttttgttttgattacaagtactcggtgctaaaatatatagtatttaaaaaatctattaggcgatggttgggacgttatatcgacaagcaaatcaaacaggaaggaaaaggtttgcagcagcatcagccgacacaatacgaatcaccatctaaccaaacgaaaacgaatcaaaacttggactagcttgctgcaaatttcctggttttaaaagccaagaaaataataatttctcaggcatgtggaatactagtagagacgacaaggaggaaacaccaaaaaattcagcaaataaacaaataaatgaagtgtattcatttctgatggcgccatgatcaagcatctagcacaatgtggagcatccacccttcctttctctcacattccacagtagaatcaaatcaattttgtcatgaaccaacgcaactctgaccctgatcttttcagtttatttaccagattattgaaacatattatttatcgtacactttaaaaactatattttctttataaataatttacactcctctattgcatttcttatcgctagtgttattttctcattaatataaagattttacttcgattttcgtaagcacgcttttaaaactactaaactgtatgcgaaaactctaaatatgaaagttgatttaaaatatcaaatatattcatttgttaagtttataaatattaaaatttaactaataatgtgctaatagctttatcgtttaaccgtgcgtcaacttaatcttaatcttatgagtttcaaacactattattaagtttattcatcaaaacatgtactcctactttatatttatatctgagtgcatagtccgccaataatctaaatcgaacaggaatatatatattatcatgttaattaaatatagttttccagaaacatttatttatataaatctctttggaatttgataatggaaaatgtcatgtggccagtggcaagtaatctaattggcgtatatattccccttgtccatggcgttgcggtttgttccctcatcaacctcaccaccattattttcttctctcctcttctcttcttcctcctctcctctcctctcctcgctctccatccatctcgtcttcttcttcctcctcctcagcttcgagatttcagcttctccaaacccccattcttcccgccacaagctctgctctgtgctttgctcgctcgcctttcccgccattggtgtgcttcgctttcttggcttcaaagatccgacgagctctgtgatagctggggagaagaagaggaggagaggaggatgctgggagcgagccctaaggccaagaaaggcgcgacggtgaagttcgggtcgatgaagaatcctcctcctcccccggtggttggcgccgccgccggagcagcggcggcggcggcgggtgggaaggtgccggcggaggaggtgtgggaggtgcggccaggcgggatgctggtgcagaagaggggcggcggcgccgacgaggagcccgtcaacgtgaagccggtgcccaccatccgcgtcaaggtcaagcacgccggcatcacccacgagatctacatcaactcgcaggcgtccttcggtcagtgcccgccgccgccgtcgtcgtcgtcgtcgacggcgaactcgatggatgggggccatgtctgatttcgttgtgggtggtgcaggggagctgaagaagatggtggcggcgcgaacggggctgcatccggacgaccagaaggtgatgtacaaggacaaggagagggactccaaggcgttcctggacatggccggcgtcaaggacaggtccaagctggtggtcgtcgaggaccccgaggcacgcgcccgccgcctcatcgaggagcgccgcaatggccacctcgagaaggccgccaaggccgtcgccgccgtcaccgccgaggtcgacaagctcgcccccaaggtaggcacccacccacattgcccgccatccatggcgacgccgacgccgaggtagtaggctcacctccgattggttggttggttggttggttggttcggcaggtggcggcgctggacgcgtcggtgaggaagggggagaaggtggcggagaacgacgtggtgcaggtgaccgagctgctcatgaacgagctgctcaagctcgacgcggtggtcgccgacggcgacgtcaaggcgcagaggcggctacaggtgagctgacgagctacctcgccgcctcctccaatctccaccgactagcttgaccgccatggttaatgagctcaacctgttcgtcccatgactctgcaggtgaagcgcgtgcagaagtacgtggagacgctcgacgccgtcatggccaagaacgccgccatcgtgcgcaagtccggcgagaagctcacctccaaacaacaccatcacccgccggcgaggcagcagcagcagcaagctcaccaacaccatcagcagccggcggcggggcagacgcggtgggagatgttcgacctgctgtcctcgctgccgtcgacgtcgtcggcctcctcaacgaccaccgtcagctcaacggcctcctccggcgcgccgccgccgctgccgccgccggcgaaccggctcgactggatgctattctgagcacacacatcacagaatcggcagatgcaatggtggtgcttggttggcaagaattgcacccatgtccggaaaatccgaggtgtcctgtccctgatgagatgatgatgaagatgatgattgaattgccctggattatttgctgctgctctagcaatttggttggccacattacatggtactactaccacttctagatgagttcagttcatcatgtgagagtaatttttttttaattttgttttttctttctttctttctttcttcttcttcttcaccatcaaatgtttgatattcttttgtgtgcatatattctgagaaagagagagagagagagagagagagaggaaattaggggggaagagagaaattgaagtgtattcagattgggaataagtcaaaaagggttattattgttctccaattggcgtttgaagaaaaggcaaagaaaatgttgtacccatatggatacagataccaatacataccgttcttgataaggggagaggccatggacttggactgtggatgatgaattcttaaatctttttattattatttcctgttagttgttatgattaaaaaaattgtttctttcttctccttgttgttgttggtgttggtgttgtctgtgttcttgagttagttggcgcctatctgtcaggcttgattcctttcagaaatgaatagtgcaggggttggtgtgcatctaaatactttattgctgtgccacatttaggtgttgcatcaagccatcagagtccgagctgttttgttttaggtaaaaagaagaagaaaacttgcgagttgctttggcctatttggcgattattacaacaaactaatcagctctaatgaatgaattttctttcttttcctccttgttgattcagcttggatgtctgatgaaatgagagatcaagcgttgattgattgattgattgattcaattaattactagctggttgccgttgcagtgtcagtattgagagagtgaagcatcatgtgtgtattagtgatgtattagtagtggactagtcattgcctggtggttgagctgagcttctcctcttgtgcctgtcacatttgcaattgcattgctggctagagagagatgttgccttccttcctctcctctcctccaagctaatgacaccaaattacatgatagtatccttccttccttcttttgttgtttcttttaaagttgggctatttatttctgaaggtaatgacatggtaccatctgccaattagcaacattgcatggttggtgctgaatagagagagagttttgagtcacatgtttctcgagtgatgatggccaatctttccttttctttaatttggtgagagatcatactccacgagatggcgtggaaccagcttgttaaacactgatttattcatgtttaaataactaagaaaaacaacaagagaagaaacaaaaagggcaggtaacgagtctaacggcagaaggatctttatcatgtatgtctcgtcagagttgttcatcagccaatcgtcatcatcgatttacagtcctcaactaactaatcataagctcgtcaggcagaataaaaatcctgaaaattccatagataaactagtcatacttggccaaatacatagcttaaaaataaagtgtttttgaaggtgataatagtaaagtttgaactgaaattaaggtggcaactggtgctgtaggtgagtctagaaatggggggatgttggttacgtggtcgccgtcgaggggtgagaacaaaggagatggtcggcgttcttgaaagcgaccactcccggcgaacttcgacgacggacacatggatgaacacgcttcctcttcgcctacaccgacgccgccggcaatgcagggcaacgcgcgtttcttttcggctgatcggtttggctgattagctacctgcacgctaaaacatgagaaacataagggtgtagttatatttatggcgtcatattttttattaaaaaatagtcggcatgtatttacattgtaagtccttaaattacatatgtaattttagtgtatttacaatgtaagtctcaaaattacatatgtaagtaataaaattacatatgtaaattcgaaaattacatactaattacatatgtaagtggggtgtaaatgaggtgtaactactgtgtaagtggctgaaaaaaaatcgactgtagcatatgacgccatatttctagcaactccgaaacataattattaactagctgggtggtggcccacgcaattgcgcggctagcacccaaacaaaatcttatatttttttatgattttacttaaaatttattaaatagctatctcattgtcttaagactttgaaagaccaaaccttatcatcctcgtgtttctaatatatagtttgtaaaagtcacaccagttgctaccccttatgtcatctcttcatttttataatttctagatgtcccgtcaaacgttgccactatactcctctgcggcccgtccactgtctcctctctttattatcattgagattttaaaaatcgaacataattatcgtttgggttcatttttactttctagaagtcccgccaaccgtcagcggttttgccattgtactcctctacggctcgtccgctgcctatctttttttattgtcattgagattttaaaatcaaacatgattatcattggttttttttttactttttagaagtttcaaacctttaaaaactggacttgtagttttattttttataatttttagaagtcccatcaaacgatgccactatgcccctctacagcctgtccgccgccaaactctttattgtcattgtgattctaataatcgaacataactatcatcggaattcattttttattttctagaagtcccgtcaaccgtcggcgactatgcaattatactcttatacaccccgcccgctgcttcttctttttattgtcattaagattttaaaaattcaatatgattatcaatgggatttgttttttttactttctagaagccccggcaaccgccttactcgtttgcttcacggcctgcctgacgtccctccttttaatcgtcattaggattcaatttggtgttttattaacaattttatatctcgtatcaaccgccaccactctacttctttataggcttgttacttaatttatctcgtcatgtgtttagatggtcttttcttttaataatctatatttttatcacaaattttagttatttttaaattgtattcctaattgaaatcttatttttctttttctaatttcagattttcttaaaaaaaagttaatatcgtattgtgttatttttaatgtttttattttttattttcaatttcagttgttttaaaattttattcctacttgaactctcttttaatttttctaattttagatattattttatttttattctaaattttaattaatctcgtattgggttcttatatggattcttctttcaatgttgcttatttttaattccaaattttagctaattttaaattgtattcctacatgaactcttattttattttattttcctaatttcaaatttatttatttttatttcgaatttcaattaatcttgtattagattcttatatggactcttcttttattattcctaatttttaattccgaattttagctattttctaattgtattcctacttggactctcgttttcttttctaattttgaattttatttcattttatttttattttgaattttgattaatctcgtattgggttcttatatggaaacttatttcaatattccttatttttaattccgaattcagctatttttaaattgtatttctacttggactctcctttcctttttctaattttggattttattttatttttattttgaattttgattaatctcgtattgggttcttatgtggaaacttctttcaatattgcttatttttaattccgaatttcagctatttttaaattgtacttctacttggactctccttttctttttttcctttttctccgattaatgtgggaatttctagctcccacagcgaatgtggtgcctcctttcaaagctgttttaataatataatagattagcatataattaattaaaaaaaatactttatatgccctaaaatatatgagattttgattggatgaaatacattgtccataattcatagtattagaatgtattctatgcaaccaaaataccctatattttggaacgaagggaataattattagaaacatgaaaaataaatttagtttggctttttagtattaactaaaaaaatttcatacaaaacataccatttagcggtttgaaaaacatgttaacggaaacgagaagtagctatgctcaattagatcttggggtcttaattctcgtcttctcggctaattaatatgtctccacgtttaatttaactctcggatttcaaaccttaattcagcccatgatggaaaaattaaccaaccaagcaaacattaaaacgatgaaaataaagtttgatttcttcacacagatccattaccccatcgattcatctatctgtccatgctgaaccaaagtaccaaatttatgccttacattatcaccgactaataatgatacagcaacagtgacaagtcccggtactgattgcacaagctaatcatgtctatctaataatccggagtatgaagcaaagattcccggccgctcggattgatgaacaaaggcgaagcatcacaaatccaatgacagatcgatcaagcatatgtactgtacattacataccacgatatgatagctagcgcgatcaagaaggccatgcccaattgccaaatgatccagtgacaagcaagctgcagcctgcagggatcggagcagggggacagagcacaagctgaacagtgctcacatagctacagacacaggagcagctgctctctttgcatcgaccaaagatgctgaattgctgagaccacgagtttcagatgctggtgcttgatatttgctgtattctttcttcttctgaattttgccggtgtgcgagttcggctgtgcgtatcttagttatgtagagatcgaaagtgttctcggggaccagaagatgctgatcgatcgatctgcagacaatgcgatgcataagtgcgtgtctcgttctgatcatcaggtgaagatcgagaatggctgaaactgtatatgtgcttgtttgatgctgaatccacagatctgacagtgccatagaattattggcgtacgacgggtacctcctcaggtttcagacagcacttgccctgaccatgatactgttatatatgctgcctgccttttagtatggctagattagattcttcaatctcattccagttgtaccgtgtggtgaaaaagttaaaactgtcatcactggtgaggatgacacaagagtaagtactgataatgccttgaaactgtaggaagaacataccaggatcttctcttgctttgtttgtttctcaaatctcttcttattgatcatcagaattcagatggtgagaggcgagcaagagggagagatcatgcctaaagtgaaaatagccgtactcactactacagaacttgagctgttgggcatattgatgagtcacttagaacatcttcaacacagagcgaccatttttgactctcaaaataactatttggccagcctaacaaaaatttagagagtcaaacttatcttctattccaacagcctctacacatttcactctctattaaccaatgtaccccacctgtcattcttctcctcctctttcttcttcctccactctccaatcccctgctcgtgctagcggggtcagcggcggcgacgctgcggaggcggtggcaaaggcatcgagccgccccgctgccgctccctccctcccttgccgcacatggagggcgacgacgacggcgtgggcaggcagatcaaggaggagaaggagccattgcgggaaaagggaggtgggggggggggggggcaaagcagccgccattggtgggtggaccatcctcgccgaccgactcctcatctcctctaggtgcgctgacctcggcaccccgcaccagtcgcgtggaggcggcggaagtcgctcggtgacggcgcagatggtggcgatggtcgcggctagcgacgacggcggcgctggggcaatgcaagagagaatagtcggcaaggagatgggaggataatgtgtgtggggccacagttggccagtgatttttggttggccaagtttggccagtggaaggagggttttggccagccgggttggagaggctattgaaggacgttttttgactggaacggctaaaatttagcttagagaatacttggagaggctgttggagatgctctacgggtcagtgtgtcctgtacctcgttgaacttgttgcatgactaaatagtaaataccattaaggggccttttgtattgtaggattggcaaataatttttctagaggattcaattcctttgggattttctcctatagaactctttattcatataaaggtatatattttttaaacaaaattgcatttctatggtcaaatttgtaagaaaataagtaagaggttacacctcttggaaactttccatttttttactgtggtgtaatcaaaggtcatacctttctgtttttctgtattttcaatttctgtaggattgaagcaacacgttatttcaattccaacagtttctctatttctccttttttttttttccctatcccacgtttaaaaggggcctaagtagctgtagcacatatagcaaaattgctttgacaaaaatagaaaagagaagtaacgggtaggagatttgggtcgggttagggcccatctgctgcgaaacagggtgaggcccataatagcagtaatgccttggcccatgaaacaaggcttgaaccgtaacatgcttccaacgacgccgtctgccgtctcaactactctctacttctctagtctcaactcaggcacgagttcgttctcgtcttggtcagctgggacccacaaagagcttccttccgggactgtaacgattatttattaaacatatcccaatttgccccgttttgatccgggcacatccacaacttacacggattttcggcacttatcctccacgtttggctatttacaacttacaagacactgataactactataaatttctctcaatattgtaacactaaaacttgagatatgagtcaaactgtctcacgatattttgaacccatctcatacaccacattaataacattctaatccgtgaaagcacctgcaactctcggtgacgaagagccaacatcgggtgccaaaccttgatccaatgtgaaccacctgtagctcatgaagatacacgttcttattttttttttgacaattttttgccaaatccaagcaactgactattataatcaaacaaatggataatcttatttttaatttttcttataggcgcacgtaaaaatgttgatatatgtgcatggagatggttgatagatgcatgtggtgctttgtgttcttaattagtatcatggttttacttctaaaagaaattctaactatgtacacttttgagtagtgttttattccattaagaaacaaaatttgatgatacttaatgtttcataacacgaggatttgcgcttgtggatttgtgcatgtccttagaaaaaaacatctaaatttgatcataatatgatttgaagttaaaattttagttacttttttttagaaaatttaccgggagggagagctttcccacctgaattcattgatataaggagttgaaagttcagtttatccaattatacatcaaaagagcgaatagtggaagaaaatagagacttccacgccgagattacatgacgatcatataattttaaccgctcagcccatagagaggcttccgaaacacacataatgcatacccgacacagggaagcttcctcatgccggaagaccacaccatgacgatgattccaaagacaccagaaacaaagtaggtagaacaccctggaatgtttgttgggaatttgatgtggcagaagaagagaagccagctcacacattgacgcaatgttgacctgaatattaaggttgtcctaaaaagcagcagcaaaggggcagtgtaggcacagatacgaagccgtttctttagccgagttgcaaagatcacaggcgggggtggacacaatgttcttcttacaaaggtttttcttcattgggagccgatctttagcaaggagccaggcgaagaactggaccttgagcggtgctttgttgttccagataaacttccaattgaggcaaggaggcagttcactgcgttggacaagatagaggtggctcgtcttcagaatgtcactagaatatttcgagtttctcacatcaggtctgtcatttgccgtggtatgctcagtcaagagaacacgaaggtagttaaattgttcagccataatcgacgacaggcggagagcaaagtgatctctcaaatccatagaaaggacctcggtaaccgagtcttgcttgccaagcgagtgcgtgtagagtggttttattgattaaacataatggtctcacaatattttagttaccttttaaagaaagggttaggctttattgattaaacataatggttacaatcccgcaaaataagataatgtacctttactattgtgagacgtgacattactaacaaaaataattatttggatagggagactcggggttttcaaaatcgtgcagttgtcatataagataaaccttctcagtttttgaaaccacaatatacctcatggtaaccgtacggttttcacggtaatcgtacgattatcacagtaaccgctaaagcgtggggtgacggtaacccacctaggttcggtgaacttgcatggagtacacaaatcatacggacttgcaaaacaggtgcgggtacgttcccaagtgcgcgtagcaaattattagacgtgcagagggtggagtcgctgtcccgatctcctctcctaataaatcacaacttcgcttctcggttggcagcagcgatttcatccaagcaccacgccgccgccgccgtcgaagccgatctcctgcgcgcggagcggatcgcctctgtcaggtacgacccgccctcttcctcctcccctgctaatttctcttcgcttcgtcggccacgccacgccacgcgcgttcttgccaaccttggtctcgcgagcagcgaggatggggaggaggagaggaattcctctcgaattgatcgccggttgatgcgcccggcttgttcctcttctgcggcctaattttgtacgagttcgggggttgtttaggtggagaaatttggtacagattcgattttacccttttggtcttcttcttgtgcgtccatgccgccgttcatcagctacggtgaccttttccagtctagcttttggaaggggccgagctcccagccatggattagctatcatcaacttagtcaagtgacttgtcgagttgtcggggtgtagttcactgtctaggtgttctcaaaatcaccaccttttatagtggcacgcctcttaaactgtatccatgcaatcaaatttaaatcacatgtcattgagttaacctttatgctactttacaggccactgtaaattttaccgagtttatgaaattgtgaatatgtgctaaaggttatatgagctcctttttttttagcagagcctgctgtttaaattatagtcttataggtagcctgatgagtgatgacaaaccttattctgctactgccaatttttccgagattctttaaacctttagctgttagccctgttacattgctttcggttttggcaatttcttcgttatcactatgcaacagagatcacgactgagcctatattatttttggaattaatttgtttcttttcctgcttcaattgtgtccctgattctgtcacggtaatgctcatctattcactgctataattgtgacccaacatcttatcaccgatgcagtcaccagctatacagtatgagttcactggagagtgcaagagcagatcttgctctgcttattttatacctaaacaaggctgaagcaagagataagatctgtagagctatacaatatggctcgaaatttgtgagtaatggacaaccagggcctgcacagaatgttgacaagtcgactagtctagctcgtaaagttttccgactttttaaggtaaagttttaatccttgtccgcagtagatattgcaaatgagaagctattttttcataccttgacatgatctgtggcaccacattattttgcagtttgttaatgatctgcatgctttgattagtcctcctgccaaaggaactccactacccctgatcttacttggaaaggtatgttgaagcttgtattgccttgtaggaactctgagaacctaaagatacgttttttcacttctcattgtatctttttgctttgtgccatccacagtcgaagaatgcactgctatcaactttcctctttctggaccaaattgtatgggctggaaggacaggaatatacaaggtttgattttctcttcacatcattactgatatacataagcaccatacagcatatggttttatcatacctagatgttgacagtagaaattaatggtaggtaatctaattgtttgtacagaacaaggagcgagcagaattcctcagcaagatagcattttattgcttcctgggttctaacacatgtactagtattattgaggtatgagacttcagactgtagaatctatttaatcctgcccctgatattattacaatcaagagaataccatctgactagtatttcattataggtagccgagcttcagcggctatccaagtcgatgaagaaactagagaaggagcttaaacaccaggagctgttaaaggtaccgtcttatatgatcatagctcaatgtaaccacaattttcacatcttgcttttgatgacataatggcgtgtgatggtattggcagaacgagcaataccagatgaaactgcagaagtgcaacgagaggcgtctcgctctcatcaaatcgagcctcgacatagttgttgctatagggctgcttcaactggctcccaagaaagtgactccgcgtgtgacaggggcgtttggatttgctagctcactcattgcttgctatcaggtaccttaactctcacatattgtcatgtggactatcgtctgtttagagttagcaactgcaaaacctgaaactttcattttgatctgcttatttcctctgcagttgctcccagccccagccaaatccaagtgatccacctgaaggggtgtcagtgggcagttccaatgttgcaaccagtaagaaataaaagtggagctgcttgattgactcatgtggacttgaaaatcctttgtgggttatggttaatatgatgatctagtggattgctgcagctgtaattttaaggtgcagtacttgtgacaaaaaataagaaacttagcatgggaaaaatgttgcattgtttgccaatggtttagtgttgggactagctaataagaacattgccattatatcaacatctgtttgtgtgccttgttcgagactgatgagtggttaaatatgctgtgcttgcttcctgcgtgtgtagcgtgaaagcaatggatgtccggtttcggtgcatcgtggaggaaggctttttctgtgggccgtagtttgtgtgggccggcatagctagctcgtgggcctccgtttgcgttccttgtccactgtcgtcgccgacaagctatttattgagtgaaaaaaagatctaaccataaaaaaaaaaagcatcgcaatacatgtctctactattataaaaattgaagatgtttttgccggcacatttagtacgtcatccgtgtatgagtcggtttctaagctcgtttgcttttagaaatacagatccgtatttgaatcgggttttaagttcatttatttttggaaatacataacatataagaaatctatttaaaaaaactcacacgtaaacttaacatgattttctagacatatatatccaagcgaattctcacagtgaactataataagattaaaatagcattcacccgttgcaacacacgggcatttttttaagtaaaattaaagtatttgacatggatagcaaatataatatattttgaccatacaaaataatatttctgtgcctcccttcgcccctccctgtcttcgcccttaagtgtatcgactcacgaatccatccatagatcaaatagatcgataacctttatgtgggggaggagtgcgcgtcagctggtcgggctagcgagagttaagccatggccgatcgaagcaagcaaacagccactttgatatgtaatgtaagcactgtacagtattttaccatgaatcaaatgattagaaaaaaattaataattacttaaattttttaaataagatgaacaattaaacatgttaaaaagaatcaacgcgcgttaaattttagagacggagagagtattatattatcattattgtatgtccacatgttcttttttaggggatatgtccacatgttatgaagcgatactgtcacaccctaaaaattcaaaatatataaattgttgtttaattggaatttttagaaataattttaaaagcctagaagagaagatctaattttttaattaataaattccaatataaaatggggccagataaaatttcattaaatactttgcttaatcctttaattcctagatttttctgggatttatttgagctaaggaagtatttttaataaatggaattgcatttaaggaataatttaaattgaaaaaggttttaaaagtcttcttttggctttgggccgaaagtcggcccaaaacccttctctctctcctcggcccagttcggcccagtccgcagccgccgcgcccacgcgtccgcccgctgacaggtggggcccacctgtcagggtcgtcgtctacctccggccgccgccgcccgaaaccctagtttcgcgccgccgccgttcctttccaaattcggtcgatcctttccttctccggccgaattgatagaggggaaacaatctccgggatcttctctaccttttctcttttggaatcatcggctaattctttttggaaatcgttggattcgagttcgaatcggattcgtctctttcctccgaaccctaaaccttccttctcgtcgccagccgccgtgggccttcgccgtcgcctccgagcccctttaaaaggttccccgagctctcctctacccgtcgccaccctcgccttcgcctctcgtcgtcggaaacgctctagcatcatgggacctagcgccgccgtcgctccagccgtgcgccgccgccgttccagtcgtcgccgtcgctcgggaaggtcgtcatcgtggtcgccgtcgcgtctccgtcctcgtccgccccttcgccgtcgccgaagatcgccggagcaccgtcgccgccgtcaacccgaagagcgtcgccgcttcttcctcgtcgtcgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcaccgctgacgccatcatcgccctctcccgtgaaccggtcgtggaccgttcgatctcggccatccgttttggatcaagtcgatctcggccgtccgttcgcgtgaaccgtcgccgtgcgcccggtccaccgaaaccctagcccgctgacgcaataaatccctttttccttttcaaaaataatttattattgcgtcataattcaattaaaatcaatttaagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcaccggagaagagtttgaagagttccaaggccagcaaggcaagtcacacagatcccaaacaaccctttgagcatgttgatcccatttaaagctatggtttctattcaactattgcatttattttcgaatgtcattgggtggaattaacctattgtttgttatagcccttttgttcttgattactttattccttgataccttgggttattataattggactagttgagctttatatatattggttcaactagatattaggtatgattgcttagccatgcttagaaacattagcacactttcgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgcattgtttataagggggtgattatgattcaggaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattaactcctggtttggaatggtacattcctggtttggagatagaactgtgcagccgggatggttgttcagaatggttgggcctatacaacaaggtatgttgtatagcgttggattaatattgtttaatacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaataaggctgatggtgtggaggattaggtgtaaccttggtcaagctgcctgtggagtggagccgtctgcgccgtttatcttatttttccgctgcttagatctttattgtttgagaggaactatctacctctgtaatgacattttattcgcttattaattaaagtaataattgtactctattatcaatttgttattgtgtgcctcggctgattcctagacgagggttcacacacatgtaagcgtttggaattttggatagaaattccgggcgtgacagatacggcgaccgcttggctggtgctctcgcaaaaccaatcacaaggacaacaagagtcgtcagagaccgacggccgtagcatacgccacgtggccaccggcaggcgacggcgtctcacctggaccacggacacgtgtcagtggcgttgtacacctgtgagctgccgctgccgccgtcagcagaaacaaacacaaaaggaaatggagaggccgtccggaggagcgacgagcggcggcgcgtgggcacaccggccaccgccccacgtactactactactttcagcactccatgtgtttaagtactccctctgccccgtaatattgattttgattttttcttatgttgtttgaccattcgtcttaatcaagaaactttgaaattattatttattttatttatatcttactttattatccaaagtactttaagcataattttttattttttatatttgcacaaattttttgaataagaagagtggtcaaacagtgtaaaaaaagtcaaaatcacttatattatgggatggagggagtatgtgtttacctaaagtagtactctattcatattatttactaggaacaaaaaaatgccgtcgactttttattaacatttgatcaatcgtcttattcaaaatttatgtgtaaatataaaagtatttatgtcatgctttaaaaacatttgaagataaatcaagtcataataaaataaatgataaaataagacgaatggtcaagcgttgtaaagttaacggcgttatatattaaaatacgaagagagtactgcatcagtatcatactagaagaagtaataccagtactaaacagctttgatattttcgctagtagcccgcatatatcctcagttaatttgttgctttagttaaattgtgttaagagtgaattgcaccttgatctgagtatctttttttttgttatcgtagttttactttagatcacctcttaattcatggtttttactttaaaactagggaatgttacattttctagaatagatggtccaaaatgaagctctggaataaaatatagcccaatgtataattcattaataagaatagtagtataaaaatctccatgtaaaattattttcagttgattagtactcaacaaggtatattgtgtcacgtagaccataagatattgtcttgtagggatgtaagtggacaatctcactacccatataaagcctcacttgccaattactttctcaaaactttaaaagaaaaaaaattaactagaacaggtaaaagggaaaaaaaatcccgcttgtccgcttcccttggcatctggatggtcacgtggcaggaaagaacttgtacagtagtagtacgtgctagggtttgaagtaggagcgcgtgtcaatcaccaaaaaaaaaaaacaaaaaaaggcacagcagcgagtggaaaggagtcgatgggattttatgcccaaaaccgcgagagatccaccgctgtttgatgggttcgttgggacttgggaaggaatccatcggcgaatcgccgcgcggctccgatccggggcgcaagcgcaaggccaccggcccacgtactccactactcctactccgtagagaggcgacgcgtttgcgcgggcggcgccgcggccgcccaacccaaccgtcgctgcctccgtctccgtagtccgtactgcctgtgtctgcctctgctactgctgctgcctgagagcaggtaccatagcatagcaggctacaaaccagctacaaacatattttaaaaaaataaataaggagagagaatggtagcaggctacagatttatagccagctgtagcacggacttcaagacacagtgtgtatgacagatgggaccatatattaatagtgtaatatgtaactattatatgaatgagctattatattggctatagatgaatggtagttattagttggctatactattgaacttgccagagaccaaccagctactccctcacgtgcggctggattaaataaacattaatcaattaattaattatagagacaatcagttgccacttgccaattaaggaagaaggcataagtactgtagcactgcagccgcacactccacgtctccattgggaggaaatggaaaatagtttttcttttttttaaaaaaaaatagaaaatagtgctccttccgttttatattataaatcgtttgatatttttcttagtcaaaatttattaggtttgatcaaatatatagaaaaaaagaaacatgtacaacatcaaatttcattaaatttaacattgtatatattttaatataatgtttattttatattaaaaaacattactatattttgcttaaagtttgacttaaaaaaatctctactattataaaattgaagatgtttttgccggtattctagtacatcatctgtgtatgagtcggtttttaagtttgtttgcttttgaaaatatatatccgtatttgagttggtttgtaagatcgttcacttttgtatgatacaaaaggaatcatataagaaatctgtttaaaataactcacatgctaaattgagacgatcggattccaaactttagctcatgattttctaaaaatatatatatccaagtgaactcccacagtgaattttatcttaactaaactatataattaaaatagatttcacccgttgcaacgcacgatattttttctagtactccctccgtttcataatgtaagacttcaaacattggttatattcatatatgtgttaatgaatctagacacacatatatatctagattcattaacatctatatgaatatggacaatactagaaagacttacattataaaacagaggaagtaactcataaatacggaacgaaggggtagaaatatccgcatctcatacacacacagaagtggtcagccgccgcccaaaagcttgcctttgtcgccatctccacgtggccacccccatatactattgcttaacgctgtcacctcaccctctcgcggtttgagttttccacttccacggttccaccccgacacctagcgaagtactcgtagtaatccgaatcccaccgttccatccgtcgcggacgccacgctctcggctctcagctcacgtgacgtcaaccccgccaaaacgcgttattgccgtagtactacgcctcttcttccacctccatctccccctccgacatctccagccaattccagctcagctctcgccgccctcccctctcccgccacgtgcgcgccgcccctcctccaaatctccttttcttttccttttctataaataaatcaaaattcacacaccaaatcctatataaacttcttcctctccatccccttcccgctcaaactcaaacaccaacaccttcttcctcttcttcttcttccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttttgagctcaaccagctttgctcctcctatacagctaaatactgtaggagaaattaatggagattttttccttctttattttttttatattttttccaagataaaatggctgagctggtagggagttctagaaggaggaaataaagattacgagatttgtaatactactacgagggacagcatgcaaaaaagaagtataattgctatgctctctctctctctctctctcttttgtgtggagtggaataaaatgccagctctgcttatggtcagattttcacttttttttggagtgttaagacaaatgaaagctccagataaattagtgagtgctactgcttatctgaataaatgagatcattcatcatcctataaaagaataattaagaaaatgggtgtaccatatatgctattggcagacaaaatttagcagtacttgtaagtactagaatttggtttcactttattttaagtgagattgagcacttgtttatcatgctatcatcggtctacaattagttagaaactgtagttcgcagctcagttattactggatcaaaacttcgtcctttttttttattttttgagataagggtgtttttactcggcctcatatatgcaacctttttaaattagcaaattagcctatcaatcagaaaacttatttcttaaataacccaatctaaaattcgcttctatatatatttaaattcaggacgttgggaaggtcacttcgtccttttttttaagcttcggatcagttcgcactagctggagaagcagagatagttgcaccagattgatggtggttcgatgcctacgcctacgagaataagtactatatactgtatatgatattttcctcgtactagtatcatacgagtactttgcaaaaacacctcgtatctatacgtccgtgcttatatatatggctgtatatatacgtccgtgcatacgatcgagtactcggcaatggcacgtgctgagtactaatgtaaccctaatagtaaagggcacatgttgccgagagcttaagatactcattacggggagccgtgcgagtgattacatcatgtgacgacggatgattgcacggtctaattaattatcaattatagtaggtaatccatcgattagattagtggtcacacacgcacacacacaccggccctaatcgatcgctgaattaagacgcgtttccgcgggcggcgcagcggacgacgacgacaagatgtcacgaagcaggaagcaactctgcacgattgacaccagaattgttgtttaggtggtaatcctaattgtaatagattagacagtagagtaaaggttaaggtcttaggggggtcggcgctggcgctagctagttaggaggagtaggattctgtgaatcttgtgcacgtcgctggacggctggatacggatatggtccagccagccagctagcgctcatgttgagtcaccgtcacggccaaatggcagcgaccatgtcaactttgccacgtcactccggagaatactcttaacagtggtattttcaatccgtctcaaacaacccagtattagcactatgaatttaaacaaggcatacaagggacaaatgatgtgtctgtaagggcagtcccaaccctccacctaggatgatgtctatgacattaactacattgacatgtgggacttttagcttatgtggcactatattaattaagagagagagtgaagagaggaagaaactgggtctcatgcaagacacagcttcaacacgagaacctatgtaccagacactatcaagttttttgtattggaagagaatattgtcttcataatagatgaagaattaatatggttggtagagaagagagatgatgtatttattaatggcccactttaagaaaccataggttgtagagtgtagtttctattgtgatgtcttattgacataacaccatagataccgcttatggacactatgggttgggactgccctaataggttagtatattttaaaacagagattattatagtttagaatagagttagtagcgaaattttagtcttcagcagcatagttattaagagaaaaggacttacgctgtgtttggaggtgggtgctgggaacccattcccatacacggaaaacggagcggcccattaacgcgtgattattaaccattagcctttttttaaaaaatagatcaatatgattttttaagtaacttttgtatataaactttttgcaaaaaaaaaacgcaccgtttagcagtttgaaaagcgtgcacgcggaaaacgagaggggagtgttgagaacttgctcttgcaaacacacccttagttgttttggcaaaaaaacgttggcgtatacagacacacatttgaagtattaaatgtaaactaataacaaaacaaattacagattccgcatgtaaactacgagacgaatctactaaacctaattaatccgtcattagcaaatgtttaatgtagcaccacattattaaatcatggcgtaattaggctcaaaagatttgtctcgcaatttacatgcaaactgtgcaattgtttttttcgtccatatttaatgctccatgcatgtgtccaaacatttgatgtgaccgaaaagttgaaagtttgaagggaactaaacacaaccttagtactccctccgttttttaatatatgacgccgttgactttttctcacatatttgaccattcatcttattcaaaaaaatttatgtaattataatttattttgttatgagttgttttatcacttatagtactttaagtgtgatttatatcttatacatttgcataaaatttttaaataagacgaatggtcaaacatgtgaaaaaaagtcaacggcgtcatctattgaaaaacggaggtagtagtattttatagtgaggttcacctctgaaagtctatgctttgtacttcaatgtacagccatacattctgaattagttcatcagaagacatgaagcattttattagtagtagcaattttctgtttcttaattgaattagcttctgaaaaccaagaaataatggctacagtaacacacgccttttcttttcagtaaaatcactgaaaagggttacgctactactacagaagaaaacagctgaattggtagcataactattggctatggctaacggctgtaatttagagagcatgaaagggaaatgcgcacccgatgagatccttcattccttgctttctttagttctcttcttttgacgacagctccagaagatgttctgcctccctcaagaacaactttgtcagctgcttttggcctctgcggtacactatgcacgtcctaatatttacttttgacttggtctcgttgctctcgtcacttctgtgaaaaagacaatgagagtaatggtgaaacacaaaaacaagaggtgtacagatggaaatgtcaagcatgatagtgctaatatgcagaaaaaagtatccattaagcaacgtcaaaaggccctacgtccctacctcgttgcgtcttctgaatcactgagatcgaatttctcaagtagttggctgtcagatgcttcagttccagtgccctcttcaagttcagtcattcttgcaaaagagaagggcttgatcaataaattattgacaacgccatagaaaaaatacaggtacactgacatcgaatttctcaagttgtgggtgtgttacttgactctaagaagatccacaagcaaactcagtgctccattatcaccactgacctcccatatagcactccggagctcatcatctctatcttcattagatccaatctacacgaacagattcaaaggatttctacaatcaatttaccatgaaataaatatgctcatacagaataatgctgaaaactagggaaaataaataatatgtgaatattaaggtcatatcagaaaatgtgaaactagatagcctaaatgcttcttgagaagctttcttaatccttttagatgagtaaaacaaccttttttatatcaccaagaaattatgattgatgatgctgccaaaattagtaccatgtgtgataaaattttggactcatggataatattttagtttgaaagcaaatgcgctaattttcataaatactgtttgccagcttacagtacaagtacaggaggatactggttaataagacaactctatggtctgttgagaagtggttaatatcttattaaccagtatccccaggcattagtcccctttatgaaaaagatattaaccacttctcaacagattagatggttacgaacaatgtcatgtaaaatttggggtactaaaatgtcccaaaggaaaaaggaaaaaaaaaaaggacagggcaaggcaatgtcacatatgcaactgatgcctttgaacacatggtacagagtgtgaaaaacactaacctctccaagcaatgaagcggtatgctcaagctcatgttcttgcagagcaattgtacgcagggtacttataaattcctgagagaaaacaattttctcgatatatgatggaaccttgcgttgaccactccagctataactagaaaaaggacttgtattatttttgttctccttgttttcaccagaacagctaccaaaaaatccattttcaagcaaactacgaggtaaaagacatcgcaattcggcattctgtaaacacagaagatatggaaagtgagacccgtgatgtccaaggatacttgttgggcctaaatttttcacaacattcttcatatcgtaaataaaaactagagctaagaaatgttgctacctgtatctccagtagcttcatcttaatatcagcagattgaacctgtcgaagagcttctactggataatgaatctgcatttggaacgtttgttagctctagtttttatttcaaacaagtagctactttcttaaggaagtacgccaaacggaggaaatatcaagtataagccatcttatcactatgaacatgtggagcacttcaaacaatcagcaactttgataatgaaaaagggtgggtacatacgatttcataatttgaactaaaagaaaggagatattctcagtgaataatggttttcttatcttttaaaatgttaactaaaagtttggtcctttatgtatcccagaacaccgatagagttacacttacaatatttagctggagaacaattaagtaatggctacctacaatgtttcaagacagacaagtgctttgccactataatgtttgacagaaagagaatatctggcagggaatatgctaaacaaagaaaactgagttgacaaacacctgttgctaaaagtaatctcttactgagtgttaccatgagataatcgtcaggattgttgtcaattacaaatccatagaggtatagtagttcctgcaagtaaacaaaactatgtcatttcatcagcaactatatttcagtaatcataaacggtatgaatatttgatgacatttaatcattttgtagtttctcggaacaaaagactgcagcgctgcagcttcttttcgttgactattgagtctcaaagtcatctatcagttagaagccccaaagtaagattattttatacttcagaacattagcaagtgtgtttaatgcaaatccataaggaactaaaggatatgtgaatccatgaagaaatcaaatcaaaccaggcccagtgatgaaacaaagggggccatagagctccaagaagttcatcaccgtcatatgtccttcctcttcttttcttttttttttaaaaaaaaagaatggccagggtgacggcactaatgaagctttcctggattgtttgtctgaagtgcaaccaatatctaaatgcacaaatcaaaagaatcttcttgtgggtagttctattttggctatatatcaataatgcccgtatcagtatatagagaaatcgtgacagagaagtcagaatgagtatacacgaaaatatgaaacagtgacatcaatccaagtcacacaataacaagtacgataaaactaagagcaacaacttgagaaaaataacacacttgcttataaactagtcagactagatctgcacatatgtaactatgtgagtaatacctcatttcctttgttgccataatttatgcagatctctgtttcagccttcacaaagcttttatcagctagagggagatacaaaaataaacagtcataaattggaactataatcttatatcaaaatatttgattaaaggaaagatcatgaggttctcttatcaaaaggaaactggagctacttatgtacctagtacaaggtacattgaagaaggacatccagtaacatgtcccatggaatcaacttcccatgttgccagcgcctttacatctgaaaaatatgatatacctatgtaagactgaaaataacatgttttttcaatgagtatttattttcagtacaacaattttttttatgtaaatccttgcaaattcgcctacagttttttttttgtcaaaagttgaatatagaatgatctgccaactagatatttcgtctatactacataattcataaacttttattagaactcttactatgattacaaaagtcgattccagggacaaggccctcaacccaaattgactctgtattacttgatttaggattatcattgccactgatattcttagctgtaatggcagtcccagttccctggaaacaaacagttagcatgttaaaatttggaacaagaagatatgggtgaacaaattaattgaagtattgagatgttaaaaacaaatacaatttggcataattataaacaatgatttgtcagataagttggatctatattcacgagattggcaaagtatatgatgagtcctcaaaagtatatggcgtttccttgaggacaaattgtagcatgtcacaagtatattttgtttaagataattgtagattactgctgtaattaacaaaaccacaacttataatataaaagtcatttccctgtttccgtgttataatatccagttatgcaactagtttgttcaacagaaacatattcttgcccccattcagtttctttttttttttttgtggcacataccttgagaccactatatgccttcagtaacagaatttctctgttggtatgaaaaattttcagggccaagaaaggtcctatgcgatgttcctctctcttgacaacaaaattccattcaaggtcctatgctactctttcatgacaagaaaaagtcatgtaaccaatgtttaacctctttttcacttttcagataggttgtacatgagcaaaaaagaaacctaaatgaccacatataatcgaggggaaaaaattaagccacacacaataagtaaataaaacaattgagaagaacctctgaagctaggatctgcggtcagaaaaaatgcaattaacctgaggggcactgagactagaatcaccacaatcatcaccaatgttggcccgcttttcgtctagtgattccggaaaaacataaaaacgaggcaatggtatattcaatgctcgagtccagaatattgagtttgccctgccatagagtcgtgctgctgagttacataaaacaaagaaagcagggaactgaaccagcaactatgtgaaggaccctgcatcatatgtgtatattgcatttttcatttgttgacataaaactgttgttccaagatatttattgaaggagctgcaaatcaaagccatcacccaattaagtacaattttcttatgaatgagctaatttccaccttgatggcttgaaaattgtaatagtagcaaaggttagttgatgctaggtacaaaaacatccccaccattttgtaaactaatgcctaatttgtccaaaaaaaaattagcacactgaatcttttgcacacgaaattaacatgatatgccatgtcaatactatgaaactacagtatcagtaaggcttatattattccccccaaaaaaatgtaagccttataatatgacattatcactgcaaatgcaaagcataattatacataccaaaggaagtcttcgaaccgcacttcaattgagctgcaaacaatattttgatagtattactgttaaataaaacgaatttctttgtcagtaaacatatgatagggagtcatgagaattagccatattggtatatcattgccatactagacagtaaaaatcacaaactcggtaggtgggcatacagatgtataacagaacaatatttgagtgatattgcttgtggattcatgggttttaagtacgcacagaatcaataaacaaaaatcatgctggatacactctacttagcactagaagccttcacaagaaaatattcatttaatagggttggctgaaaagaatattcagatcaaaatatttcaaaggtacacaaagcccagtatacagtgcattaaaatgatttctaacgtatttataagttaaacctatgccatgtcaacaaaattcataaatgttctgtaaaataaaagtagcaatttatctcatagtgcagcattgccatcttggtgattctcatttctataaaattaaataaaaacataggcgctatcccagatgacaacaaatggtgcactcatacacatgaagatatggaacatgcgttaccccaaatcactttatatgagaagctattcttcatatcatactttggggtgcaatccccatgtatcgcagaaccccagtacagaagtgtatactaaaatgtaaaagaaactatgcatgtgtgcttgatacagaaatatagtgataaagttgcagcagcgctggaaaatgatgcgaaatcagtacaaaccttcctgattcatcgacgtttaagagctccccaaccagacctttaaccttattatcgaataaggtttgcaatgacttcctctgaaacaaaattgcagcatgttcgtttaaacgaatttgctcttggctccccaaaatatccccaaggaactgaaagaaaaggtttgcactactgatgaacctgcatcacggttgcccggtgaagtgtggtcccttccaactcagcaagctcatcttcggtgaaccaaatggagcttccgaaggtgcttggaagcatatccaaatacctagagaaattaccaaaattcaatcactgatcaagttgtttaacatggagagatgtggattgcgaccatacggcttccagagggagctagggcggagtcgctcgaccatgaggaagagcatgacgaggaggcggtcgtcgacgccaccttcctcgaagagcgcgcggcaccgcggcccgacgagcgggtcctgcagcacccgcatcggagtgatggcgagatcgagcggcaccaccatcaccacctctgcaacgagacacagccaacgcgcgagtcagcgcggaggacgagctcctaaaacctccgagagaagaggtggaatagcaaatgttaccgtcggtggcgccggcctcggcggcggtggagaagacgccgtagccctcgcggccgcagcggcggatcgtgcagccgcggaggtcggcgccgttggcctgcggagaggagccaggggtttagggatttggcgtgcacgcgagtagaaggggatgtgcaggagggacgaggagcaacctggagccattggaggaaggagtctagcttggcgtcgccgggtactgctgctgcggcggcggcggcagccatggtgttcgacgggcggcgccggcgcgggcgaagtggaagaagcggtggagcggcatcgaggaagacgacgacttggctgggccgtgggctgggtcagcgaccaggcccaaaggcccataggatcacaaatttgtagatactggaagactggaagaggggacttgatcataaattggtaatcacttgatccaaatatatcatctcttgagccatattttttctttgctttatagtagcaaatacgtcatctctatccaataatcactatattattcgatcatcttttcataatgaggtatttgaaatgtttcttgagctaattacatgggggtcaacttcggtttaagtttgtctgcaagcattcaagagagagcatggcaccaagctgatgttgatggatggtattagtgataagtagtgacaagtgcacaaaggagaccaaaaataaggaacacattcaacaaacagaaagcaagcacactactcggtaatctactatagcattatatatcatcaggtccacgttacattctaccactcacactctcatctcatctcatcactcatctcactcttatctttcagcttgcatcgcaggtgcaaggaggaaggcaagagactagcgaagcactctcacagccacaggacacatggtgaattgcacagataaacaaaatgctagcacaccagcgaagcccggagcgagtgcgtcgtcgacaggttggtgcaggacgcccaccgtatcaccgactcggcgaccgccacatccaggtgctcgcgctcgccggcgccgatggtgtggttcctcctgctgttcatgccgatggcgcgcgacgggttcgcccttacggcggccctcaggacctccgctgtcctcggagccgaggacgagacgagggccaccaccgtcgcgtcgcagtgagctttctcgcccaaggcgtcaccatcaggcgacgactcaggctcgccgggttcttggccgcagaagaaggagaagctcggcatggaagcgaccggggacgggaacacggcgttgcagggttcgcagacgccaccgaaggagaaccccgagagcgcgcacgacggagcattctcagcgacaaatgcagagaacgatgatctgcaggcgaatgtgggggagcacgcttcttcagacatgctttggcaggcgaccgggccaccggtgttgaagctcacatcgcggctgcatgacgccagcggcgtcgagaacgaacatgagccggcgtcctctcctctgagattgatctcatggcaatgtccacaagaatcttgggattggtcggcatgatcttgtatccaggaatgctctgtgtaacaacagttgtttagattactccacatggcaagcattacaaaaaaatggggaaaggaatcattagcagctgatctgtacagtaaggtccgggaatgatgcaatgacaaccaaacaaaagattccacgaaggatgacagaatgaaccagcacaactaaaggaatggctacaatagacaaaaggtgatgaagtgccaagaaattttaaagttcatctgtaccacagtggatctaccagaacatgaccctacaacaaactgtgatgcaacccagctttttcccccagccgtgcaagtttaaattagaccaccaacttaagctggcactaactcagtacttagcagccaagttttgttaatttattcaatatgtaaagtaaacaaggctaacctcatcaggaaaattttgatcaatttcgatttacaattccagttacatgcatgtattaatagtcagtgagcattttccatcttaaaaaaaaaaaggcagttccaagttctcaatatgatgctagtgatgtagaacaaggacaggaaattgaaagtgtgtggtttctgaaaagattgaggccgtgtctcacctaggacctgcttggctgtgagcctctgtcgaggatcgcgccgcagcatctcggttattagctccttcgctgaatcggaaaccttgtcccagggatcagaaggaaaccgcagctcagtcgacctgatacattcgaaaatctttgatttggttttcccccaaaatggggggatgccactcaggaggatgtaaagtatcacacccgcgctccatacatcggcagcctcattgtacccaccggcgagcacctcgggcgcaatgtaaaatggactacccaccatgccactcaagctccgacctgacaaaaccgaaacccaattcagcttcgaaacaccagccttgacagagagcagccacgaaattgctcaagaattcccaattataccaggctggatgtaggttgcgaggccgaaatcggcgagcttgatcggcgaagaaggcgatttgctgacaaggaggatgttctcgggcttgaggtcccggtgcacgatccccttgctatggcaatgcgccacgacctccatgaggtagcggaagagcgcggcggcctcgtgctcggagaagcagccgcgctcctcgaggcggtggaagagctccccgccggcgcagagctccatgaccaggtgcacggacgcctcgtcctcgtacacggccttgaggtcaacgacgttggggtggcccgagaggcgcgccatgacctcgatctcgagcttgacccccctcacgtcgtcgggggacacgaggcggtccttggcgatggacttgcaggcgagcgcctcgccggtgaccatgtcggagcacgaccggatcacgccgaactggccccacccgagctggggccccagcgcgtagcgatcctcgaggcacgacacgtgcgccgcctccagtatggcgccgcgtagccccgccgccttgtacgagttgtacttggcgtcgccgccgccgccagcggcggccatcgcccggaggtcccacacgctggaatcagacgagattctccgctgaaatctctcaccgactccccccccccccccccccacctcagtgcatcatccttgcttcttcggccactgaatctgggcacgaacacaaaccgagcagagaaaatccaaagctttttagcgctctcgaaaccccaaaatcgcgggcttttccatacaaatccccaccgagatcattccccggaaaaaaaaacaaaacgaataaaaccgcgtggattcaggagatggggggagcgccgcgaaattcaaaattcccaccagggagagaacccgcagaccacgcggccgccgcaccggaggaggaacccctcctcctcctcctcctcctccggtgagagagcgctccccacgagcaagtctccccgcgactcgagcccgcgcagatcgagcacccacccacccttgctgctcgacgcagaagccaaaaccaaaaccgcccgacaaaacgtccgacagcacgtagcggaggggggagagtcgacttacccgcgcgcgctggctgctccggcggccgagcggagtcgccggcggcgaggtcagcctccggcagcgcgaggcatccgggtggggcgagagagagagagagaggggtgagggtattcgttggtggggggagggggaagcctttgctttttgataggtggtaggagaaagaaatgagcatccaataacaaggccattaattaattaattaaatcattgttcatcttaaccctaggttttattttaaattgctctaggtttggctttggagtttaccttagagacttgttgctcttgtttgcttttgttactaactggagcagtagcagggtttcccaacggttaccgcggtaaccgtgaaaaaccgtacaaaaccatgcaaaatttatcaaaattttaatttattttttaaatttatttgaatttaaggaggttaccgcagtatttatattaccgtaccctcgcggtaagcccggtaaccgcgcggttaccggcggtaagtcgaaccctgagcagtagtactctactcatccctccgcataaaaattgtagactacgaatctggacataataatcttaggatggagtaagacgatttattaggataagattttgataaacaattgttctactaatatgttggttgtttatatagtaacaaattacgatcataagcaaatacttttaaatgtagatataataacatcaattttatgttggttggttaaatgattgttctaacagagtgaatagtatttgttgttgactctagaagaaaaaaatgattttcgccagactggttagttaggaagaggtatgaacgatgatgtatgagactttgaattgttctaatgtgtttggttggtttgaattaggtgcagcagttgtggtaaggtcttgtctttttttcgaagtacaaattatgcgtttcgggatttgttttttttttttttgggggggggggggtacagaccgttagacaccaatacagatgcagtctgtacttcgagtattttttttccctgcgaccgtattagcacataggagtagtataaggtactagtatgtcaatgcatgtaaagttgttaaagactgaagaaaatgagatgtgcaatttgacccggtagtttgagatacactcaagtgtagtgacactctttctacaactcacgcaaaaacataggtgaaccttcacaaatcagtaaggatatgcaagcagctagcgcatcctggtacaaatcactcaaagttattcattctataaaaaaaataatcttatgtttataaaaaattccttctgttttttccaatgtcgacccaattatatgtcgcaaaaggagtcccaaaaaactgcaaatgcaaagtaggacagaagcaaaagaaaaaccagaaagaaagtaaacacaaaaagggcccaatctcctaaaaatttgttgtttagttaatgtggtgatcatgccgatgtgtgatggttgccctctttgctggattggtttaaggagcactacaagttgtgcctctagtggggctacaaataattgttcttaagcaatgccatttgcatgcctttatttttttttttgcttattattttttgtccttgttctttctgttttgcaagtgattgatcaggggaaagaaagatctaatgcaatgttgtgtggttggctggcctaccagagtgggaaagcgacaggagggcgaaagagagatgcactgcatttaatttgcttccttctggtttcaacgggttcgtttgcttgcgtccatttcggaggtggaaaaatgaattagcacattccctagtcagaccagctagccgtagccaaaaattaaaatttgaaacttaaatttgagttgattcttaaaagttgctaagtacacatatcttaaagatttacgcataaattatttttgttgctaatcatgcttaaccaattaagattttttttaacggtcagacccgttgctgatattttatataaagaagaaggtgccccattttaagaggtaagtgggactaacctagtgctcagttaattagagaaagtgagcaaaaaccacaactgcaacaccacaccaatatatagctaacttaagctaccgcgacaaaacccaacacaaggcaattaagatcaaggatagagtaacctaacaaggataatgttgaagtgcatctacatatgcgtgagtatatacgacagttcaaaggaagaaccatgaaaagttgaatttgatgaatgtgtcgtttatggatgggatatgagccgttagccaaattaactccacaacatggctactaatacaagcaagaagagaacatatatggaacaaacaaatgatagcgacaacactaggtcttattcatgaaagaaacggcatatatagcatactcaaaaaggagaggaatcatgcaaagtttcaacgtagcactagtgttttcaagccggagaacaattctggtggtgggctgcaggatgatggtgtctctaagatcctggacgttggtgagtgttggtcggggtccaaagtggagcaacaccatcattatctcctaaaccgttttttgattaagaaattaaagatagagaggctcaatgcaatgcaaggaatctggaccctggaattatatggccagtgtggttgcaatttgcattgcattttgcactaggtgaaccactagccgaagcttcccacacgagctggtagctagctttgcccaaaaggttagcccggattctttgttgctccaaatcaaggaggctttccgtgtgcacggaaaaaaaaaaaagctagtaatgggtacgcgtgtgtgtgagagagagttattgtttatgcccgtttgttaaagctactccatcggataatgtgtgtatctttcttcgtgctctcatggatggattcgtatcctctggcttgacgtagcaatgtcactacgtgacattatttctatctaaaccatccgtttgaaatcaacggataatatatttgagcggtaacatgtgttttgttgataacattccgttaaagccgtatcgatttggcgtattcaatgggattatgctctttttagaaacttgttgcataaaaaaaaactcataactcaacttagggcttcttcggaatacgggaattttataggattttcagagaaaacagtttaattcctccaaaatttctatgaaaatcctacaaaccgaatagatccttagtattgaagtgtgaaaaaaaagagaatttcaccacaaaatttaccacacattgtttcatcaatggaaaatgaaatataccgtttgggatacctaggacgacattcatgctaacttatcatatgctttactttgcaaatactatgtcgatctcgtgcaggatatatttcagcaggtaacatgttttcttttttaatacactttgttggtgtgtggatcgagcgtatttgataagggcattgtttagttttccccatattctcaactttccatcacatcatatcacaacaaaaactttcctacacacataaaattccaactttttttccaaactcctaactttcttcaaacttccaacttttttcagaaactaaacacacccaagattattctccttctataaattctctgtccaaaacctcatgacactagtttgtcctaggtttaactttggcaaatgatatgtgaatgcaatgctctaactaaagagtttgtaccttgtactctaaacaaaccatttctcgtttggtagagtagacgacaacagctcagaggtatccgtacaatcatcagctccgctagccacgaaaccacaccgtacgttgaccactcatctgtcgccacctggcgcttagctggtctagctgtctgtgaacacgcagtgggccccacctgtcagatcctcggagtaagtgtgtaatgaatgatcttcgctggaatgtcaacggtggggagtaagtagatgatcacggtcggttgtggctgccacgtgatgtgattagatggagctgagatgctgatgtgtgtgattagtgggtaggattagtttgttcatcactttttgaaaaaaaaaaaacacaccgtaagttgtggaatggatccgttggccttggcctttgggccgttgacctactgcatctgactttcctatcactcattttttttattttttttcacatgtttacttttgtttttggaaggttttatactcccgttctaaacaaatcaatctatccagatttgctgtattaagttttatcccattaccatcatgattgatttattttgaaggacaattttactatcattgagaatgtgtcaggaagtatcatactttctaatgtaaaatttgatgcatccaggtactacagctactatgtactttgaggtaaaaaaaatataaaatataggtatctcgagataatttttaaaggattatacaatttctctattttgaaacagagggagtacgtgccttgtgcttagtaggtcatgcttatgtcatcaacatgcatgcatacagctcggcccaggcggcaaggcctatctggagttgagatgtgaagcccaaagtcatatcaccccttctttgctgtttgaaattaggcctgcttatcatgggctgaaattcttcggccacttcatttttcttcactttgcaggcccaacgattggaagcttctaactagagattttggcccgtttgtgaaacgagaaccaccgtcacatcttacgaaaacgctaatccgcgacaagtcgcgcggagcggcggacggcgcgtgtacggtactcttttttttttgtttttttctgttttcttccagcgcgtgtacggtttcttggttttcgttttttctgttttcttccgtatttttggtttctttttctttgttttcgttttttgttttcttccgtatttttggtttcttttggtttctttttcttttttatcgttttcagtttttttcggtttttataaagtttatatacgtgtatataaagtttgtatacgtgtacataaagtttatatgcatgtatataaactttatatacgtgtatttttttatttttatatgtacgtatacaaagtttgtatacacatatataaagtttatacacaggtatacaaagtttgtatacgtgtacataaagtttgtatatgtgtatacgaatatacgtgatgttttttttagtttttttgatttttttaatatgtacgtatacaaagtttgtacacgttatataaagtctgtatatatcatatataaagtttatacacgttgtatacaaagtttgtacacatcatatataaagtttgtatgtgtgtatttttttatacataaaaaatatacatataaaattatatatttttttatagtagtatactagtagtagtactagtaatagtagtataagtagtagttatagtactatagtagtagactactagctaatatagtagtactgtagtactagtggtggtggtcgcgcgccgggggg

SEQ ID NO: 72291 - DNA, 4660 bp, Oryza sativa
ctgttttttaaaaaaatcatgtgacttgaaaatcctgtgtttggattttgttgctaggtctgtttggatgcttggtggtgcgctgcaaccaatacaaacaatgtcgcaatttataggtagtcgcagcctcacctgccaaaatgattttttgagttagaactgcttattagagtgaggcattttttttcatgttttagaatttacataaaaagtactaaactgtggtactttagtttaatctacaaactattttctctagaactcacagcttagagccgtgccaaaaaagggcgtaattttggattagttaatactgctcccttcgtttctttttttttttagagttacatagtacaacgcagacactcacagcgcacgtgcacttatctctatgaacgtacgcacacaaactctacccatataagcatcgtcgaagactgctcccttcgtttcttaataactagcactaggtaatattcgctttagaaatttgatcacttgttttatttgttgataagtggatagccctttgaaggtgaggtttttgcttgtgttgtaaaggctttggcctgttttggattaggttggtggacacttttcctttcgtgttctcttcttttaatgaaatgatacacaatgaaatctattaacatttatctaacaatgtaaaaataattaatgagaaagtcaaaattatcaattattaacaaacggagggattattattttgtgttttcctccaaaaacctgaaaatttgagtgtcaaatttcggcctgttaaccttcaaacaaaatttcggcctgctaagtatttgtggggcttcgaagtgccagctcattaagctgcccattgacatgaccttttcgtgcgacaagtcaacgtggaaaaatccggcctgttaatctgcgggccgttttaacttacggcccgttatacgtacggcctattatgtttcggccctaagatttgggcttattaatcatgcggcccatgtaggcccatttaacaggccagaattccggcccattagtctttagataggtgggatttgatgatctctcgcagtctcatcatcagcctgtattcctttgtttcttttgggctataatcatttgattttctttttgaactcaaatcgtttcaaataattgcataaaatcacgcagattattcgccgatgcgaatcagaatcgtcccacgctcactttaattaaagtcacactaaaaaaatactccctctatttcacaatataagttattttagtatttcccatattcatattgatgttaatgaatctagatagatatagatgttaatgaatctagatagatatagatgttaatgaatctaagacatatatatctatctagattcattaacatcaatatgaatgtgggaaatgttagaatgacttatattgtgaaacggaaagagtactaaacaagaacaaagattccaatttgcatctgaagttgtatatactttattaatcggcgtcatggagaaagagatttgcgattaggacctgacgaaacggaagccgccagccgatcgcttttgttgacttcaaacccgggggaaaatcgctggccggcaaacgatcgacgacgtgcgcgtccggatccaaacacgcgtaaacaattatggatgatgatacggtacgacgacgacggtggtggcagaagaaattcggcgaaatttgcttgatttccctagttaatctactcatcaattgggatgaattggaccacatggtttgatgaatctaatgtgtgtgctctggtcagtaggttcgagactttgggttgactgataaagtgctaatgcagccatgatgcgagatgatggaatattttactatcttcatcacaaaatatataaaagattttctacaatagtaaaaaaatacttggatcgtcttctatttaagagtttggtaggataacattagcattggttatttttcagttacgttagatagggtggtatgactaaaagttcatattaaaaaatagtctactttaaaattagatatttaaaagttcaaaaacaatacaaattctcagattaagtcgattccaagcggaattttaatacaaattctcatatgaatgttgttgtgttagtatacgtatccgtgatgtatttgaacaaataccaagttaggcatctagaataaattattatgttttactaaatacaaatatgtagtacatattgtggacactcgagtttgctaaccgtgtttaacacgtaaggttaaacaatatcatcgtcgaaaatagagaaaaatgagaacaaaacaaaataaaatagcgaaagaatactgagatatttacccccagtatagagaagaacaaatttatattaaaattatgaaattttaatgattcattaatctcaagatatatcagctcaatcttccgaaggtactcgtagacatggatgtacgtgtgtacgaagcgtacacacgttaaaataacttatattgtgggagtgagtttgcaggtgccatgagcttctacgttttaattgcattccccgtaaaagatagtagtaccaatgtttcataatcagcatccttcctagcgtagttgtgaaaaaaaaagggaaaacaaaaaggagatcgttgtgcggtgcctcgacgagacgacgatatttccccttcccctcgtcgtcgcctccgactccgactccgactcctcgtgagctcgccccgccgcctgcgccgccgatcccgcgaggcgcgccgccgccgttcgtcctgctgcttccgccgcatcccggtgagcatccattcatcctcttcctcatcgctgtgtacccactcactttttttttccctccaattttgcgttgaaccctttggttgttcctcttctagacctcggaggaagcttttctcttaatttgccttgaaaacttgacacgaatagtagtttgcttgttccccaaattttgcgttgaacccttgttgtttctcttctagacctcggaggaagcttttctcttaatttgccttgaaacttgatacgaatagtagtttggttgttccccaaatagtttgggggttcagtttattagatccgcccctgttttagcataattttgatggtatactttactatatgcgtatttaggcgctaatcagttttttgttttgattctagataccgtgggagcactgaagaaaactgagaaatggatgtttttcagcgattctactgtttcgtaaagcaaccctactgttagtgttggttgtttgaagatgattgaggggtcaaggtttcagaatatgttgggcggtgctggaattggaggtggtataggttgcagaggaaggcaagaaaacgagatgaatggcttccacaatatgccctactaccacaaggtcggggagagctcccacatgtccgtggataacgccgacaacctgaacatgatgaactttgttggtggttcggttgccatgtcggtggataacagcagcgtgggatcaaacgagtcccgcacggtcatgctcaaacaccctggcctccgtgatatgccggcgccgagttattcggttcacaatagcgtcatccatccgaaccgggctatggcgcctactctgaatgaggatgcattggctcgggtattgatggatccaagccatccgacggagatacttagtaattacgaggagtggaccattgatctgggtaagctcgacatgggagctccttttgctcaaggggcatttgggaagctttatcggggaacatacaatggagaagacgttgctattaagctgctggaaaagcctgagaatgacccagagagagctcaattgatggaacagcagtttgtgcaggaagttatgatgttgtctacgttgaggcacccaaatattgtaaggttcattggggcgtgccggaaatcaattgtttggtgtatcattactgaatatgcaaaaggtggatctgttcggcaattccttgcacgaaggcagaacaagtctgtgcctctggggctggctgtgaagcaggcacttgatgttgctcgggggatggcttatgtgcatgccttgcgatttatccatagggatctaaaatcagataaccttctaatttcagcagacaaatccatcaagatagctgactttggagttgctcgaattgaggtacaaactgagggaatgaccccagagacaggaacctaccgttggatggcaccgtaagtcataatcacgcattcacgctcattgcctactgtttacctttttaaatctctgtcaaatatgcttatcttgccatcatgcagggagatgatccagcacaggccttatgatcataaagtagatgtttacagctttgggattgtcttgtgggagcttataaccggcatgctccccttcacaaacatgacagccgttcaggctgcatttgctgtcgtaaacaggggctctcgtcctgcaatcccgcaggattgtgtggattctctgagcaagatcatgacttgctgttgggacgcaaaccctgaagttgcccatcatttgccgagatcgttgtcatgcttgagaatgccgagatagaggttatgagaaatgtccgcagggcacgtttccgctgttgtattgcggggccaatgaccacagactgaaactaatgcaggataga

SEQ ID NO: 72292 - DNA, 7074 bp, Oryza sativa
ctctccactgcgccgccactctcgtgccgccgcgccgccgctctcgtgccgccgcgccgccgctctcgtgccgtcgcgccgccgttcccgtgtgctgccacgccgccgttcccgtgccgccgcggcgccgttcccgtgccgccgtgccgccgctcccgcgccgccgtgcgccaccgtcgctgccgccgtcgtcaccgctgctgccgccggtgagccgccctccttccccctcgtgtccaccgccgccgccgctctggtgggagagagccaagagagagagggagaggaaaagagaggccggcagagagaaaaagagagaaagagagaaaagaaagaaaaagagagagagagaaaagaaagaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctacaagaaatcaattcgcggtagtagtttaactgtaattaggaactaaacgattagatgaattcttatagactattatagattattttgggtaatctctataagtaatcgattcacggtagaaattcggatttatttactagggattttagccgtatattatatttaatcatttagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcgttcgacttccatttggatttatttggattttttatttgaattctaatcgaatccaaatcagttttcgcacgtaactatagagcccgagggagttgcggatccaagtgaaggccaagacccccaagaccttgagcaaggcaagtcatcactattccttgaacatgttgatcccaattgcgaaattattttgtttataaataaaattgcatgcaatgatgaacatcctacttgtgattatgccatgccttgattattgtttatcccttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggtatgtggagacatgagcgccacattgccatgaaattgataacatgatttgtgaaaggaaaataaagcgaaaacaactgttttcgactggggcggacggatgatttgggtggtatctggaaaaggctagtaccgtccccagtcaattaaggaccgagccatgaagttaagcatgaaacgacccccgtacaactgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtatgtgagagagagaacttaacttgaaccataatttaatatgtgtgtgagacttctctttcctgggagcgccagaactcctctcactactagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacctgtgtgggatgggatattgcatgatgattttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttgaaataccccttttcatatgcattgttgttgtggtggcttgctgagtacggttggtactcacccttgcaaatataaaattaatcagaagcaggagataaagctttggaggatccctatgcctactaccaggagggagatgaagacgatggcgctcagtaggtcttagtacggtcgttgcctgtggcaatggcatgccgctgcgcctgaattccgctgccttatctatttctgcattttggatgtattccgaactgctcggtccgatgatttaagacaatgcctgcgggcttatgatgtaataattagcactagactctcgtgtatgtgcttttggtatttcagctatgaactcgtgtgtaccagactacttgatccagggaaatggtactgtttacacgaatgattcctgttataaaaacgggggtccagaagatatgattagttaatgtgacttacattttgttttagcatctgaataagctaaacgatgtactgattctttatacttatagtttcatgtcacggtgtgatcgattcaacaatttgttccacaaaatttttaaaaaaacaactgtaaacaatatttatgacaagctaaaagggagaaatgggctacattgatttggacatatatatgtactaaaattttgagaaatcaaatacacacaatcgtcttaatgaaagctaaccaaatataacatttttccatacatccactataaacagcatatatttgaaatcgtgttcacatatagctccacaacaatgttttggaaggacacatgtatgccttattttgccactggcttattacaacaaaataaccacaagaaattaattgtttgcttgctcacgcatagcatgatctctttcaagacaaaattatttagaggttaataattatcatgcaacccaatgcaagaatactcatgtctattaattagacgttgataccactcttgtattcagagccggccgtaaagctttcggggatgacgtcgtcgacgacacggtagccgccgttcttgacaaggaagcgaacggagaaggggcccttgagcgccgcctcactcttgagcgaccaggtgttagtcgatgactccttgagtgccacccagtccttgccgcccttctccttgatctccacctcagagatggcgacgttggtgacgagctctagactttttccgctagaaccctcaccgaccttgaaggtgacctcagtggcgcacgagccgacgaccaacaatgccgccactgccacagagagccggaaggaggacaacgaggccattggcgagctagctagtttgttggtgttatctttcttgtttcttgaagggtagagggatggatcgaggtgtttggtgatccatgttgtagttgggtgcgtatttatggtggcagggggcaaagaaaaccaggcatggacgcatgatgcagcatagagatcgttggccggctttttcgtcgagcaagtctaatacaattcctataaatagatgcaaacttggtagttccgattgtttcgctggtgcaggacatgcagacctctcaaaaagtagttatgcatttccatgttttctgtactttttttttaaattacaaataataaaaatttgtgatgttccgtttatggaggatatggaccaagacatgaaaatattaggggcgaagatgctagtggaaaacagaggggtggtagagctaacggtcgggagtgatggccaggcacacaaagggccaccgtgtagcatccatagtagatgttgcagaggggccatcagcagctagatgttgatggaaccgtggcagtgacggatgggctcatgtgttggcccgttgcgggtctgctcgataggggacataggttagcatttatggtgagatggggctggtgctaagtaaattggtagagcacacctagtcagctagctggatatcgagcggtggtggcagttgatacaatacatttgataggaatacaagatgacaactcgatgaggcgtatgtggggaggagcacgtgaccttatgaaaataatccaacaattctaggtctgggtgtagattgtacattaaaaaggagtacactataaattcagttgaattttttattggcaagtgcacatgtcgttacatcctgcaggttgagagctagacgtgaaaggaggtccatggccaagcaccggggaatgatggttgattgattttgatcggtggtgggggtcgggggcattccattcatgcagtggaagggacatcatgcgtgcaggactcgctcgagagggcatgggagtgaggatgggcttacgatggacgagggatcataaaccaccactacattttttaggccttaaggatttattagttctttacatacatagtttggaactaatgatatattttctagttccttttaacacgttggtagtgtaaagattttttttctatttaaagtttggaaccaattgtgtatttactttagatactttgcaatagattgatattctcgtagtactatataaactttagatggatcgatgtgttttgtgatccatgttgcagctgggtgtgtatttatggtggttgggggtgggtgggggggtaagaaaaccatgcatggatgcacggtgctgcatggatatcgttggccggctttttcgttcggagctcttgtacaattgctataaatagatgcaagatggtgattatattgttattttatattgttaggtgccaaattccgctggttgataagtaaaaacctcgggaaagagggtgatgatgcaccgagagtagtattgatctagagattcattacaatggcctcgggtgtacatatttacacccatggatagatactagtccttgtaggacaagaaagaaacttttctaaagttaaaacggaaacataaagtccttattggacactaaacacactttcctaaagataaaagaaaactaacaaactattcctaattaatagataacttgccatgttgtatccttcttgaactcggtcacttcggataagcttcctttaattcgattaatttccttaaccgaatatagcaggaatccgactattggcgatgtgataattttgattggccgattataggattctgaagccaattctgactctagtccgatgatgtcttcggggcttatcaaatttcgctgctaacagatgtggcaatattaccaaattcctaaaattttggcattgccaaaatttgttaaggtttatttcgaaaattgcgtgcatgcatcaggcacccgcacctcccacgcttgcgcgccgcctccaccaagtgcaccatcacagacgttgttgcaacaaatcaactgcatattacggaaacgctatagtaaaggaatccgtttcattttttgttccaccaaaaatgtttcagctagtgtactcgtgatgtttcactatgtacggatcaaatgttgcagtgaattgaaatagtattttgctatttgttgaaatattgtttttatatagagtgaaacaacgtctgattttttggaaaccgtttgtatcatacgttgtagcaaaatgttccacgaggtgatttggttgtatttcagctttttaaaagactaaaacattttcgaactacttagtgaaacattctcgatctacttggtgaaacaacgctcgatttttgaaaaaaaaaaggtttattttgaatacaatctgaacatgcctttagtcaatggctcactgctaaataacaactatacccctattttttcccctctaaatttctactaccgctaactaggatgacagtagaaagcaacatgaacccttcgatcaaatgagatcaacggttcagattattttctacaactaaatagcaccaaagtgaggctcgcttttttattggacagattactagaggcgtctgttggttggtgtatggaactgtacgggtagagctcgtcgtggactgtccgggtggatgacattgtaaacgcgtgacctgtgtacaccgaactacgcgtactggagtgtgtgtggaggaccatgtttagcctgccatggacgatgcaagtcaacaatttcacacaaatacggagtatatagtacacagtgctagccagctagagagtggactagtccactgttttgttcctgctcatcggttttgtggtcggttggcaacttgtcgtgcttgctggtacagtacgtaattagtttaccggcgactttaggaggctattcatgtcaacgccggctgcagcctgcaaatgccagtaccgtgtaattctcgtgtagttccaacgtcgtgtttgtcaaaacgtagcactggatagcagacatgccccaactgccatagtacttcagagagaatccaaatggttcaaccatacgggctcctttttcttattatatatgccttgttcggttcggttatacgatttaaatgatttttttttctataggaatcatgtgctagatcttcaaaatgtattggttccataggaataaaaacatctactccatcttctttgttcagctcactaaaagaaaaaaaatatgtcttgatccttagtattgcatatacattcctacgcaattccactgttttttaaaaaaatcatgtgacttgaaaatcctgtgtttggattttgttgctaggtctgtttggatgcttggtggtgcgctgcaaccaatacaaacaatgtcgcaatttataggtagtcgcagcctcacctgccaaaatgattttttgagt

SEQ ID NO: 72293 - DNA, 9928 bp, Oryza sativa
  unsure (1)..(9928): unsure at all n locations
gatcctgccatgatatatgacttctacaatgatcagcacagctacctttctagtgtgggtgtggatggtgtgaaggtagatgtgcaaaatgtgatggagactcttgggaagggttttggtggtcgtgttgcattaactcagaagtatcaacaagcacttgaggaatctatcgctcggaacttcaaaggaaacaacctaatttgctgcatgagtcacaatacagacagcatttttaggtacatattcttgtcgctgaacaatatgtgtgacatacatgaaatttgacgtaaatcttggttctttgtagttcattgaagagcgcagttgctagagcatcagaagatttcatgcctcgggagccaacgatgcaaaccctgcacattgctactgtggcattcaatagccttttattgggagaaattttcatacctgactgggatatgtttcatgtgagattatggcatccccagtacctctttctttcttttttttcatgccaggctggcagctaattttccattcttgccaatgtaaagagtaagcatgaatcagcagaatttcatggagctgcgagggctctgagtggtggtggtgtttatgtcaggtaattcttgcagtatatttatgcagatgttgtatttgcatttaagaaatttgcatgatctcattatggattttatattactgaactgatatgcagcgacaaaccagggatgcatgatttcagtgttcttaaaaaacttgttctgccagatggcttgattctaagaacaaagcatgctggtcgtccaactcgcgattgcctgttcaatgaccctgtcatggatggcaaaaggtacacacacacacacacacacaccaatttttctaaaaagtttcctgctacttgttctaaaaataatactaactcagttaacttttgtgcagtctgttgaaaatatggaacttgaacaagttttctggagtcatcggagtgtttaactgtcagggtgctggaaattggacttatccagtgaaagaaaatgctcatgttcccactaccgtctgcatcactggtgatctctccccatcagatgtggagttacttgaggagatagctggggatgattggaacggagagactgcagtatttgcttttaattcatgtaaattccattggacacatatttcttgcaactgttacccatctccttcatcgatctttttcacgattattaactgcagctacgccttcaggttctctctcaaggcttcagaagcatcagactatggaggtttccttgtctactatgacatgtaagatatataccatagcgctgataaaggtcagatttttctccattcacctacttacttgagcaatcaattttttatcgcgaatatgcaagccttttgtatctttgtattaagaactcaatctattcttgagcaatcaatttttttttttgggtgaatacttgagcaatgaatcattcgatatatgtttacttcttagagaaatgctcttgtttttgcaccaggtttttggtggctttgttcagtttgctcctcttggactggttaacatgtacaactcaggtggtgcgctcgaaaacgtcacgagcacaggtgattgttcagagatcacaattcagatccaatgccgagggccaggtcggtttggggcgtattcagcaaccaggccggaaatttgcagtgttgatgagcatgaagtagagttcaaacacacagatgatggcttcctggcctttgatctctctcacggttcgtcccaggacaacctcaggaacattgagattctgtacagagcttcctgaacctccattttcagtgtgatttttatgctctttcgagcagattatgctgctctcaggctcttagctgtggataattattgcttnccgcaagcgtgtgttagctctgaattactgcatctcgcgtgtgttgtttgtgccaattaatttgggcttgttctaagtttcgaatctgccggagacagttataatacgaatatgtattttggcagatcaattccaattttgtgccaatattacctaaaacaaaaatattatccctctcgcggtaaacctgtacgtaactttataagagacgggaaggaattgcatggatgaatcatgaattgaattgttacatcacaagaacaccgctcttgttcaagggcagtgtcttctccttcctgcgccagatggcgtcatggcgattgcaatttgcaagatcattctacaacaacaatggatacgtggattactccaccatgtatatggtgagcttgtgctcacgcgcacgtgcaagatggatttggctaatcatcagagggacctaatcttccatgacctgagctttggcggcagctgcgcgagcatggtgttcgtcgccgccacgctcctcgtgctggtcaccagcttgaaccactggctctccgggtcgcagctgttgtccgcgctcaggcaccggcacgggttggtcaccaagctccggccatcgtcgccgacgtccaggcagagcatgccgccgttgctggtctcgggggacgacgacgacgacgaggcgttgacggcgaggtgcagcttggagtccgaggtgaggctccaccgcgccagctcgtcgccgcacgacaggccgaggcgcgccggccggccggcgccctcggcgcggaggcacagcagcgggctgtcccgcggcgacagcctctgctggctcgccgtgtacgcccacgcctccgcctcgccgcaggaccccagctccagcgtcgtctgcaccaccgacgacgaccgccgcaccacgcaccgccccgtcgtcgggtggaacatcaccgtgtacggcgccgcctccgccagaccaggccctgcacacgccaaaccaaagtcatcgccggagaagatagataccggcggcggcggcggcgaacctacctctgaaggggcgctgcagggcgtggagcctggtcagggcggtgtcgttgcggggcttgcaccacgcccagtcgagcacgccgtagacctcgtcgaggcccaggacgccctcccggaggtagtaactcccctgcagcgtccagagcgcccagtcgaggtcgaggtcggcggcgacggcggcgacgcagccgtagtaccggttgtcgttgacgttgccgccgcggttgtcgacgccgaactcgctgaggaacaccggccacccttggtcgagcaggtacagcgcgcggcgcgacacgctcgccgccacccgcgcgcacacctggttggcgttccccgcccgccacgcctgcccgtcggagaagccgtaccagtgcacctcgaacgccaccttcccggcgaagctgacgttcacctgccgcgagttgaggaacgccaggtcgttgtcgaagctcatgccggacaggatcaccaccacgcgcgggttcgccgcgtgcaccgcctccgccccgcgctgcatgtacctgcatgcacgcacgccatttttttcccgcgcagtcgtcagctatcagctcagccgctacatcgttggcgccattttttatttttattttttgcagatggcgctagtacacagtacactgaaatgaatgatgcgaactgcaactgcatcagattattgccattactgttcttcacatgcttgtgcagggacgagcaatggcggacgcggtcagtcagctcagctgccaaccaccactagcttcaggttcatttactgatcgatccaggacatggccgacgatgaacaatgcgtggttcttggatgcagatgctaatcatggcggtcggtgtgcaaattgatgaggaggatcgatcgagcaaatgggtggtgaactggtgtgacttacttgtaccagtcggcggagttctggcgggggccccggagctcgttgcggaggctcatggcgacgacgctggggacggcggcgaacatggtggccatcttggtgaggccgtcgacccacacgtccgggtcgaagtacgcgtcgccgaagaagccgttgccgtcgttgttgccgcagcaccaccccggcttgctcacgtggttgtccagtatcaccatcacgccgttctcccccaggctactcaccaccgcctgcacgccacgccacgccacgccacgccgcgccgcgccgcgcgtcgtcggtcaatctctctctctctctcgcattgtcaaaaataagtagtagataacaatgatcttgccttgaaggcgtcgatgagcttgaggtcgacgagggaggggttgttgacgcggatggcggcgagggactcggtgaggttgaggcgctggaaggactgggcgacggtgagggaggagtaggaggcgttggtcaccatgaacgtggcccaggtgaggcggacgcagttgaaacccatggcgaccacgtccttggcgatggcgcccacaggctgcttgcccagcccttccgccagcatcggctccaggtgcgacggccagttcacgcacgccagcttcaccctgttcccgccctcgtcgacgatccacctcgacgccgtcgacagcgtcgtcgctgccgccgccgccgcggggcgcccatggctggccagaccaagaaccgccaccgcggcgagccacaccaccacgagcctcatgtcgacgccggccgtccggcaatgcgagacaccgagaagaagcagcggcgaggtggatttatagcgagtactacggcggcggggttgcttcggcatggggaatggcgaggcttcacgggattgccatgggcggaagacgacgatctctcctaagctatgctgctggtccttgacatgtgtgaagtggagaggccatgaatgagggtgagtgagcaaatcgcattgctgatgtttcaagaatgcaaccaaatactgttttatccttcaaggcaggacaagctaagcgacatcactgtacgtctgtgacaatgcagtgcatagcgcgtttatttgcacattattatcgtgaactatcaatttaattataaagataaattaaatatttaaagaaataaacttaatgaataatataaaataaatagcctaggcaacattgcttatagtaaagaaaataaatatttttgaaatatggagtaaataatccgttttaataagaagcggatgatagcttattatgggcaatgtatggcgtacttatgaattaaagaagcaatgctgataaagaaatttttcgaagacgtacttttggaatcgtggtactaataatccggttgataatccgactgatgagccaaaccaacctggcctatttcagaaatcagaaccagagaaaacaaagaatctctgcacgtcggtcggtgggtggttggagtaaaaatggccaccaaacccttgcagttacagcttcggtttggacttcttatagtgatactggagtattgatgttggttacttgcatcgattattagtagtacctcatttgcaattaataccagatctaatcgtggttggttagtataattttttcgtgaagcaatcaatattcagtagtgtagcattggtgcacacacaactgggatttatttgcatcctgtttatgaggagctcgtccaaagcctcacgccgttgtcaacaattcagctacaaagacaggttaagaggttttgcttttactctaagaatgttgctagttgtattccagatcatgcatgtaaactgcttgcgattccgtatctgtctcacatcagatcagttaagaaatgccgtgctgaatatgaactaggatgaatgaggattttgcccttcaactaaaaggaaaggagaaaggcgacattgaaatgaacaaagagggaaagaagttgagtgtactgaaaatatagggaaaggcctttctctggcgccacgattgctgtttgcatatttcagattcagaatacaattttattttctcgaacacgtaggagagttgtgtaccaatgtattaagaagggaagtgcagatttcctagctgcattattcagtaaattgctgaggaactgaaataatattgatctcagactgatgctcctgttgtagttttttgcttcatccctcgaatcaaagcagtgacttatgaggttgttgagccagtacctgtgaagtcttcagaagaaaaaaaagtatccaactatgcacaagttgagatgtgcatgagaaatttcaataagtggacaacccatgcacgcgacctcaataactggacaccatccctttgagtgaactttgcaatgttttaagccatgtcaacatataccaaccgtaaaatactaacactttttattctatatagtatatcagagaacaagcatggtatttttctgtacattccttttattctctctagtttttgtacacataggacatgtttcaacagaactctatagaacaaggcacaagtgaattcaatggcatcactatatacatgtggagttctgtgtattattttacaaattacaataatatagtcatccaattgccttgattaactaggtggaacttggcccttactctgtcatattcatccaccacacgcaatcaggatattttcgaaatagtgccatggttaactagatgatgttggagaccagggaccatcagatggcaactgcaaaatggaggtgcctgtgtgtctactgcttaatataattttgaaccactggctctcaggattgcaatttggatctccggttaggcacttgcacggatttgttgtgatgataccatcaggagtggcatccaggcatactctggttccatttttagtgagttcagtcgaaacatgcattcctgaatttgatattagctgccactttgaactggatttgctgcaatcggtcccaagctgtgcattctcaccgacagacttgacctggaggcattgaccagtgtgttgcagtaccaactcgtgtgttgatgtgtagttccaagcgtttgattcatcacatggacccaactcaagtgcctctgatgatttcaccacgacacaaagcccggatagaggatggaatattacgttgtaaggttcttggctgttcggtagtccagggcctggagtgtaaataagtttgcactattatctaactcaaggaaatatagtgcatattgcaatgattaaaatttaccagatttttacatggcacattacttattttgtctaatgtcttacataccatattttgtttaaatgtcttacatcggcactatccatatatcgaagtgttctcttaagagggtacatgtcatattgtcatttcatgaaagggctaaaacaatgcatgcatactggtggataatctgaaatttatatcagtgcaaaataaatttcagccaacaattaagtactgagaaggggcccaatcctatgacgaaacatgcagaagtttatgtgttgattcactaaaagaggtcaaatgctttttttttattagaacagtccagtataaagtatataatcttaccacataaaattcgaaatgtagaacattccaaaaatctatgttcccatattcctgataatgttgctagacaagaataaaactgagataggcgaagcacaaaccttgaaatggtgattgcagagaattgatccttttaataaaactgggatttctagctgtacaccaatcccatgatagcaatccatatgattcatcataagctagagtgccctctctgatatagtaactcccttgcagagcccaaatagcccagtccagatccatttcagctgccacacttaagaagcaagtgagatagcggttgtccccggtgtgtgtgccagacatatcaaacccaaactcggagaaaaacaatggccagccttgctgaagtaggaaaagtcctttattctttatgaaaccaacaaccatcccacaaacatcattttggttctgagattcccagttgccaccatctgagaaaccataccaatgctgctcaaagactaactttccagtaaatgataggtgaatttgatttgggaccacgaagttgagagtgttgtcgaattccaggcccgacaagataacaaggacgtcaggatttgctgtatgcacagattcagcaccctccttcatgtacctaaatgagaatagattgtaaatgaaattttccaataccatgggtcacacaaaaaaatccctatcaattgagataaaaacaaggcctttaggtttcagtgacaacctgtaccacaaactaacattttcataggggccccggagttcgttcctcaagctcatgcccacaacattttttgttttcctaaacattgttgccattgtcttgaggccattcaaccattcttctgggtcaaagtacttgtcaccaaagaagccattaccatcagttgtgctgcagcaccatcctggagtggtcatttggttatcaagtatgaccataatattgttcctggccaaagctgacactacttcctacagttgttcaatgttaaccatgtcagatggaataaaaaaccagagtttttatcatgtattaaaactgtttactttagtttcctttcatatttagtacatataaactctctatatactcgtgactctatgagcatctgttttcacagattactgggtcaactaactggataactcattgcaaaaagagagataactatagatacttgatttggattagataaaaagtagtacacctaatgcaaccagttgccgtctatcttaatcattagaatagatccgtagaaagaaagatctgttctagctagagtattgtggcttgcaagataccctcttggaccattaatttggtaactagtaggtaatctgtacacgttcaaattaaacttgtttggaagaaaataaaaggggaaaatgaaatctattcaagcaacaactactgttggcctttcctgaaatagaaaatatgatcagatctttcttatacacttaagccctcaacatgaaattgattgttcttattaattatgcaaaaatggatatcctaaagtttctttgggaagctttatgacaaggttgagatgatatcatctgatttcaaaatccatcatctccaaagttttgacttctaagcaactagtttttttgttaaataaaaccgcatggcctgcagttggtttagctataagtcaattggttcaatgcatactgttgcttgccacaatgtaagtctacaatcttatgcatcattgcatcgtaatgactatttcgtcagacaatataaaatttgcatggactccgacttaaatgtttaaacggacacatagctttcatcaagattgtaaatcagtctgttcatctcacacaaagttactcctacttacttttcttgcattccatcatcaaaagactagtttctagcggcaagacagtaaaaaattgaccatctttgacttgctaacagtagaaacagctagctgccaatttaatggtggtggtaagaaaaactaaggaactatttcttcagactatcattaataagatttggttaacattgccaaaatctaacgaggttagatttaaaaatgccaaaatctaagaagggtagaacactggccggatagctccaaaatctttttgccaaaccaatgcttggatattgttttggctactcgaagagaaacccttacctggaacacatcgatgaggggcaggtcaaggagtccggggttgttgacccggacgccggcgacggactcccgcatgccaaagcgctccagcgaccaccgcagcggcaggctcgccagcgtggcgttggtggcgaggtagggtcggccaggtgagcctgacgcagttgaaccccatcggcgccacgcgcgccgcgatgtcccccacgccgcggggcgacaggccctccgccgncacgggctccaggtgcgacgcccagttcgcgcacgccagctttacgcgccgcccgtncgtgcccaccacccaccgngacgccgt

SEQ ID NO: 72294 - DNA, 3797 bp, Oryza sativa
catattaaattattatactaatttttttaaaaataatttgcgatgactttttaagtgacatgtttatcctcttaatgaatagagttttcccaatgtcagcaatggcgggcatactttctcaggggactgaaggtactggacgctgaccgtgcagaggacggcgtcgaggctggaggtctggagctcgagccgctgctccttgttgaggtccttgacgaagaagtagtcgaggcgtgggttcttggcgagctcctgggcgttgaggccgtggccgacgacgcggcggagcgggagctcgcgctccggcggcaggtggctgacccaggagctcatgaggtccagcacgtcccacccggggcggaggcgctcgcggtagaggtcggcgagcgccgcgaggaagccgtcgtccacgtgcttgacgagccgcgggaacgcgtagaagtcgcggtccggccgcgcgtccagcttcgcccggccctccggcgtcagcaccagccgccggatgccgccggccgacggcggcggcgacgcgcctgcggcaggggagcaccgcggcggaggcggccgtcgcgaggcccgcggcgcctgaggcggagcgcggagcatggctgcgatttgctgccgtcgccctggagaacggaggctcactggctcgtcgctggacgtggcgctttatctcgtcggggagttcgagtggttggcgtcgcagtgtgcactgtgtagtgaccgtggcacagtccagtgcagatcaaaactccctcttttcaggccatcgttttatgtggcttcaaatatcatcctcattcctcaataaacaggttaaactttaaaataatttaaactgaaattcaaattttagcccgtgtgctatttttagcccgcgaggcgtcatgtcgccatatctgagggaaaaatgatagtcttgccctcataaatgatgacgtggcatttcgctggctaaaaattgacacgagagaaaaaaaatcgtctctttctagtaaaaaaacgaagtcatccaagaggggatagtggtatttgagaatggaaaagtttattagtattaaattttcttttcctaaagttttactaagactagactatgtatcatgctgtgagtatacgtagatatctatgatttttatcttcttaaattaaacgcatgatattattgtttatgagagttttgtaaaaatagaaagaagttactccctccgtcccatattatagcaatctagtatcggatgagacacttcatagtatagtgaatttggacatgctccctgtccatattagttgtgctataaagatgtgacattttcgccgtgtttagttttaaagtttttcttcaaactttcaatttttccatcacatcaaaacttttctacacacataaactttcaacttttccatcacatcgttcatatttcaaccaaacttctaattttagtgagaactaaacatatcctttataatacaactaatctggacaggaagtatgtccaaattcattgtactatgaaatgtctcgttcgattttatattgctatattatgatacggaaggactaagtacatttagcagtgctcttcgagaaggaagggggccaaatagtccataaaaaccccgatttcgtagctgtcgccctcgtcccccccgcgtagtcgcgcacgcgagccgagcgtcgccgtctctctcgcgtcgcggcgagcgcccccatccacacgcgggggtcccgatcatggcagcggaagtactaccggatatcttagtctatcccagctcgaagctgacatggcgatgacggggacggcgccctggaggtcgccgcttcgggcccctcctcctactccctcgcgcgggaataattcgcgcccccgcggcctcgtcccggcgcaatgccggccgtggccgcgtcccagcctcagttccgccgccgtcgcgtgcccgcggagcgaggagatggcgcggctggagcgcgggtcgctggtggtcggcgggcgggagctcctggagcgggcccctcccagcgtggccctccgccgccccgcggtcgtcgcctccccggggggcgccgcgttccttggcgccacggcgcccgccccgtccagccgccacgtgttctccctcggcaccctcgccaggtagagcccccgcccccagagcagagattgcggtgtgcgccgcggccggcagcggtggtactgattcgttgttgggttttggtgtgcagtgggtggaagtggctgtccctgttcaggttcaagatctggtggatgatcccgacggtgggcgaggacgccgccggcgtgccagcggagacgcagatgctgctcttggagtcgaggagcgaggcgggtgccgcgctgtacgcgctcatgctgccggttcttgacggcggcttccgagccagcctccaggggagtcctgagaatgagctccaattttgcttcgagagcggtaggtttattctggatttgctggattctgaggtgttcgaattgaaacgaactgcaaattttggaatttcggttggaatttctgaagagtacagtggtggactgtttttaggtgatcctgaggttcagacactggaagcagttgatgctgtattcatcaactcaggggacaaccctttcaagcttatgaaggaatcaatcaagtaatgtcatcctctaacataaccacaatgacacatatttttgttctatttgcaactggctcacttcagttgtatctccatttaggatgttatctaagatcaaaggaactttcagtcatatagaggacaaagaggtatagtgtagctaaggatgttcatctttgtacttctatcttctacttagaataagactgttaatcatgtaaaccttttctagtcatttatagttctatgttattttgtttttcacaagtcctgttgaaattcatcacaaatgccagatccctgcaaacctggactggtttgggtggtgcacttgggatgctttttataaatctgtcaacccagtgggaattgaagagggccttaaaaggtacaaatgaatcgatcttacttatgtgatattcgaaaacaattgaaaggtcttttttattacccgcatcctccatttgtcaattcctgataaagcatttcttgttgtatagtttgtgtgaaggaggtgcaccaccaaggtttctaattatagacgatggctggcaagaaaccgttaacggattcaaggaagtggatgaggcctttattgaacagactgtgttagcgtctaaccatttttcaacttgctgatcggtccatgaagtatattaaattcctgtttaacaaagaaaatttactccaggaaatggacgtttgagtatttgatttcatattaaataaacaccaatacattttgaaatctctccttatctgtttgtgaaagagaatctagatccaccaacatagactgtatactttttctttattgtgagatttcctatccaatttccttttttttttcccctgaaactgtaaatcactgtcataacctcatattatatctatacacataaaagtgcactcatctgttccttacccatgttgcaatattattaggtttgcggagagacttatcgatctgacagagaacgataagtttaggggagaaacctgcaagaatcttggagaccatgtcaagaaaatcaaagagcactatggagtcaagtacttgattcttattgaaatactagttctataatatgcttttcataatatatgctgagaaaaaggctttgtatgaaactacaggtatgtctacatatgg

SEQ ID NO: 72295 - DNA, 9670 bp, Oryza sativa
tcatttgaagaatatatggtgaaaggtatcggcattggcgtccctcaagacaatgaaagaaagatgaaaaaaggcattcctaatgtataattcttttcttatttacatttgagtttaggaatgccgtactattaagagggatgcaacgtcgaggtgtttgtgcatgtctcagtgctaaaagtgacctatcatagtgctaccttgagagaaacccaagctttaacctatcctttcagtggttttagaccttgtttttggttgagttgggtagtcctctgagtgagtttttcatagagtccaagttcatcaaaaatggactcccgagcgaaaagttatagtcgttttactctgtgcttttcggaaagtccgaaaaattatcagaaattccgaaaaattttcggagttatccgaaaaattttcggacattccgaaaatggctgcgaatctgagatttgcttctgtagattttcggacttgtctgaaaatgattttccgcttccgtagatttttggacttgtccgaaaatgcttttcggaaaatccgaaaattacagtcttggcctccaacggctagtttttgagaggctctggtatataaactcctccacccctccaccacccctcctttgagtggctgttgctcttagggagtattagacacatccagagccaaatagccatccctatttccctacctttgtggtgcctctttgtgagggcgatttgagaaggggagagagttggattgagagagtgaggagttgagagctagtgagcttcactccatcctttgtggtgcctctttgtgagagggatttgagaagaggaaagagttggattgagtgatggagaagttgagagctagtgagcttcactccatactttgagcactcgagttcatagcaagcaaatcttcgattgtgtttgttactcttggggactaaggtctcctagacggctaggcatcgccggtgagcacccaaggttgtggtgtgccacggaaagtttgtgaaggcttccatttcgcctccgcaagggaagaaattaagagtgaaaccgaggagtgcatttgtgcaacctcgtgaggaaagggttgaaataggcccggcccttgtggctcctcaacggagacgtaggatccatggatccgaacttcgggaaacaaatcacgcgtctcctctcttggtttgcccatttgtgcattctctcatattgtgcttgagcttgtttttacccgatctacttgcatgcttaattgatttagttggtgaccttatatcttgtttagataccttatttgtcaccttttgattcatacacattttctttatttgaactacaagttcatagctagtgttttattccattatccgccgaacctttcggttgagatcggaacttccaatctcatatcggaagttcctatttgaaccgaaagttctcatcattctagtatgctatgaagttgtgataatttttaggaacgcctattcacccccccccctctctaggcgacattaaggtcctttcagtttctataacccatctaaggctcttcaaatgtcaaactccatagaatttatttttgggcatgatttgagcatttgattgaattttgccgcttggaaagagatacaaagcaaatttcaggtcttctcttgatagaaaatcgcttctgcaaaaattctttttgggaaagtttctttgatttacaaagatcatttctgcaagatttcaactcgcttggacttgatttggaagagttttgagtttttataactttgatcaacttgctaaaaaattcagaaatgacatggttataggctgaattgtgaattttgtatctcaaaatgcaatccaaattggaaggagcttccattatgacttttgataccctaaggctgaaccttacttttaaatttttgtttgaattttttcagctcttttgtactttgtttgaatgctttttaaagcccttcttgagttgtgaaaaatctggaatttcagcttactgaaatcttgtgatttttgttttgcctatatggttgagatatgagcaagactaccaaaatgaaacttgtgcatgattacatgatatatctccatgatttattgcatattttttggagctcatttccacaagtttatgttgcttcaagagcttgcttagttgtatcttttttgttaaacttcaaattttaaaagtgtgtttcatttagttgaaaatctgagttggtggcttaaaaaaagttgtgtcaagaagtgagctctatgttatgtgaatgttaaatcaattttgagctcgtttggatttattccttgcatgaactcctcttgctctcaaacacccattatttgagccaacctaaactcaaatggaattttcactgtcaacctacatattccatctattttgcttctaaaattgaagttgatccttgtttctattgctaactaccatttcttgattccaaattcgcacttgcatacacaagcggtgtccatataaaatggtagtatcatttgaccatcttgaactcggtaattgcctatcattgtcattcctttgtcgagattacacacttgaccaagaagctctcaagtatcattgaccgaaatcctctcattgataaaatacttgttgagtgtatttcgagaggaagttcaagtgctcacaaccactccctccgagagcaagggggagcgtttcttaaatggacattttctcaaatttttgctttgaaatttcatctaaaaattttatttggtcttgtgaatgtttgttcttgttttgctcgagcaaaattgtttctctttcggttccatgcaaattgtttctctttccattgagtcaaaaatcataaaaaacggactcccgagcgaaaagttatggtcgttttactctgtgctttccggaaattccaaaaatggctacgaatctgagattggcttctgtaaatttttggacttatccgaaaatgcatttcggaacttccgaaaatcgcagtcttggcctccaacggctagtttttgaggggctcgggtatataaactcctccatccctcctttgagtgtcttctgttcttggggagtattagacacatccaaagccaaatagccatccccatttccctacctttgtggtgcctctttgtgagagggatttgaaaaggggatagagttggattgagagattgagaagttgagagctagtgagcttcactccatactttgagcactcgagttcatagcaagcaaatcttcaattgtgtttgttactcttggggaccatggtctcctagacggctaggcatcgccggtgagcacccaaggttgtggtgtgccacggaaagtttgtgaaggtttcgatttcgcctccgcaagggaagaaatcaagagtaaaaaccaaggagtgcatttgtgcaaccttgtgaggaaatggttgaaataggcccggcccttgtgtctcctcaacggagacatatccgtgaatccgaacttcgggaaacaaataacgcgtctcctctcttggtttgcacattcttgcattatctcatattgtgcttgagattgtttttacccgatctacttcgcatgcttatttaatgtagttggtgagcttatatcttgcatagataccttatttgtcaccttttctttcatatacattttgtttgttcgagctacaagttcatagctagtgttttattccgttatccaccgaacttttcggttgagaccgaaacttcctatcccataccggaagtttcgatttgaactgaaagttctcatcattctaatatgctatgaagttgtgataatttttagaaacgcctattcaccgcccctctaggcgacatcaaggtcctttcacttacaactactgcggttgttagcacgctactatcaaaacaagattcagatagtaaagttagaaggttttagatctgcagtttggtacacatactgtgataatctggatgctagagtgtcagttggtttaattacagttcttctagaatctagagtcttatagcaagtatctgaaggagagaactctgtggctttgatcaactaacaagacaaagcaaaggggaagtatctagtgatgtatccgcagcaccgtatcggttgatatatttcaatattggactaaaaaacattgcggatagactggcactacttgaacaaggtagagtgaaaagcaagctaacttggtgtctgctccactctgttgaaaatcagatacatgaggattcgattgatacttatgaacgataagaaatgtattatttgttttatagtactattgctattgcttggattcattcttcatattgaatggtgagctggttgttagttatgtcttagctattttgccataaaaccttgccttttctttaatgactggaaacattgaatataagataaggccttcaattaattagcatgacaatgtagtagttcacacatcaatattagctataagacatctggaaaatcatgttaattggggcagacattgccatgcatgttgttgtcgaagagacaactgcttcacgtcaaaggacgtggttcactcaatggaatggttgaatagtaaagtaatgtattaatgggctttttatagtcttagtacaagctcatgcactctagggtttaatgtttgcaggggaatttacatggatacccttctgatagggacatttacgagggcaaacaatgtccatttggttaaggggtcttttcatgggcttttgggcccgacccatattggtgaacggccttctcgggccgttctgatccttaggcttcttggcgaaggcctcacatcttctggcgaacccttcctgcttcgcctgaagtgaagacttgccagtgggtcctttggacatgatggcgaaccctttcagatgcgtcctcagggtttcgccataggcaaaccatcttgatcattggtggatcatcacaggtaaaacggtttcggcagttaatccatgacttagtgaatttgatatatgtgaaataactccgctggggattgaagtcactcctaacttatgtttatgctaatgcttgcatattctgtgttaaaatttttggtgacacactagtaggaaatagtcttgagataatcaaggaggcactaaatcccaaaaatttgtttatagtgactttgtcgttttggacttagtgcatttgatatgtgtggaaatcactaccctggggattgtaatcattgctaactttgtgctggagtcatgccacgaaggccttcgaccgaggctaccaaaaccactacgaccagggcgaaggatcagtcgaagaccaagatgcttacctaaggcgaacctgctgggcaaaactagagggattcaccaccaatctggacgccttcgccatggagtcaaaaggcaataaagcctagccgttcgccatgtctggcctaggctaaggcccattaaggggcccagggcaaaatagacactagttaccctcataaatctctctatcataagggtattcatgtaaattaccctgtacttattaaccctagggtgtatgagcttgtactaaggctataaatagccccataagggcatttagtaggggatcccaaaaaattccattattaatacacactgctttacttttctactgtgtgtatacctcgttcttcgacgaacgtagttgtcatttgacaacattatgtttatgctaatgcttgtgtattctttgttggaatttttttgtgacttgtactagtaggaaatagtatgagatagtcaagctccaagatctgtttatattgacttttgacaacctggcttctctctcaaaaatgaccatttctctatattcttgaaagggatatttgttcagtgtcatgtataccaagtaatacacaatagtttagtattttgaatgacgtatttataacagtggatctatgttttctatgagacaatggagtattgtcggctgaaaatggtgctttgccctgataaggtttcttcttacatgttttatcaggtgggatggcatttggtaaaaatattttcgactagttgtagatggttttttttttactttcttgcaaatgttggaacttccgtaccctcgttcctgatctatggaaatgcggggagcatggctctcattgataaactacttagctaaatgttggttttggttggaaggatgatggtttatgaataattgtaaatgtatgttcttttgacatgatatctagattaggagttagtctatttaaaaatttgttttactgcttttttttcaaatttgtcaccaaggtagtacaaaatggtttagagttactctttgcattttaggaggtctttcggccttaggaaatcgtggctttgtcttatttggttacattgtgaatgatagttatctctaacaatgttgaaaaggtacatatacagcgttccctcttttagatctgctgagaagtagtctcataatgtgtatcaacatgcaaaacatttacaatcgttcatacccgatgaagatcaaatacttcatttgtggctttgagagataaaatttagtcgaatcagtaattcaataagaaaggcagaaaggctgcgagagtgctaacacctgcaggcagaaaggctgcgagagtgctaacacctgcattttgtgtggagaactgaaacctccaatgctatattgtttatttttctgacacctgcatttttctgatgtagagatatagggatggacaacaatccctataaggttcgaagatataaactttttttagctttttcaatggtgttgatgtagagatatagggatggataacaaccctaaaagcttcgaagagttgttctctttctcactaagaataataaggtttttctttcgttgagcattgtaactatcttttgtatcttatgtcgaccgggatatgtcgttccttttgctgctagcctctttcgcttcgttccctttgctgctagcctctttcgctttcagtaaaagccatgtctcacgacttttgtaaaaaaaaaaggctcctaccttatgaaaattttcttttgggtacaataatataagagaattcaatccactattcagttacatgaaatagctcgggtttgatatgaattttgtgttctttatgcccaacctgaaaaagctgcacatgtcttttttattgtcttttgcacaattagttggtttcacttgtagggatgctaatgcctggaatgctatttcagtgtgatttaaacattattttacaaaggttgtgggtaaaacaagcgtttgtatgctattagttgctacagttcttaaaaaaaatacattccactcctttgaccttaatcttccgcatgctttcttatttgcttcagtgaacctaacggccctcttgaaatgtgaagtctggttgtgttggcaactctgactaactagcttattaatcagcaactattcttttttaatgttcataaatatatttgttccatctccccaactattcttttctgatgtatctctctacttctgcagtgctgtcatgcttagaaattcaacaacccgaatctctgtccaggaccagccagagtacacaaacgacaaattgatacagatccatgtcttacaaaaatattaaaataaacttacaaatgcagcagaaaataaaagacaatctaaacttaatcttcacggcaaaagtgtagcatcctccaaatcacaggcaatcctcaacatccggaacaagcttaatcctcaacgaactcaccatctgaaatattctctgcttttggggttgggaaaaataatttaagactgagtacaaccaccgtactcaacaagtcataccaacggaaatgtatgatgcaaggatatcacaaaggattggcaataggatatttgcataaaagcagcatttgcaaatcataatttgaatacagtaaaacaatagatattattaagcaatattaaataacatcactgctcaacgctaaaaccacgttgcaacaggcccaaccaaaccacctgaactactccagtcatattatttaagtgagactaatcacggtgagctggttgaccgcccaataaccacgggcacgactattcgaatagttttactctgattagaggtgtacaaatttacccacaagatgcgattcgacacatgttatcatgcctcgaagtaacaccgcgatactgcaaaggtgcaaatcgtgacaaaacccttcatataaccctccctaaccaacatcccacctcaggtttcacccccacccctaaacaggcattgggcagccccctcttgtgcctaggttaatccggaagcagcatagaccggctcccgctccatccatactccatgacggccacccttgccacggtatgttagctagaaaagattatacttcaggtcaagcctggagcccatgctagcttgtggtttgtacgtgtatatcttccaaggattcccgagaaccggtccttaattgttatggacacgacttgcaaaatcatgcacccacaacccaccattaaaatatattttagtttaattacttgtatacatgttgacggtcgttagcgatcagtttcgcccatcaatattactaaaataaaggagaactagttatgtttgcaatgcatattatgttagaataagatatattccactagcactgtgctttctaaccttttgtagagaataaatacaaaatggaggagaatcaacagtgaaataaacgatcaatcaatcagacactgtcgagaatcagacttatgaatggatgggccaagaactcagaaatgacacgaccaaaatgggccaaaattcacaagtctgcgaaaagaagaacataaggaggcaaccagccaaaacctgggctggttgggccggcccctggttcggtcgaacctcgggtgcagccgaacccccctcgtcgccgtttgatccaaggctttgcctggacggtgtagattagccccaatgacggttggagggtatttccaacaattccaaccgtcgcaactgtcattgggaggttataaaaggagctctcatcctccactccaggacatactcaagcaagagctcaatcatctttctcaaagtttagtttagtgtctagagtatagtggaatagaaatagaatagagtcttcagtcctcggagacttcgggaaaagttcgggtattgctctagtagcttttccttcttttgtaagacttgtactatttttagaatattcttctaaatatatatacagtactttgcttcattctgatcatctgagtactagctttccaatatgttatttgatatataattgtctagctagcttactcgggaaatgcaatggtgtgggtataatgttcatgtatatgattgctctgtgtcatgacgatgatattagagtagtatttggtagcataagcgaggtgcttaggccgctggatatcattatttgggattatatgctacgggacagcagaggtgggccgctgatggtgacagctcagtacggttattcctccacattagcatatagtcctaagtacaatttcctgggaagggtactcctccgtatttagccccggttggatggccatgacgggttgtcgtaaggaactcggcaaccagggatggtatctcgaaacacta

SEQ ID NO: 72296 - DNA, 972 bp, Oryza sativa
agtttagggaccgttgatgaactttactcaataccacccattcaaagggtatggctatttgaatttcatccaaaagtatataatgaccataatgacctaaagttgtattttgtgggttaaactaatggagctaaagttctttgtgaatattggctaaaattagtttctgaaagttcaagtgccattaatttggttttgatggttaatgacaaatccaattacatgagactaacattgttataagcatttctttgtctactagtctcatatggatatgaaagtggaatatgtgagaggtgatttctggacttcatatgtgttgagagagaaacgttcattgatggtgtacctaaatcacaaggatgaaatgcatggagatcaagctatatgtatcattctttctatccgtgcacatattgatatattcatttataatattttcatgtgattacataagcatgtcagactaatgttttgtttgagccatatcttgtttagtctctttacattgagaacatggagatgatgaaggtatgtttttattttattgtctatatttgataaatgccttctattcttgtatgggataagctctcaatgtttaatatcttgttatgcatactcttgcttcacacaaatattttgtatgcatacatttagggggagcaaatcctatactttagttatgcatgtaatcgatccaagttattcaccttcatttaattgggatcatttattcaagttatgcatgtatatgacacttgtggtgttgattaatgctcatcatttattcatatccttttatacatgcgatcggttggtcaacatgtggaggttgacaaccggatcattgggactaataattttattgagttgaatgaaagaaataggtcccaaggattacaaaggtgttgatgctcaagtgatatcattacacctaacaataccaagaatgacaaagtgaagatattg

SEQ ID NO: 72297 - DNA, 23484 bp, Oryza sativa
catgtcacgccgtaccacagcgacacgccggtgccggcgccggcgcaggggccgggggtggtggtggcccactggctgagcggctccggcggcgcgccgtgcggcccccgcagcgccccccggaacgccagcagcgtggcggcctccggccccccggcggccgccgccgcggcgagggcgagcgccgccgcggcctgcaggaggaggaggcgcacggcggcgacgccggccatgaggcgggcgggcggcggggcggcggctaccagtggcggtggcggtggcggcgacgtgcgggaggcgtgcggcgcatgcgcgggagggtggctaaagaacgggaggcgcggagggggaggagggacggggagggagatcgcgaggtgggggagagagcagctaagaatagcgcgggaagcgtgtgtgtgtgtgtgttggtatttggcgggaggcttaggcttaggcttagacaccgagggagaagaagaggaggaaaaagctggcgtttggtgtgggagtcgccgctggagactgcaacgttttcttgttcatcacttctgttttttctttgtttcggttggcaatggcttatttggctgcttgctcgcacattgacaaagggtttgtttgggagctggatttctcagctccttacttctaatttattttctaaattctacaaccacagctttttataatccgaacagaaaaatgactatttggaaaagatgtatcagctagaagcttctccaaacaaactcaaagactatttggaaacaacgcttctccaaacaaattcaaagactatttggaaaccgttgtttctgcttatatgtaacatttatggctaaataggatgtaaatcttagtgacttaagttatacatcaacttaaatcaccacactactattgtttttccctacttgagtgatattctctttattttttaatatatgatgtcgttaacttttagagatatgtttaactaaattttgtacaaacatgacaataataagtaatgtttaaagaacttttaatggtaatcaaatcacaataaaataaatgataattatatattgtgcaaacatatataattaaaagaaatggtgcaaacatataaaaaatcaacggcattatatattaaaaatgaagatagcatttatttggatttaaaattgtctggagcgaaaaataactatttttacttagggtgaagacaatagacctccagcaaagctcaatgacgaaaaaaaatatatatgactttttattaaaaagaaagtacctttaaaaacgtgataatctcttgggttatacaataattttcataaccaaaccatgcaggctgccaagaatgttgagaaagttgtctgatttttcttttaccagccaagttgtcttcctttttttagataatggattatattaacccggcctctacaccttagaaggtgtacacaacccaaaccacaatcaagagtacataagactcaacccattacatggggataccaaatacatggggataccaaataatagtttaacaaaacggttaaagaagaacaatagtctaagcctcaattctggtgtgtttagttcacgccaaagttaaaagtttggttgaaattagaacgatgtaacgaaaaagttaaaagtttttgtgtgtaggaaagttttgatgtgatagaaaaattggaagtttgaaaaaaaaagtttggaactaaacaagggcctagtgtagttgtatgctatatgtagatcctttgcagtactgtacgtgcagtattgctaactgacatgtcagtctaagaatctgtgagacccatgtgtcagcgagcggtactgtatgtacgtatacgtacggtactgacatgtcagtctaagaatctgtgagacccatgtgtcagcgagcggtactgtatgtacgtatacgtacggtacttcagaggaccctctctctcagttcagagctgtatgatgtttactctttgtccatctagcagcacatcggcaagttgttcttttttttttctaaagcacatcggcaagtttggctctccattttcactatttttgccagtgacacatcgatctgcacacctttaatgccgaattaatcacaacattttcacttctggaagcgaaatgcgcgacaaaagctttggttaatcacaagagatgcgcccaccgacaaacgcgctgtcttaaagaatttcgtgccgccaactcgcgcccacgattcaagagaaaaatcacgagtacgtggcccatgaattatagtatatacacacatagaacatagtcacatacatcatgcaaaaaaaagttatcgcacgacaagaacaaggcctagggataattatatatgtgattagcaatagttgtagatgatgttgttgctgctgggatatgccttaagttgatatgcttttgttctctgaaaatcatctgaacttgacagctatatatgcccatttctatgtcacattcatataaaatggtggaatgtaccttgattttggtcgtgatattgttgttttgacagcaaatattggtccaggaagatgcattggtctattcgacatctgcagtagaacttccaccgattgttctaccttcggatcataaattattcgataatgtaaatatgttgaagaaaacttacagtgtgaaaacctgaaaaagcatgcacggcggcctcttctttcttcagagtttagttcagagagactttgaccgtagttgaacgaatggtgtaagcaacactctttcagtctcagataatacaaaaaattccagttgatggatacatggaaactaggaagcaggtcagatttcctacaggagagtgctgcttataggttcactgttcaaccagaatgatctaagtttcatctcgggaatccaaaaattcagattttcgattgttgaatcagtatatcttgttctgctccaacaggaatatgactgttctgtttaatcaacaatgaaacacctttgtctattgaaatcctcgtatccaacatcaacaagacagagcccatctggaggcgctgggggagcagtagctcgcctgcaagtggcttccatcaggttcagcaaagcatcttcttcagcaccagcagctgcctcccttatggcagtcgcaacaagaaccctaaccatctgttcaatgaaatttactaatattaactagaattcgggggacgactggataaattacaatgccatgaaacaacttgatgtataataccttgcgcagaaacctgtttgcgactagctcaatgcatatggccctggtggtgccttcttcacaattctgcaaaaattgggaaaacggaatggaacatggtattaccagttgaaatgatatatgtgcatgcagaatgctaattgaaaaaaaaaacagataagggagttatcgattgcatagccatgatgctaaattttatgagtccacataatatatttagttttgatatcagcaactcaaaactatataatccacaattgcatacacgtcataatgccatactcaagctatgccaatgtccagcaactaaagttaaggttacaaacgcgataccacaaaataatactgttacttttatgtagagattagcagtactagaatggaagcactgggaagtaacctgattcctgacatagtatattaccagcaaaagttacattgttattttctggtttaaaagttcaatgtattagactagcatcacctcatcagcagtgtgtagtttggccactgcagctcgagaatggaacatgaaacactctgtaggtggaccactgcaaaacaacaaaacatcaacagaagtttttttttttttggttgaacttgatggcgagcataaaaatagtgacatggtcatttacaaggaaaacaataatgttatattccaacaaagatgaacaaatatgtcaggcctaggtgattaattatcataaaacagcaagagaaccacttttgtacttgaaaaatacacaaatacacaatagttataaacttacacacttcgtgaagcttgtgtatcacgtgcaaacatcttgtaagatagtgattttccttccagttgtctaatgattttgtcaaccttacccacatcaaagctttgaggttttatgttgcactcaggaccctctactgttttagcggactgttcttcccctgagattagttttacatcctcgtcaagaggaaatatatacaggtatctcctccatttggctgcaaaattagggtgaaattcacgtgagacctgcaaattatgccatcagttaataacaagcgtagcatcacccatggtggatgtcttgacattctaagaactttacatgaaaaatggacaattctaccactagcagcaatgcagcatacatatcaagtgcagtcatatattctgaaaaagcaaaagaaaaatacctgtgacacatgcaaaggtcttagtttatcaggtgcagccttgtttattgcatcctttatatcactagactttacatccttcctccatgtatctaaggaaattagaagtaaatacacatgtcagctatcaggagaagtaatgtatctagtcccatggtgtatctcagcattccattagagttaatttctcacataagtacacaaggattgtctatttatttgtgcaaatgagttcttcatgtcatatcaaatgaaatgaatggcatgcattggtggagttagtcaaataagaaggttagcagttcattgcacgtaggccagagttctgcactgctatatctccaggctattacttctttgataggaaaacagtggtgtatttggtattgacaaattgttgtgttaatgattttataatcagaagcaaattacttgttcaaatgcttctgtaaacaaagcaaaattttcaaccaaaaaaaaaaaaactctacaaaataactgcacataagctcttcttgagaagtagaccctccatcccaaaatataaggtattttagagttggccacagatattaaagaaaaaggtaaacatgatggatgttgtgattggttgagatgaggaagtaggtggagaaactaaatggggattggtgcgattggttgagaggtggaaaggtagctaaattttggaacaaagggaatagtttgtaatatgacatgttcataaaagtggataattagttgaaggaccactggaaaacaatagtgtgttctcaggtgcaactaacaaaatgagcaaacttgctgaagggcagtcacccctttgtctgtgcgcccagcaacaacagcacagccttctaatggcaatgatcttgcttcaagctgtttagctttcttctcgtcaacaaactggccaagatgtttttctactaacctgcaagaaatacagagtgcaacaaatggttttatcctgtcatctgtcttgagatgcaaaggaagtgaagaataaaagtgccagatatgtctatagaaatgacataactccattcttatttatccttacccttgaacagtgttgaggccaggctgcttctgccaaccatcaaatgaccccccatgatatgaaaggacaatcttgaaggttactctttcccatcgtcctcctcgatctttggatgatttagttgatgtttgattttctgatggtgctgtgtaatcttctccattcgtatcaaggctgtaaccattctgttgaagaaaaatccgataaatcttactgaaacaaactaaaagtactagaaacggacctgcaccgacaaattccaaaatctactctatcctccaagaaaaaatgtgttcacccaaaagatttcaatttctctaaaacgatgtgtactacttagatggggaaaataccaacatttggctcactaagagaaattgcaactaatactaacacattttccccttcccatttactgaatgcgaagaaccactacctcagggtttcacatggataattctagaaacaggcctgcaccgacaaattccaaaatcttaatctatcctccaagaaaaaaatgtcttcacccaaaagatttcaatttctctaaaacaatgtgtactacttagatggggaaagtaccaacatttggcacactaagaggaattgcaactaacactaacacattttccccttccaatttaccgaatgcgaagaaccactacctcagggtttcacatggataattatttaaaaaataataatatcattccttctcacctcatccttcccaaacaaatcggcgagccccgctgccccggcgccggtgcgcacgagctcggcgtagaagtcgaccaccctgctccacggccgcgcgtacatgtactcgtagctctccctgccgcagccgcagtgcccaaccaaaaccaaaacagttactaccaatcaagccccaagccgcagataagccctagacgatggaggaagtgatgggggggagccgttacttggctgtccaccggaggtggtggcacgcgtcggtgtggttgtagtgcgcgtgttcgtctccctccgccgccgccgtggaaaacgacaaagccggagctggcttcgccgccgccgccgccgccgccgccgccgtcgccatgaggggccggagcttcgcgagcatgttcttccctttttctttttgaccgtaatttgaccgtaatttttttcaagaaaagaaaagaaagatggttgttgtacaatttgaatccatggattagcacaatttgaccgtaatttttttcaagaaaagaaaagaaagatggttgttgtacattaccttggagagaaatttagagatccttatcctctcactctcactctctcgttctctctctctcccactctctctctctcgttactcttcaagccggctgacgggggcaaggagggggggcgtccaggtgtagatcggggtcggagacggcaattctggtggcggctaactggcctggcaacgcagatcggtaagatgggtgtatgggcggcgcggatgctaggggacggcgacggcgaattcgatgcggcgtctttccggtcccctctcgcacagatccgtcatcagctgcgacgggaggggttggatccggcgacctgttcctctcccgctcagatcccgttgtctctccgtgccccgctcacgcagatccgccgccggtgttaacgggagggtcaagatccggcggttctaccgtggtcgtggcctccctaccgccgccgcctctgcacgcgcggcccctacgccgcccccgcccctgctgcctccttctcccccacgccgtcttcgatggctgcgataaggggcggcggcggcggcggtgggaggcgctagaggaagggatatgaaggggaggcgcatggtccggtgggtgaagaatgaagaagtgggcggtcgatgagatggaggcgaaggtggcgagaggtggtcgccaagacctccgtcgagcatctggatccggcatcccttatcctagcgactgatggcgctggcgcgttcctcatccatctcgatctgacagcgccgccgtaggaggaggtcaccatctaccagtccaacgacgccaatgtgagtcctcaacccaatcatccagacactttcctctgcatcctcttttgattttctcttctatccaggatacttggtgctatcttttggtttgtgctttcaccgataagtcaggggacccggtgttggttgctaagcacatcgcatttgaggatgcaacttctttttaagtccttatggggttcaccacattccattagctcatcagatttgtctctgcttcttctggtggagaaccgtgtttgacaacactccttatgtagtcatagtgtccaagctacatacactgcagataatctagttgtgtattaatctacatttcttcagatcttcagaaacatcatccggctcactggagctatgctgataggcaagccttacgggagaaacaatgtccgcattatactgaatttctttcgaggccaggctgcggccggctgagttcgaggagagttggcccgcgccgtgcttgccaacgaccgacgtccttgactcgccgtcagttccagccactgcctcccaggtgctttattttttaagacaatatatcatgttgttgatgtgaaattttgggatcatcttgtatagtagtaatccggttgcttagaaattagaatacggttcttatctgagcttgtgttttgaaatgtggaattgctggacaacagttttgtgatcatgcttttatgttgtttataatatcatttacatcccatgttacatattttcctttgcttaaactaaattgagagttgaatccactgtcatttatttgtttcaagtattattttttgtgattctcagcattacattttcactctgatactcccaccgttccaaaatgtaatgtgttttagttttatcctaactcaaagttatcttccttttagaaaataatctgggtatttgatgcaagtacagtatgatctaacctggtcagcattcttatataatgagttattctttgtaatgagctagaagttatagatataatttattcgttaaatccatagtatattttcatcacaaaattaaaaattagaagtgattttttgcttctctctgaagtcatgagtacattgtgactacatatgatggtgaaactggtctggtagaggggtcaaattatctgttagtaaaaaaacttgaagcatatattgtttaactttattagatttagcatgcgatgagctttgctgatcaccttcataattaatgcaatgtgcgtccttaacatttggaaggacatttgaatccttttttcgcttataggcgtcatgacgtttcttaagtattccttcttttcgtcaggcattttgcgcatacagctttgtgtctctgtcttcgtgtattgggatctaagaatggggacgatgatccagatggcgcatctagcttggaagatgaagctgtacataaacattatcaacaacaaaagcatgatgtatcttctcgaaaacaacggtgagaagcaaaaataatttaatcattcacttatgttttttcagctgattttgttcatttaaatgagccgcaggatgtgtttatatatgtgttggacttcgatggaatcaattaatacaccaattcttttggtggggattattctatctcaatgttgagatagcttgcctgagcaaggtcagttatcaattttgtgcaaactacagccatactactgcaaccaatttttttttctcttccaatgtaatatctgatcacatggttgtttcctgctctgttttggttgcgatgtgcatgcttcattggtcatctgtttggaaacactcaattctgacatgtaccaatgtagtaccaaaaatttcatgtcttagtttgctatgccatgatgcttgatctaaagaaacttttgttctgatatgcgatagaggttccacttgattttctaggcaagttattcgttattgttttgttttactaatgttccataatattcttttatgtgttctctatatgcaaatactgttaagtttttttttatgctttacttatgctatttgaaatacctttcacgttatggccctaggaagtaataggggaactcaagcaacagttatgtacacaaaacaccaagctataggccaaacatttaaactttatacgtaggtcttcttttgtgtgcgcgcgtagttaagggaaattgtttggcagactatacatccgaaatcagaaataagtgtagcaaataaaaatataatgaagtaatagtggtattattttggttaatagtttggtgtgataatttttttttggatttgctaaatttctggcaccataaaattccattgattacagtcggtttgcatgcctatgcgctatgccacacaaccgcacaggcctgaggcctcccaactgtgcttccgtgaggttgaagattatttccacacatacatcatgatgagagatgattatatattaattacatatatgcaatttcgagacttacatatgtaattttgagacttacatatgtaagtttgtgacttacattgtaaatacaataaaattgcatatgtaatttataaacttacgatgtaaatacacaccgactattttttggtgaaaaatatggcgccataaatatagctactccccttttttttagctaatagaagatggatggttttttcttcagaattactaataaaagatggttgcctcttaaataaggtatgagatccgatcaatctggtgttaccttgctgagcttggtagttttatttccatgtattttttccctcttaagattgactgatttatgttaattgttcgttatatgtcataaataatgtatacatcattaaggtctaaagaattaccttttatcgttataaatgcagtaaaagcagattgagtctcacaccgaacatgaattgctcagtttcaaaaaaatatctgggtatatgagtagcgccgagcagagattgcttagttccacaccaaattctgggtgcatatattagtcttgtttgtgctttcagttttattctatatataggttgagaagttgtttgtatcctaatcggtcatgtaattcttatgtttgggttctatgtaatttatgtgctggactgaatttgtaattcctgggcaatgggcccaaaaataccgcatgcgggaactggagacggacagctaaaaaaacgcgtgcattgaaaaaaaggcggactcactaaaaagagcgtgtgcgcaaaaaaaaggtggatgggcccacagaaaaccgcgtgcgaaaaaaaccctgacggacaaaaaaaaccgcgcgaaaaaaaaacggacagaaaaaaaccgccgtgcgcgtgtgggaaatcggcgacggaccaaaaataatgacggaagccttaagaatttttttattaggtatagatttgacaaatttcctttcctacatgtgtcggtcagtgtatttccctgcatggtttcctatcaaaaaaagaccaagaaaacaggtgtttggttgtgattagttcacgctaaaattagaagtttgattgaaattggaatgatgtgacggaaaagttaaaagtttatgtgtgtaggaaaattttgatgtgatggtgacggagctcgtggctcctcaccgggagaccgcgcaggcccccctttgccggttcggccgggggcttagggtgaaatctcaagctctcgctctccctctgtatctggaaagatcgtctgcccgcaagacacacgagacacgacgatgtatacaggttcgggccgctgcgaagcgtaataccctactcctgtgtttttgtggatttgtgtatggacaagttacaaaggatcgacttcctttcctctcagccttccgaaaggaccaaaaatcccccgttctaagctctaaatctcgaaaagaatcccccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccagcttgagacgagtgcctagaggctttcgtcttgacgggatggggcaaggcgtgcgtcagaccgccagtcgccacctaacccgtgatctgaccggtctgtgactggtcacagaccggataaagaaacgcgctgtactgcgttgcatgcagcgtgacacgcttgaccagactgcaataaatgctgttaggtgagcacagctgtgatcacttatcccatgtatgtggcgcagacttccttaaggggtcggggtgcctcggccctcggggccggggcaagcgcaaccagacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacgccacttgagcagcgcgcgaatctgggtgagcagatttgtctcgcccggagatatggtaacgccgcttcggtcggcgagcgtaattaacgcgcgcacgatacaatccatttcgattgccacaaccgcatatccactcaatgcgccgcaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgccatggcacggggctctgctctgctcgacggcagtgtactaccgccttcccgcatcgtgaatgagaggcacgccggactgccgcgccgcttcatgccggagtccgccaccggtcgggagatagtgatgctgggcgaggggcgcccggcaccagactacccggggcggtccatcttcttcctcccctttgcgatggctgggctggtcccgccattttctcatttcttcatggatgtcctggagttctatgacctccagatggcgcacctcacccctaatgcggtgatgacattggccatcttcgcgcatctgtgcgagatgttcatcggggtgcgcccctctcttcagctgttccggtggttcttcaccgtgcagtcggtgtcaccgccgtcggtggttggcggctgctacttccagccgcgggggccggtgttgaaccgctacatcccctgcgtccttcgcaagaagtgggacgactggaagagcgactggttctacacccccctcgccaacgaagcgcgcctccgacttccaagccagcccccggcgcaggtctccagctggcgggcaccggtagatctgggggaggactacgacgccgtcctcgaccgcctggcgggcctgcgatcccaggggctcaccggggccatggtgtacggcgattacctccgtcgccggattgcgccgctccaacggcgcgcccggaacgcctgggagtacactgggcctgaagactacatgcggacccaccagggagccagatgggattgggctcccgaggacttcaagatcgtggtccaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccgaggggaacaatctgccccaggagggggtcgtgcttctgggccccgcgccgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccgggggaacctgatttctcctccaaggtggtcattcaaccgaccccctcgcaggttcgtctcactctcattgcaaccacctttctcccaaagagaagttttttcttactcattttgttcgtcttttggttttttcttctgcttcagcgatgtcccgtcgcattcctcccgccaccccaaatccggccagtccgaggccgaagatccagcggccgcagaggagcggaggcgagagtctgaccggcgtgaagccgcagcccgccttcgggaagctgaagaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcctactcccttgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctccaccaccgcgatgatcgaggcgcaagacactctccgccttcagcacgcaagctgggaggcggagctgaagaaaaagctcgacgccgcccaaggggtccttgactccgccgctgcccgagagcggcgggtaacggagactgaagcggcgtttcagcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtgcgcgctccgcctccgcgaggacgcactcgctgagtgggagcgagctctcgaggaggctgaggccacgaccaaacggctggcggacagcctgtcccttcgcgaggcggcgcaggaggagcaggcgcgccgcaatctcgaatgcgtccgcgccgagagagccacactggagcagcgggctgctgacctcgaggcgcgggaaaaggagctggacgcaagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcgtcaagcaggcctctggagaggccagacgacggtgccccccaccaatctggaaggcctcgctccgcacctcaacaggatggcctgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgaggacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccggcgacccgggcgcatttgaatgagcccccaggcccccgccaatcttaacttttttcttgttctttcttctaaggccttcatgcctcttttttgtacaatttaacttaatctgcaatgagaaatgatgaaaaaatttttgtgttagttttattttgctatatgtgagatgaggatgatctgtgccgtggtctttttgcgtcttagcttgaaataagggcccatgcccaagtcccagtcctcgaaaagcgcgggtcggggctagtgcctggggagatccgcatgtcgagactggccaggccgggaacgtggtgaccgagggttatgggtgacccaattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgacacccgaccccccccctttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtagtagaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttgagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaatgcatttcaggaggattccgttagccgcgcgccgatagagggtcccttctaccagcacgtagcgtttggaaatgcgttgtacacgttcactcccttcgcggtcctcaggtagagtcttatctgtgaggtatgtttggatctcagagatccaggcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaactatgttatcccttctgggtacatgccgaagttctatcccatcgaaatggcgctccatacgccgcacttggcgtacgtaggcgtccatctgtgggtcagagcaccggtactccttacagacctggttaacgactagctgggagtcgcctaataccaagaggcggcggatccccagtccagctgccactctgagtccggcaaggagtccctcgtactctgtcatattgttagtcgctcgaaagtcgagacggaccaagtatctgaggacgtctccgttcggagaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctaccacaaaatcggcgagggcctggctcttgatagcgtggcgtggttcaaagtgcagatcgaattcagaaagctcgattgcccattttaccacccgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacgggccgctgcacctttcggcggggccgatccccttcgctaggggccgtatccccggggcgttcttcatccaagtggcctctcggggtgcactcgtcttctgtgccgatgacctcggggtcggaggacgacaggagcggccttcccacagtggcctcggggccgtcctgggggtcgggggctcctggcgtcatcggacaagcgggcaaggggccagctccggtcgtcaggggcctcaggcctcctttcggctcgggggcctcttctccctgctctctcccgggtcgagtcagcacagggttagcctcggggccaaagggcgataagtgcggccttccctcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtaacagggactcatttggctccggggcgactagaaccgggggagagctaagatacgcctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcagggttcagctttatgcgggcggagcggaggttctcaaaagtttccgctagatctgaaagtaaagtttcttggttgcgcgtttttacaaccaagtcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccaatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggcccccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgtgggggaaaggatgttgagagccgctcctccatctatgaggacacgccccaacttcacgttgcagatagtgggggaaaccaccatcgcaatctgccctccccgggcaacgcacggtgggtggtcggtctgatcaaaggtgagggccacctccgaccaccgcgcccgacgcgtcgcctcatgagtaggggccgcggctagaagctctcgcttcatagccttgaagctccggcgagaaacgtgagcacacgctcccccgtcgacagtggcaatggtggccccaggttcttggaaacctaggtcatcatcaccgtcatcggggtcaacggcgggggccttctgtctggcctcacttcgccgtctaccggagggaactgccgcggacttgccctcacggcgttcctgcctcctgtcctcctcccacttcctcgttcgctcagccaaatttttgactgcacgacagtccgcgagatcgtggagggaggtgttgtggacggagcaccacttgctggctgggcgctcccggttgggagtaccagcctctttctttttgtcgctcgcaggcctcccctttcgggtggcccgcggagcgccctcgacggcgaggacgtgcccctcgtcgccggaatgggccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacattctggacgaggaggcgccctccgttgcacggggagtacgccggctattacgcctgcgctcgatgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccctgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccggttcggccgggggcttagggtgaaatctcaagctctcgctctccctctgtatctggaaagatcgtctgcccgcaagacacacgagacacgacgatgtatacaggttcgggccgctgcgaagcgtaataccctactcctgtgtttttgtggatttgtgtatggacaagttacaaaggatcgacttcctttcctctcagccttccgaaaggaccaaaaatcccccgttctaagctctaaatctcgaaaagaatcccccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattctt

SEQ ID NO: 72298 - DNA, 15490 bp, Oryza sativa
tggtaggattttttattctttttttcctttttgaaaagaagattgacttggtagttgctgatcgtatgcctctcaatgttgcatgagctactagtagttaggccgatagtcatacaatactttgaccatcattgagacgcatatgaaaatccgctagcttttattaagagcaaattccctgactagattatcatgaaactacagatttcaaagggtatattataaaactatagatttagctctaaatttatcacaaagctatagatttagatcgtttcagaaaattaaatatttagtgatgaagttatcatataactatagatattttcaaatttagatctatagcactattattttttcaagttacagaagctaaaattttgtggtaatattgatgttaattatttagtttagtgataatgataaatttgatgctaaatctgtaattttaagatacatttttatatataatctatagttttatgatattttgataaaaaaaactgtaattgcgtaaaatttactcttttattaataacgagtctttttgtttttttctctttcttggttttcatggaaatataatctcgatggtcaaacacaacactgttaattcgaacatcaaatttctgcacgagttttgtatcatgttttgtactaggaaagagggctttcaccactttttttttcatgcatcctatagagacatgaaaatgatcatgccgatcgacttctcttattttcttaaacgtgtagaatttgctcatgtgattgttgagaaataattgcctatgtcagcagtagagtataaaatcattgtcatcataaaaggaggcattggtggtcgttttccgtttctttcggttgtcttttcgtcgtgaaaaataagaacaattctttgataggagggtttatgtgtgataatgacgatgataagatgatcaacccattgtcacaagtttttcccttgcttctcaattaccctacagttttctaatacctattcaagtttttaaatattttttgtgcccttagtattgcacacttaccattttgttgtttgcaccagaaaagtacaattctagatattaaaagggaaaaataagaaatcagtactaggtttcttctgccacttacccaataaactaactttaattatttcctaaagaagcataaagagaaacatatataaatagaccctgaaatgggaatgatgaattgatgagtcactgtccagcgtccacttgtccagtgtagatgatttgaacattttgaattcattattgtttgaattttgattggcctggttgagaaaacaatgaaacgtgagtctactttgattcggcaaaatcaaaatctgccaatagaggcaacacatgtgtacatgacgcagctaccgcttttaggtcagatccgaggtgtaagcggatccaaattttggttataaaatattgcgattttcggtaattgaatcttcggagagatctgttgacatgaacggcaaccacgtcatccacgtgaattttgctcgtgggcatttttaaatggtgagacaaggttgctcattttttaagagtaaattagtcatgaatcagaagcaaatcagaaccaaaaactagtatatcaacgtgacagaatccggatttccagtgacgcaaatgagctgctgattctcatcttccgtatagactccttcggtttatgccgtagcttaaatttaacttcaaaaccatagtcatacagttgattttgatgtttttcattttgcagtactagcttttaaatgctaagaatacatatgaaaaaggtttttccttatagatttttttcttttgccgctaaaaaacggtacgttttataagccactataggtttaacgataaaactgtgttcaaatcgataaaactgtgttcaaatcgaaccttttcaactctactttttcattttttacatgcatattttccaaactattaaattgttattttttttgcaaaaaaagttctacttaattaatcatgtgataatgagctaccacgttttccaaaaggttccaaatctttatcctcgaatgcagctagggtcggaacaaaacttcgtatggaaaacatgaataattctcgcgattctctgaaattgattcccgttttgtaattaatctcaatcatggcctacttacttaatttccatttcattttttgcagattttggtgtcaaatcaagctcttaatttagccaacattgtaggccaagacgatggagatccatactgctactcgatgcagcagcagaattggtagaggggcggcacacactgccctccctgtgggtagcctccggccgtcttgcaccagttgtcgcagtcacgtatatcctcgcacttgcctcggcacacgaacttgccctctcctgcatccatcagaaaagaaaaatgccaatgtttagttcacaaatcagccacatccaaacagagtaaatcataatttgaaactccgatgttctctttcgatactgagtaattatgaaccgtaaaaatcagaatcgtaatagtgatttgagaggaacaatattatctatatctatactaatataaaagatagtagtggtggtgatgagtctgccaccaccaccacccaactaccatacgggacccatgaacggtgagtgcttatctcttagcccccacatgctatagatcttatagaaagaaaaatataacaatagaatattatgaaaattttcatctttacaaaatgatagaaaaataaacaaaatgataatatattagacaattagaagaaaaaagcatgttgcaacacacgggcattatgctaatcttagaaaatcttgcaatgtgtacctgaagggataaggagagcagcaatggctacagcaatgacaaggatcttccacataacagaagagaaggtggcagccatctcgctgttaattgcaacccactgctgaatgctcttctgattggatttgttggaagcaagatggtttgagactttgagtgatgctgcatcgcagtcatctctgatcatgtgtatatatagcagcacgatagtaaataaagagggtaattttggtgaatagtagcattcagctaatctaagcctctagaaggatatgcatttatgactcttctaagtttaacatgccataatgtctctattagttagattagatacgacaaggataaggcacttaattatgtgccaaagataaccatgctagggctcttttaccatgtgactatttgtgaccgtttttagactcattgacaatttgacacatggcagagtaaatcaaccacctatttttatatttaatttaacaaattaggttcacatttattttagaacaactaggttcatattacctttatggaattaagatgcctgcactacatcagcacgataatatttggttttactattgcgtttcacagaattaaaatgacttccaagtttatacacacccccagctggtttatgagccactgtttagtattgtaacagagcaatatttctgcagtcgtaaattgaaatctttgattaaattagctaacaagtgtgcggacatcaacagctgaacagatttcagattgttcaaaggtgacctgcagtctattttacaaacaacactgacctgacaagtgacaatcaccctcatgtacaaaaaaaggaaaagaaaaagaaaacgacggcgcaatgtgcaatctattacgattagaaagagctgcggaaaagttacttcatgctgtggaaaatttgactcaggtagaagataaaactcccatttcaatcttgttattactcttcaagtttttggtgcttttgaaggaacacctttgatcttatatcagcctagcgaaggatgaaacgaaacgtcaaattagtacccaagatacaacgtgctgacaagatgaaacttgaggtatactatttacaaaattctacctggcgaatgggctcgggaatgcgataattactacagaacttcactatcccaatggctgagtcaagtgaaatgcgatgcccaactgagatgtagatcggcttcgacaaactagggcaggagcacattgcctgggataagttaatagtttagttccaacaatagaaaccttttcattatcaggaaatatatgacagaaatgaagtgaaggatgcattcagaggtccaatatagaatctcctacagctccccatgttgtcccagactgtccagtcaataaaattaactccttgttgcagttttcttttgcttctaattgtcttctcaattcagattggttaaggccatccacatggtgcagctggggcattcaaaacactgaggacttagtcttctctcagaggatcagaacatcagaaaaccatcaagtacttgaaatggtcggaaaacaactagatgagagaacttccataggagtagttgcaatggcagtaatattaatacattttttccaactccaatggtcggcaggtctgcaaggacaccaagatgacaagctaaaccaaaacctgttgaacatatgtaagttagagggtcatgcattcaagtagtttattgatgcagcttgcagtgtatatgcataactagacatgctgtacgctatcaccaagtcaattgactagggactacaaggactgtcaaggtagttcgttctaaaagaatataatataatcatgttatgtgtgtgattctgcagtttttttctaatcacatgaatcatcttagtcttacaaactaagattgccatgatactaatcactaatgaggtatacctcgtggatgaagtaatccatttccatcaaccatgagtacctgtcagttcatcaagttaaaccatagagaaggcactggcataactagtgttaaatgtaaaactagaagacgctaacatatctaaaatttaatgccaatgcttatgccattaagcattccagatcaaaattctagaataaatgatatttatgatgacaaatgattatacatcagcgcagacaattcacactgttttcacagtcaaaatggaaacaacatatgacaacatggaatgctacaaagcataaagccacagtaaacctatttacagaagggtaaattgcaacgacaaagcaacctgagggtagaaatgctggttgtttgtcttcattttttccaagagtcctagaagaattggagcctgtaacaagtagtgcatgttgacacttttagctgtataacaatatacttgatgtatattttaaaccatctaacaaagtagaataattaaaagaatagttagcatataacaacagtttatccacgtccaatcataacttgattttgcattgaacatgctagacccatatatggttatacagataagaagaaagaatagttagcaaaaacacaataaatatgaatgtacccatcttgattttgtttcattgtttgcttgtctgcctgttcatcactacagaaaatgaaaatgtctaggcccctgaataataatacagaaggcatggataaactgttgctcatgatctagcaaacatatgttttgatcaaaccaaacacgccaaaataagaggacacacaatacctctctgaaagcaagaaatcctggaatatatggcacttgcagccgaacaacatcgaactcttcgtggacaacttctaaggtaccagcatctaaaactaccagtgcagcacacgccgtggaagggtcttctttcgagaagctaatgtcaacacctcctatatacttcaggttgcccttattattagcattgctctgatctgaatttgagcccattgaaggtaaattccacccaaaatcatcctcaagaatgagcttgctctttagcatgtcttgtgttctacagcacaggaaaaaaccagcatgagatgtgaactgactcctcttgattggtgaatggttctgagggtatacttggcccattcttgtttctgctgcatcaactcacaatcatctcctcctcctgaaaatcgtggggtattatccattcctcttgtgttcctcacaagcctgcagaatcttgcacagcggtccggaaatccaaaaaaaaaaaaaaacggctgcaaacctgaaaaattctagctgcgttctgcatcagcataatgatttgtcttgaaccgtaaaatttgagcactgtggaattgcggggcgtactgacagggaagagaatcgaagaatcggatggcgagagaactcgccgagattctctcacctgatacgtcgccgtcgcccgatgccgccgccggcaagcctaccctctcctcttccccttcaccggcctcctcttctccccgcaaccgctactcccgtcctccacctcgccggcgcccgcctgctcgtgaccgtggcagccctcgtgatgacggcggcggcggagccggagaggcgaccttcgccggcgaggcggcgcgagagatgcagaggaagtcagcgagacacggagactgacaggtggggcccacaaaagagagttgacagatcgcaatctcggcccatctcgctttgcccgggaaacttgcgacggatgggccacaattgcggcccggatatgtcatacaatgggcctttacttcgaagaacttttcctgatgggactgtctaggcatgtggcgtgttatttttgagaaaaaaatcacccaatttttttctcccctcgtatctgcatccaacggtaaaaaaaaaaataacaatacagagaaaccgtccaagtagcatgtgattgtacttattagtagagtagtattcaataaagattaacacaaatgttgcatttataactaaaattaccgacaaatgttgcatttataactaaaattacagtgttttataactaaaattacatttataaaaacaatagatatggcatgtaagtgcactataatttatttgtcgttttagtataaatacattgcttgagaaaccatgcagatatctgaagtgttaaatgttatatttataactaaaattacagtgctttataactaaaattacatttgtaaaaacagtagatatgtcatgtaagtgtactgtaattttagtacaagtgcgctgtaaattttggtaactagaatatttgtcgttttagtataaatacatgggtgtagctatatttatggcgccatatttttcatcaaaaaatagtcggtatgtatttacattgtaagtccctaaattacatatgtaattttagtgtatttacaatgtaagtctcaaaattacatatgtaagtactaaaattacatatgtaaattggggtgtaaatgaggtgtaactactgtgtaagtggctgaaaaaaaatcgactgtagcatatggcgccatatttctagcaactccgtaaatacattgcttgagaaaaccgtgcagatatctaaagtgttaaatattgcatttataactaaatacagtgctttataactaaaattacatttgtaaaaacagttgatatggcatgtaagtgcactataattttagtacaagtgcgttgtaaatttgggtaactagaatatttgtcgttttagtataaatacattgcttgagaaaccgtgcagatatctgaagtgttaaatattgcatttataactaaatacagtgctttataactaaaattatatttgtaaaaacagtagatatggtatgtaagtgtactgtaatttattttagtacaagtgcactgtaaattttggtacctagaaaaaagaaagaaagaaatagatagaagaagtaaatggctactgacaatctgacatgcgtgatgtacatgaatccatcgatataaagtcaggttgacttggtcatggactcaactgaccctgcttttgcacaaatcttggaaaacatcgtgcggctagaaaaacgtcaaatactatgaaaaaaaatcacccggcaaaaatttagcaaaatcgtttcatttccggattcgttcatactacaattttcagataaaattcttcgaaaatcatctgaatgagaactcgtacgtataaccaatcattgagagaatatgaaagcttgatggtgtggacgatcttgccgaaatcagtcaccaaagttttttttgggcattttggcaatgttgttcaaactcgctcagcatggtcgtgttcctaaattctctccctaaatgtttttaggcccgtttgaaactccttattagattatagcatattagcacataaaatgagacggcccatgaataattactaaacattataaatttcaaaaatagatttctttgattttgggtaatctgcatttcagtaaatgaaatgggagagcgctgctctccttcttaaaaaaaaatatttctttgatttatttttaaaaaacttatatacagaaatatttttttttacaaaaacacattatttagcagctcgagaaatggtgctaatgaaaaaggataatgttgtagtttggaattgaagttttgggcatgatgtgcttgatcatgcccaaactcaccaaagcttttggaattttcacaatctataacctatttcaaacccgtagaccacgatcgtgctgcttaaatctctctgcaaatgttctcagtctgaaactctcaactcggtatcgatatatactctgaacattctgcatacatcaatcaacacaagaaaccaaatctgcagggagagatcatccgactgctctgccgacgtactcgacgtcgaagaggagagtggagttgggcgggatgacgcaggaggtgggctcccagcctctgcacccggctcctctcgcgccgtaggccagctccggcggcagcctcagcgacctctttccacctgaacattcaaccacatttccattcagcttcaccatttctctaaattgatacaaaatcgaggtgaatctgatcgagtatggtgagttcatttcagatttttgtcatttttcagggttcagttcaggcagggagacgcaccggcgagcatcggcgggatcccttcgccgcccactatgccctggtcccatcctttgatcacctgaagaattatcagtgaatatgcaatgtgagtgatcttggtatcagagatgagtctaattcatcgtgtagctgcgtaatctgttgccgattagtacaatgtttgaatatcttgcagaatctgttagtgtgcttgattgattgatcgtgtttacctcgccgacgccgacgcggaaggtgagcggcttcccgcgcttgtagctgctgtcgaacaccgtgccgtcctccagcctcccggtgtaatgcgcctgcgtgggacgaacgaaacacacggcgaggttagcaagaaccccgagacctcgcctcgccggcggcggccggtgggcgggcaggtgcgtgctgtcgtgctgaccttgatgagctgcccttgctcggcggcggcgccggtgccgacaacgcggtcgcagaaggcgagaccgttgggcgccacctcgagcgggcactcgccgccggacgcttccgccgccgcggggagcacgcgggagaggatggatgcggacagcacggcggccacggcctcgcgccggcggagggcgacgacgggggtgctgttcttggcggccacggcggcgccggcgttccggctcggagaagacacgggaagtttcacgctggggtttgggaggctgagcaggagacgggacagcggcgaggcggtggcggcggcggcggcggcggcggcggcggcggcggcggagggagccatggcttgccggctccgtcctctgctgctgcctcagttcattccaaagctccccaaaccagagaaacacagcgtagcgttgcagaaacggataaggttcaacgtcttctgaatcgtggacgaatccttggacgacgtgggtcaatctcgaccatctgtattggatccaacgcgcccaaagtaatgttctttttcatccttttggagagcgtctggtagtttttccccatgagggcctcctgaaccgtaccaaaaacatatacttccttctaaaaaaaaacatatagttcctccgtttcagtttataagactttctagcattgttcatattcatataaatgttaatgaatctagatacacattcatatagatgtctagatttattaacatatatgtgaatgtgggtaatgctagaaagtcttataacctgaaacggagataaatttggagaatttctatattataggaaaatcgtaggaaagtcttcgaaacaaagatttaatcctatacttttgttttaaaatcatataaaatggacaattctacaaaaaaaatttagaggaaaattacaagaactctaaacccttgaaaaatttcatgcgagtctatttatctaattcgattcatgtgttttttccgcggtctacacaaaccactatttctatatttttcttatgttttgttgtactctattttgcatttatgttcacgtttaaatcctttgctctttttccattattccattttttttcaatactacgtttcaaagaaccatgtaatttggattaaagatgatggatttgtttatgtgaattagtcaaatattatatattacaaaccttaaaaataaatttaaacacaaagcagtctaaacaatgaacagttctaacgtttaaagtttacggagaaatcgtgaagtaagcgttgctcaattgtttagattcttcgtggtggaaccagcctacctgggtacaagttctagatttgacacatgtactcacattcacggctaattattctttcagtggtaggtgctgtacctgccgacagcgagacaacatggtgacttcgtcaatctcgagatatgtcgacatagtcttccgaaaggtcatagcggtagggtgtgcgtgtgtgcattcataggagtgagagtacacgtattgtgagcaaatgcgtatgtatgtttcgaaaagattttgtagaaatcgaatttttttggagcatggcacgagtaatccacaaccaataatctgaggtctgagattttgttgacatggcaattggcaagttgatctgttccactcgtgctaactaggaatttatgtggcaaaaccaaaagtggcccccgcatgtcatcatcactgtcctcccctcttctctctagcttctctctctctctctcctaagggggcgcgcggtcaaattggagcaagggctgccgaatcgaaggagaagtcgcggccgtcatctatgttgggacctcccctttgaacttatctagcaaacagtgtgagtgtcttaccggaagacggcggaccatgccgatgctacctttaccttcgacctcatcagctctatcgcttctgtcgaccagtcgaggagcgacaaagaggtgcctggccggaccgccaccgttgactcgctgtggagcgcgtcccactggtggagacgaaccaagattcggtgaataagccaaagaacgagcggctcgggacgggaactaggacatggtgacgcaaccaccactcaaagctcaagttccacctccacggctcctcctcctattctcaacatgattgggtggaggcggcgagcccacccctagtggtggggaggaacgtcccacgaggatgagcatgagtggtggggaagagcccactccagcatcacaggaccgcaggagtacctaaggcggagttgctggggcattggatcctctccttcactgatgccttctcgcggatggctggctccctcgcctcccttctcttttcctccactatggctgaccaccagagccacctcatcaccgacctcccaccgttgcctcgtgcggacggtctagccagctgtcaccgctctccttgccgacgagctcctatgaaagagaggggagagatggaataggtggggagatgtggaagtccacttatatgtgggcccacttgttttttaatttcctttttgctgaaacacgtcagcaaaaacaagtatccatattgtcacgggatctgacttgaatggttttactatgatggggttgaagatgtctgatattgcagtttagagttatcaattaaactcgacggaaagttgaggaatgaaaatggacttattcctccctagatctctgaaaatttctgggccaaagccttcctggcctgctcaacattatccggcccatctacccaacacacctcatcttatagcccatacaactacccaaacctgacatccttcatcaaatttctgcaggcaaccaacgtgattctgaacaaatgcgatataataaaacccatcgatatcctcgtatacagtacactcatggcgatccaacaccgtcgctgtcttcagttacacgaacgcacgatctcgccggaaagaccgccgcttcggccggcgagccaccggagttcggcgtgtgagccttcaaatccgcacgcacaaatggcgtagcaaaacttcgttaggtttcggtcattttcacaggcaattctgatctctcaatctcttccacacacgccgccgccgcagtaatggctcgatctgcagcatgtgcctgaccaaactctcgatccacatccatcgatacatcggttaataagtcaggttttgtactttcgtttgaactggtctgcgaggaaaaacaaaataaaaatctttgttattggagagacagtttgatcacaaatcactcctgtgatcgtggtccaaaatccagtacttgtcggtgtcagtactaccgttctgttgacaagtaactcatggtgattgatgctcatcttctcttctgatcttctccttgacaattgtaggaaatgattaattcccaattttagactttgtttagataaaaagaaaagaaaggagagacaatcttgcgaagttaggtttcatgcgttgcaaacagcggcaccattaacaggagcatatcgtcatctctgacatctagtgagtcaagtgacacagcccaggacttgggccagattaccagaatggataattggagtcgctcacctgctcgtgatccatcatctctcttcttctgttgctttaggttgcttgcttcactgcatcttaagcttgtactaatgcaaaacttgcactcaaaaagattagtgttgttgttttgctaaccacacacacagacatgaagtcagaagctcagatcatctgctcttctcctgcatatgccaaagccctccaactccatgtttcagaaaccatgacaggagcatccacacaaccaatttttagcttagtgatcagcaaagcagcattgtgtatgtcatgtcaaaatccagtgattaattagcggaaggtgacttaatccagatgcaccaaagctatactatccttatccactgaagcacccaaaaaaagtctttcagggacaaaagtgcagtgcagtgcagacggcaggcctgctcaactgtattttgaccggctgctgttgcgacactaccaagtacaccaaaccacttcaatctcaagctttctttttatggtcctggatctcactggcgtcatctcttgacatcttaattttattttggagcttgctaggctgctagtttcccttgatttgctcttttcgacttattcaccgaattattaaaacatattatttattacatgcttagaaacataagttttctaaaaaaagacattcttccaccacacattatttaaggtgcgttcgtttaagcgaatgactggaactcttcagtcaaacacaaaacagatactccctccattgcaaaatgtttgacaccgttgactttttagcatgtgtttgaccgttcatcttattcaaaaaaaatttgtgaaatatataaaattatatgtgtacatgaaagtatatttaccaataaataaaatgatataaaaagaataaatgattacttaaattttttgaataagacgaatggtcaaacacgtactaaaaagtcaacgatgtcaaatattttgaaacggagggagtatatcgttaatatatgattaattaattattaattactttaaattttaaaaatagatatgctgaatttttttgcaaaacttctatatagaaattgttgcacaaaacacactgtttagcagctcaggaaacttgctagcaatatattttcctaaaaaaaaactcaagcttctttttttttgtcctcgatttctttggcgtcatctcttgacatcttaatttttctttaaatttggtgccagctaatttccctcgatttaattttttttctgaattttcttttgatgccatcaggagagctaattttttctttggtgttgacgtgtgaagggggtatcagtacagtacgaaggcaatttaaggagccgtttggtttgggtgatgccttaaaaatgaggcctatttatttaattttcctatcactaggaagccatgtgctaatggtaccaagacagtattagtgctgggcgtgttgtaattgtggtttttctaggaccatattgtgtcctctcctaaaaaattgattatccataatggtctttgggacagaggaagctgtatcctggtatatatgtcgtgcattgcattaatgctttgccatcaactgaataagctagcgctcaaatgcgttggtcaccatgtaggtaatggagtgaaaacagtggtttgcaccgagcacactgcttcttgagttacgagcagttactaaaatttaagttttaaaacttaattttggaggcttttcatcaaaaattatttttcagtatcagcttttaagaacaaaagaaaataaattctatagattaatttttgttgtttcgtttatttcgtacagcttatcattcatcgcgtaaacaattaaaaacgcaaatatagaaaatgacataatatcaaataaatagaaaaggtgagactttgaactcaggcaatgtcttagtagagctagctggaaaacctctcgacgtttttcaatgcataaacaatctgagactaggatttgttggaatggctaattttctactgtaaaaaacgagctaattctcctttgccgctgcaacttacctctcacttcatgacaaaccagcgacctaatatggaaatttttttaacactctgttttaaaaggatgatgtcctaaatgcatgcagtcaaatcttaaactcttagaacattcagagattaaaaaacattagtatttgatatggaaaaaatggtattaatatatttttcataaaaaacactatatgggaatatttttaacaagttttataaacatataactagaaaacgtaatgatgaatgaaacatatacattagagaaccatgtccatgtccatgtccaaaactaaaggtaaaaaagaatagaggggtatcattgcattctagtgacagttataatctttttttttctcatggataatttattgagcaatgaaaaacattagcagtttagcatccagttagtaatactttttttttcttattgttgtttgtcttttcctagcatgtttcttcagaacaaaaagatgctacttttcgcttaaaagaaggggacaaaagacca

SEQ ID NO: 72299 - DNA, 3920 bp, Oryza sativa
tggaaatagacttgagtagttaggtttgtacttgattcgtcctgattatatgattttgtaagagactactaagtacttccaaacatatggttacacaatctttaaatgcatcaaacaagatataaaggttcccaagacttctagcgggttctttattgggccccttttccctgatagggacaaatgggctttgagttaagcatgggttaatgttctacttcgtaagcaacataaccttgtcacaaatggttttattatgcttcatgtggtattgatgcattctttatgtagttaggtgcctggatgaagtgcaattgtaatttgtggattaacaaactaaggataatgttacgcaagtagtggcatttggacataatatttaaattgtaaatgaatgtagcacttaactgtcatgtaatatcttgttcttttattgctgtgtcgaggagcgatttgctcgctgaagttataagtgattctcaaattaataaattaatagctatctgacatggttctggagttttgcttcaaaggcttatgcctcaattttgttcctagatagttatattccagaatagcacactgcatatagaaagaaccaccattaacatctgttaccccctcagttttgcatggttaacttgaatgttttgatagtgctgatctctatagctctgttgaatgtttttgacttgcagttttccagaggatagaatgtaacatatagattttttttcagaatcctgtggtatctcattgttaaggaagttaattcttatgtaacaggtcacatgtttgatttccactttggtggcttgagagcatactctagttgtctgaatcaagttctctgaaagagagaccggagatgagagaggagggaggaattgcttctccggtacaatcattaaatctcttactttttctgtagactatttaaaatttgaaattatttgtaagtgcttgcggaaaatactctcattttttctgtgtctggcaaaaccagggcgaaaagcctattccgaatggtgcttccccaaatcatagccaatcacctaaaatttgctcaagaattacagataatgagactcaaggaactgcaacagcaaaatctttaaatgaaaagctagtgttggaaactgtgtcagatgattcttccacacagcattgtcagtcaccacagccagatgtcttcacaaatgtcaaagatgaagatatgcaagattctgtgaagagtttgagtgagaagcttgcttcagcccttttgactatcaatgctaaagatgacttggtgaagcagcatacaaaggttgcagaagaggctgttgcaggtaatctttcttttcactatgattttagacattttgcattattgtgatcccatgcatttattgagtctgtggcttcccttcattattcaaaattaattttatatgtgaggacatcaatagaactaagaaagaggaaactcattcaaatagttctttggcaaagttaaaatagtagtatcaaccaataattctgtttgtctgcacatgcgtgttagtgtgtgtggagtgagtgtgtcgtctgtctcctcagttgtaccttctcaagaaaatcatagttttatttattccaatatggaaccaaattcatattgaactttatttttgacttacttgtaggttgggaacaagctgaagctgaagttagtaccctgaagaggttactcgaagcttcaactcagaagaatgcctctttggatgatcaagtgaaccacctagatgatgctctcaaagaatgtgtcaggcagcttcgccaagctagggaagaacaagaggagaaaattcgtgatgcagttgctaagaagactcaagaattggattctcacaagtctgagctccagaaccatatttatgagctaaagcagcagctggaagccgctaaattagaagctgccactgtggctgtccagcatgatctgcaggataaacttcaggctgcagagaaggaaaacaagggcctgaagatcgagctgctcacgctagccaaggacttgaagagactgtcactggaaagagatctgagcaatgaagcagcagagacagcaagtaaacaacatttggaaagtgtgaaaaagattgcaagggttgaggcagaatgccgtaagctgcgccatctgacacgaagaacttccttggccaatgattctaggcctgcgcctaacaatgcttgcatggaatctctcactgatagccagtctgacagtggggagcgtatgctgactgttgacagtgaaatgagaaattctgattcatgggcctcggctctgatagccgaacttgatcagttcaagaacagtagtgccagctcaagagatgttgtaaacaatcatgttgagattgacctgatggatgatttccttgagatggaaaagctggctgcattgtctgaagtagaacgtgtaagctctagctttggaacagaaactgattctgaccaggctgtggctatagataaagcttcaaaagtcgaaactgaaacactaaagagccaggtcacagatttgcaggcaaaggttgaaaagcttgagactgagaaaagggatcttgaaatggcccttgcagaggctagagtccagcttgacgcgtcgtgtgatgccctgatggcagccaacaacaagttggcagaattacaaatgcagttcaacttggcaaatgagtctaaaattgctgctttgggacaagctgatcagttagatgctgagagaggatctttggcattgcagcttgagtcgaagtcaatagaagttgagaaacttcaggcagttgtggcttcgttggaagaaagtacagataagaaagagctggagtcacagttagagtcaacttctgtagagttagcggatctttgcaagacagtggcatccttgcaagagcagattgatgccgagagaactctgtctttgcagcacaaagcatatgcagacatggcagatgcagataaaaagtcactagaggcacaactgcagtccgcacatgcggatatcgggaaactgaggggatctattgaaacactggagagcgagttgcaaaaagagaaaaccatgtatgaagaacttgtggtccaaatggagtcaatgaagattgaatcagagaaaaaacttggcgtggaatctgccaaagaagcattggaggcacggctcctggtagtgaactcagaaattgcgaaactgcatggaacagtgaacgatctggagtgcgatgcagcaaaggagaaggcattttcttcggaactgaagatgcaactagaggcagtggaaggcatccgaaagatgttggagtctgagcttgagagttcacaccaggaaaccatgaagctccaggagaagatctcattgttggaagtaagacttaaggaccagactgcattgttggtagaattcactgccaaggccgaggatgcagcggtgggaaggaaggcaatggaaggccaacttgaaggagctaaactggaaatcacaaaacttacaaatagggtaagcttgctgcaaggtaagattgagcaggagaagctgctgtcagaggagtacgaagcaaaatgccgcaagttagaggctcagctgtcaagagacagtcgggaggcaaggctttggcgactggccaacacaaatggtgacctgaaggtcaagcaggtagtctttttatgctctctctgctgcatataaactggaaatttaaccacctcactgttataacactatagggcttaagagttgcaaacatcaggccaaaagtacaaggattctatctcctatggtccaatctacttgctagttgcttcgcttgaggttgtttggacatccaaatggccatttcttttgctaagtgtatgttataaaaattgctaaaatattgaacttgtaaactcttccaggg

SEQ ID NO: 72300 - DNA, 7002 bp, Oryza sativa
cgcgtggcgagctctccagccttggacctgggaaggggaagaagaggtgcctgaagtcctcgtctcgggtccccgcacgcaccggtttccctagtgcttcggcgacggacggtgagggcgactgtagggcaggggcggcaacaatggcgcggtggtggcgacgagggaaaacgaatgagggagatggggcgactgctgttttataggcgcggggtggggcatcgaggagaaggaactgacattggggcggtcaaggggagcgagctggcggtcgtgctcggagctagcggccaaacagcagtggaggtgcggtggctgaggttggaaaaagagaaaaagaagggggaaagaggagcttgaccatgccgtttcggggagggagagaagcgggagcgagagctctggctcctggttttggacgggtgcgggtggagcggcttgggcacgcgctgcagagctccatggaacgccatggataggtaggtaggtcaatcgatggacatacatatagttggatttgagaaaccgatagttagttcgagtaggttgatagagcgataggtagataggtcgatggatagatagatagatgggtagatggttagataggttagataagcggatagatcgatcgatggacagggaaggattcagggagggatttgacattctccgaatccggagaagtattggccaggaattcaaggaccggattgaattcccgtgtttgatttccgaagttgaatgggaattggaatcttcgggtggaggattttgatggcgatgagagggaataacaggatttcaattgagatgcagggcatgacttagactcgcactcaaagaaagaaaattttcgcaattaggattttctcaaactagtttttaacgtctcacgaaaagcggagcgttacactctctctcccccactcacttttctctcccacctctcccctcctctcccatttttccactcctcacatcccgacggtgggctcgagttggcgacgacgggagcgggagagcagtggtgggctcgtgcgggcgcggcagatcctgtgggagcgcgacggcgggtgcagcgacggcaacggcgaatccggcggtatggagggcgacgacggctgccttggcaaggtcgggggatggcgatgccaatgaggagaggcggtaaatgggattgttggaattttttttcacgatttttattttcgtgtgcggactacataagcaccggcacacaaaaatccgattttcccgtgtgggtgcgtcacccacatggaaaaatgggttttgaccgcatgcaaaaatgttttttttatgtagtgttcctaaatacttcttcatgtgattttgaggatagattgctacctaatgatttaattatgataagaaactatggagaatactagcgagagagaggttaggagatggataaggtcacacaggcgttcaagtcaagttggagacccaactcatatcaagttcgagtctacctcggctccaagagtagtctgtgctaaaaacatcgcctaggtcatgttcggactccattttagacgttctacctatgtatggaaaactaacaagaccacctttccgatgggtttggtcttccttcgaagtcattggggatcgtcaaaacaagtggtgtccagaatctgtccgagtgctgtgtcaccatctttttgtaccgttgggccatgtatcgtgttggagtccaacagggacgcatccaggggtttttgatcgaccgtagaacctatatattcagtagttgttgtcgagttagggttgggttttgcttagattatttttgcaattgcagtttcaccgttcatcggtttgtgaaaccccgacatcaagttcttaatcaatcctctacatttgtgttgcaatattcttattcttgcttgtgtcttcgattcgcacgcaaggatagccttctcggcgaggtcaatcgggtttggcatggttaataaccagaggagacgtggtgctgctattacatggttcatattatgttaatcgaaagtcggatcgtgtgtgccaagattttgccaattcgatagatctctacttgacggaagattgggcaccccattatcattataaacttttcccaaattactttttgaacaaaggatagaaacaccattgaatctatgaaattcctttacaatattttttgctgatccatgtggaaattttggaggaaagtcacgacgccgcccggttcaacctcctgaaaaatgttttcctttgactttattaatttcttgattcctgcatctatctgcggtctatgtatcatgtatttttcttgtattttgtacttctttgtttttttcttattcatatattttatccctgtgttcgacatgggcaattcttgataaaaaaaatgcatatgaattttctttgaagcaattctacagaggactttgaaagcctcatgctagatcaattcctcaagaacattgtggagaaatgttattcctatgctatgaattttatttaaaatggttgtctatatccacgtagatgcatgtagaaactggtgggtttttaatccaagcagttttaatccacgagttttcttccaagcagttatacaaattaaattactcgcatataagaattatttttcattgtattcccctagtctttctcacaagccacaaaatgcttcaacccaaaattgggtgatccgatcccctctaaatcgacatgggctgtttgcatgttgatccatcatgaataatcacattctaaaccattcgcggttataaacaaccctacttcgtttttgaaaacaacacatccaaattaatcgaaaaaaaaatccaatcatacaataatgtgtttttcctataccccatttatgacacaggcgagttgaaagtagaacccgcctgtgtaaacattggccaagggatggaccaatgggccacctgtgaagaactaacttagaacacacaaacacatagatctacaacaaattatgaattatatcgagcaaaacctctgccccttagttggtcgagcaaaacaaagcccctctctattcttcccaattgagctggggtgtgagagggaacgtgcatatatattatggacctagttttcccgattgagctgttggttatgtaatagatccaacacctgtaagctcataaatatagccgtgccagggctacttcataccggttcataactaatattggcatatataagtcgtgcaagactattcaaggcccttatatatgtggaagaggttatggaatcgaatccctcacatgtatgtgatctgtgatttttttttctttcctcgcttgcatgaaacttaaagcaaatctaatagtttaaaattacgtgaaagttatatataaattacaatgtaattgtattataattgtactatatttacatctattaagtttttaagaggaaatttgtagataaatatgtaacaaaatgttacaccgttattagctcatgggcaccaaaaaaatcttgtggttatgtcatccgcagaaggctccatcgtcgtgtgtctttgatgtttgtaccaatcaattaaactagatgattcccgcgtgtgtttttctacgagatatataaataaatatatgttaaatgttgtataatcatgaatagaatggagtgaaatattttaaaaatgatttgaagataataattactatgatgtggtatgtttgcatgctagcttttagaattaataataaatactatgcttacctattgaattttagatgtttagtgggtcgtaactttatagaacgtagaacatatagataaccggtatcctaattaagttcaagttcaacatgtcatcaagagtatatatatattcattaaggtacgtggaattatacttcctccatttctgaatagataatgttgttaacttttagacgtatatttgactattcatcttatctaaaaaatttattgtatccatctcatagaaaacaaacttagtactagaaagcgtcgatatagtctatactagttatttatgggagtgtgagctagtatgtaattataatttattttgttgtgagctttttatcgctaaaagcactttacacatgatttatttcttagatatttgcgaatggttaaatgtgtatgaaaagtttacatagtcagctattgaaaacggaggaattatgggcttgtttagatcattgatagaatttttcaccctgtcacatcgaatgtttggatgtatgtatggagtattaaatataaaaaaactaattacacagattacgtgtaaattgcgagacggatcttttaagcctaattgctccatgatttgataatgtggtgctatagtaaacattttctaataacagactaattaggcttaataaattcgtttcgctgtttataagaggaatctgtaatttatcctgttattagtctatatttaatacttcaaatatgtgtctgtatactcgatgcgacacgccaaaactttacaccacttactccctcggtaagaaaaaactcaaacctatgactgattatgtcatatcacattcctaggttaatttttttttaacgaagtgagtatgtttttacgctgacttctaaaaagtgagacgcctgcgtacggcctgacggtagtacaagtactcgatagaaccgtcgatcgtaaattattgaagagtgaagaaaaaccccgtgcactgcaattaattgtcgtgcatccctccctgccattgcacgttgccacagcagatggtccggtcggtccacctcccctccattggtgaatgacaagggcacgttggtgggtgaagtgaactgagtttatcgtaattatttgagggcctaaaaagaataataaaatttcacttgaaaattaatgattttgatttaagaaaagttttaaaaggaaattctaatgaacaaacttttttttaaaaaagtatattatttagaagcttaaaaatggtgactccgataatacgctagctagctattcccttaaaaaatgccctattatttgatgttcaacttgaagcatgcaagatatgcgggccgggcccaccaaggcgtgctaggaagaaaaagcatacaggtctggttccactgcagtaatgcagaagttcactaatagtgaacctttacattactgaggggatctggattttaagcgcactttattacattagataatatactcctccgtttcattttaaacgtagctattagttttcatgtccaaatttcatcgtctattttatttaaaattcttttatgattattattgttgttgttattagatgataaaatatgaatatatatttttttaaaaaaaaattaataagacagacgattaaaattggacacgaaaacttattgttgtgtttaaaatagggcggagggagtatatcgcaaaccgatctatcgtcggcggaaccagaatcagccgtacagataagtggcgctggtcctggtgacacgtaaacgaatatcgtggagaggcacatccatgggccatgccacgtaccgtcccgtacatgcatgtgcacctctggcgacattgtgggcacctcctggctcagaaacggaacatgctatactcgatcgatgacagttaataacgtgtggggggaagaaacgtgttacctctaattttaaatagtgaatttttactctctaaacctgttcatctatgttacccatgtttctaaactcttaaaatatatttagagtaatttttgttgaaacccttattttcataatcaattatgactttaccttttttttccttctatatagccatatttacttttagaggcaattgtgtctctgcccttgctttacatctcaattgtgattttacccatactttttagggtttgtgattttgcccatgctttttttaaacagggtagctgcctgcccctactctgttaactgatggtaacggtattaaatgtgtggtgaatggacgagtatacccctgacatgttttggcttgcacaggatacatgtttcaagttaattttgagcaaatttcatatgggaaataaatgttcacaaattttgtaaaagttgatagaacacaatattttggataattttgatagaactttcgcaataatttgaacacagtttataaacgatgtcagaacaatatttttgacaaaattttgacagaaattcatcaataatttggacacaaattatagaagataacagcacactatcaaggacaaaatttcagcaataatttctgctcgctgcttgctagctcgctgcaagcacacttcctgctcgttgcttgctagctcgctggctgcggggccaccggccgtggcgtctccctgcgcgtgcaacaccgcggggccgcgccgacacgccgacagagccgcgccgctcctttccgacgctcctcagtcgcggggccgccggccgccgcgcctccctgcgcttgcaatccgcggggccgccgtgccgacggaaccgccgctccgcagggccgccgcgccgccgcgtcgacggagccgctgctcctcggggccaccgcgccgcgcctgcccacgcccgactccaccgcgcgctggcccgagccgccgctcctccctgccgcgcgccgccgccgcttgcaacccaacaagctaggtttttcgattggatcggggacagcaaggtttggggatttggttgtttcattgaagcaagggtagaatagtcattcacaaattataatagcattttctttgggtgtagctatatttatggggccatatttttcatgaaaaaatagtcggcatgtatttacattgtaagtccctaaattacatatgtaattttagtgtatttataatgtaagtctaagtactaaaattacatatgtaaattcgaaaattacatatgtaaattcgaaaattacatactaattacatatgtaagtggggtgtaaatgaggtgtaactactgtgtaagtggctgaaaaaa

SEQ ID NO: 72301 - DNA, 7489 bp, Oryza sativa
cagtttttatatatcgtatcaaccgccaccgctctactcctttataggcctgttacttgaattatctcatcatgtgttttaaggtgatcttttctttcaatagtatttattttttttcacgaattttagttatttataaattgtattcctaattgaaatatttcctattttttttcaaatttcagaatttatttttttcagattttaattaataccatatagtgttcttttaatattttttttaattttagttgtttcaaaattgtattcctacttaaactctcttttagtttttctaattttggatattattttatttttattttgaatattaatcaatctcgtattgggttcttatatagattcttctttcaatattgcttatattaaatttcgaattttaattaattttaaattgtatttctacttgaactcttcttttaattttgctaatttcggattttatttttatttttattccgaatattaattaatctcgtattgggttcttatatggacccttctctcaatattccttatttttaattcatattgaaatttatataaatattcatattgtattttatgtacgtgttagttattaattatttttaatatcaacttttagttatttctaaattatattcctatatggactctagactcgtctttcaatattttttttaaattccatatttccgttatctgtaaattgtatttctatatagactctaggctcttattgcaatattatttatttttaattctgaatttttattatttctaattgtatttctatgtggactctaaactcgtctttcaatattctttaatttttaatttcgaatttcagttacttctaaattgtattcctatattgattttagactcttcttcccatgttttttttaatttcgaattttagttatttgtaaattgtatttttatacaaactctaaactctacttttaattttattatgtttattccgaattttagttagttttaaaacttttattatgtttatttcgaattttagttagttttaaattcctatatggattctatactctacttctaatattccttatttttaattccgattttcagttatttctaaattatatttctatatagactctgtttttttttctccgattaatatgagaatttctagaccgtgggagcgaacatggagacttttttttatttctttaataagttaatagattaggtgcacgaaccgattgccgcatgagatttttgaggttgtgtgcgagctgacaactctgttctgtcatgtaagcgcgttgctcgagtggaccaaacccaccacacattctcaaacccgttagccagagatcaaaatctaacataccctgcatcttaaaatggtttttgttaaaatatacaaggagaaattgaagaattgcggtattatttcagtacagcacgtaaatagtaagaccccttcccactttatatgttgtgcgcaatccgactgggctgggccggagataaatgtgcaattgatggctgatttggcccaaggatagcattatcaacaggaataagttcatatgagatctcttaacttgttagcgaatccgattttcgtccttcaaccggaaaaccggatacaacaattcctcagctgtcaaaaccggtgcaaaataagtccaaggaggtttggatggcgattacagttgatgtagctgctatgtggttaattttactcggtcatcctctaacgtggcattgacatgacgcttacgtggcaatttgatttggaaaataataaaaaccctgggcccacatgtcagtacccaaggggggtgggcgaagcatgcaggggcagcaggcgagagcggcggtggtagacgagagtggtggcggcgaacgagagcggcggcagcagctgctggcgccccgtcgccacccaactccggtgacgcctgccccctgctccgcttcgtgaggagatccacattgacctgctccgcttcccggggcggcgcgaacactacacgagcgtcggccgcgcgtgcccaccattttgcgcgtcatcccctccgcctctcgccgccagcgatgtcatcgtgccagccacctctcttccctctcccacgacaacgacgacatggggccagataaatggaggagcgcgaccggcatcctctcccccctctcccacgacgaccacggtgacatcgacgagaaggcgctggggcagcagggggatgacaccgatgagcaccctgatcccggtgctgccttgtcgccccgccacccctgcctgcttcgcctgccacacgctcgctcgtcgtgctcgcccgctgcccctgcttgcttcgcccgtcgtgcgcttgcccgccgccgccgccatatacatgtgggccccgcatactttattttttttttatttttctgactgggatgccacgtcagcgaaatcaggtgtctatactcttatagacctaaattggacgcttttatacagtctagggatgaagatttttgatattgaggataagggatgtaaaaaaaaaaactcggtgtaaagttgagggacggacttattccccgtaaaatatgaacatgttaggctcgatttaatctcagcccagcccatgtaagttttacagattggccgtctgatttgacgtgattttcgatgcaggcatcatcggcgggcggtggctcaagtactggacggaggccggcgcggtgctctcctccgtcgggttgttcgaagcgcagctgagcagcggcgcgttccagctcctcggcatggcggagctgggcctcctcccctccgtcttcgcccgccgcggccccggacgatccgccaccccgtgggtcgccgtcgccgcctccgccgccgtctcggtcgccgtctccttcctcggcttcgacgacgtcgtcgccaccgccaacctgctctacagcctcggcgcgctgctcgagttcgccgccttcctccggctccgcgcgagggaggagagcccctcctcgctcaagcgcccctaccgcgtcccgctgccgctccccgcgctcgccgccatgtgcctcgtgccgtcggcgttcctggcgtacgtggtcgccgtcgccgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatggacgacgtgtggccgtggctggccggcctggccggcgaggagccgccgccgccgcaggccgttgtcgcccttgccgccttcgctgacggcaccacgtccattgtcctgcaggccgaccacgtcgcattggctgaaggtgatgaggaagagaagactctagtagatttctctctcgccttgaacagcaccaatggcggcgcagcgcgcgtgctgtggacgtcgggtcgatttgaggccgcctccggtgtcgcgttgcagcggcagctgctggcgaggctgctcgacgaggtgatcacgctctcgccgtccgtctcttgcttgagcggaaacctcggactcggagtcggcggcgcaccgaagtcgaagttggacgaggagatcgtcgccggcatcgggaatgattctgccgcctcattcttctcgctgactctccttctgcgcctcttctggctgtgcgccaccgaggcacccgccgacaccgggtttctcttcttccaagctctcggcgccgacatccagcgcgctctcgtggactgccgcccagcgctcgccctgttcctggcctccctcggcccggacgtcgaggagcggttcatgcggtcgctcggctacacgctcgccaagctgtgcttgctacgggagatgcaagcggatgcggatcagccggcgccggcggcgacacggcgcccgcgcgcgctccccgcggtgtgcctgtcgtacgccaccgaggtgcacgggctgtgggttctgagaggatacgcgccggtgctcgccatgccccgtgtcacctgcgcggcatcgacgacggcgcccatcacggcgctgccgcacgaggcgccggaggagccggcgctgaggtacggcctggtgcaccagcagctggaggtcgtggcgcagctggagtacgccgtgcgcgctcgccgcggcgagaggttcatgaccgtcgccgtgcgcgtcgacaacgtccgggtacgcgtcgcgcggctcgggttccggagggacgacgcggacgctgacgccgacggtggcgacgctcacgacgacgccatggacggcgagcgccatttcccgtcccgtctccgcctctgggtcggccctaggttcggcgcgtcgtacgcgaccggcccgagcctcggccggtcgacggggaacccggagcaggacgtcgagacgacgcgcaccgtcaagggcgccttcgccgccgccggcgccacgaagctagccaacggcggcgtccctccgaggatcaaggccaagacgcggtcgtcggcccgggcacgcaaccggagctggcggtgggagcaggaggcggagggcagcgccggcgtgttcgagggcgtgctgtgcgacccggccaccggcacggagatctcggcgtggcgcggcgacaacaacaacaacaatggcggcgccggtgacccgcgcaacgggatgcggcggcggtacggcgggccgggcagggcgttcagcaagatgcgggggctggtggtggccggcgacgagctgcccgaggaggtgacgtggagggtggggagggaggcggaggggagaacgctgccgtggcgcgtggggctcaaggcctggttgacctaccttcccaaccaggtgaggagccaccatttcgagacgaggtgcgtcgagtgggcacacgaggtcgacctcccgcttgccgccgttaatggcgacgagaggtaaaaaaaaaaaaagaaaatctctctttatatcacctatgaacacatactagccaaaagaaatgaaatgatcttatgcacgtattgtgtatatgaaatgaacagctaaaataagaggttaagaatctaaattcagatgctgtccatttgcaccgatttttctttttttttcttttttttttcgcagggcatttgcaccgactttaagatagatcatcttaatacctgatcggagaccaaatcgtaatggatgcaaaactatttctataagggcacaactattataccgccgtaatggtataaccccccatttcaaatgctcatgcgtccactcactctcccactccatgcgagcacgcaactcccgacacgtgagcgcctgacacacgccatatgcatccattatgtgtcaagccatcttgatatgtatttatcgggctgaacctactagtcaagtttggttggttctagagaccaaagggtgggaggtttcgactccattcggctgggctagttcggttgttccatctagctcttttctcattatcaagttctcaccacacatatattcatagtcttgaccagtacatgtctatgatacttaattgatgcttaaaagtatcatcacatatataccttccaaatggtactcgtgtcgagcgatactagtcggcatcagacatcatcccctgatacatatcgataccaagactatactaatcagcactaggtccgataacgtttagtaccactctttgtaccctctattggtaccaggccggtattaggggcctgtttggtagagctctaactcctaaatttatctccaggagttgggtctaaagtggagttgtagagctacctaaacctaactccatctctctagttcattttgtgagagacctccacccaagcccactcccattttaggtggagctgaaactgtttggctgagctccagctccagaagaggtggagctggagttggagctgtgacaaacaggccctaggtctaatacccatcgatgctacacatggtactcctgatacccatcggtactaagctaataccgatcggtactaggtagagtatattggtcagtacaaacttgttacccttattagtaccatgtcgatatcgggtctgatactcgtcgataccagagttactactcctgatacccgtcggtacctatgtgataccaattggacccagtctaataccaatcaatacaagacttagtagccctgatacccggtgatatcagactaatacatgtacgtataaggtttgatacatatgtactagcctaatatttgtacgatattaggtcctatatcttaggacaaagatatgaacctgggatcggaaataatatgtatataccaattgaaaaaaaagaagaaatgaactctatatagcaaaagaagtgaagaaaaatgttcacttttacacttgacaccacttaagaaaagagtatataaattaaaaagtactagctataataagttggcaagaaggtcactaagctcagtcttatcgcatgattagggtaatggttttattttttccgacatctttctcttttcttctcattttgttttgccgccccaacatctgcagtgaacagttagacagccatagagtaggctgatcgatagttgcacgttctgacacatgtcatctgtaccgaaccacgtgcaaagttactaaccatatatagacttgtgtacccacgaagtctgtatgcaagaaggaatataattccataagctcatgtagtttcttacattaaacttttacagtcagtctaaaagcaagtttaataatattgtcaactaatatctttaaaagttaacacatatcatctacagccaacctaatagtatgttcactcatcaatagttagttgcaggcccggccacaggagaggagggggagggggttgagctatgccaccgcacagggcccacaaagtgaaggggcccaaccccatatatgctgtatataatagcccatagaaattaggaagcctat

SEQ ID NO: 72302 - DNA, 633 bp, Oryza sativa
acatcattttttttatctcgtttaataattttattgcctttgaattacatactgtcttaggacatccacaatagcacaatgtacactaaaaagtaaccataagcaataaatgctgctatagtacaacacatttaacattgtggagtcagaccacaagtcatgcaataaaactagactttaagcttaaggtgtggccacaaagctacaaaatataatacttgtaatgtttttctgttcacaccaataaaatatacatgtcagttactacagatagtaactacttctactagccgttggtgctctttcatttgagttgctcatttgctttcctagccattggcttcttacaacattcttgtgctacctacgaaaggaggcacaagtgagatgaacaacatattgatccattcagttccctagatactaagtggagccttttgttaagccaaacaagtaagcaacaaatagtgatgtccaaaactccccattctacccaatttcccacaagttatccctaaaacttgagacctagttttctccaaaatttccatccttttggtcctctaagcaactaccaactatatggacacccttccatcttttaaggtgctcaccaacaagattattatgcgc

SEQ ID NO: 72303 - DNA, 672 bp, Oryza sativa
gccattactcaaaaaagcatactggatgggttgcgaataaggcatagggtataacaaatatatatataagtcttcaagtctattgataaatattatataaagctcacttggtgttaaacaaaatgtatatgtaattcattggaaattgttccttttatcttttggtacagctaaaccagcaaaggcaaggtgataaacttgaaaactatcccctggttcagttgaaaatgttagagcacgcagttacacacttacactagatgggcttgagtcattcaatataaaaaaaaaggaaaatgccaaacgggacaaagaaattcaggacaacacgattctttgaagaagctcccaatttccagaagaatttaattccaagcatcgacttttgacagaggagtgaagcaggaagtgaagtactaaaagattggcgttgcgcgaatagcaatgcagtggtcagtgtcgacctacaccatcctatgatcctatcctagcatcttcttaatgttagcaacaataagaagaaaatgaaacaatcctctatagattttacaatccatatagtatcttctaacaacgcggataaccaccctgcatcattaacgatgttacgatgcgataaaaagaagacacacaggacgcgtgtcgattaataaaagagagttgatatctctt

SEQ ID NO: 72304 - DNA, 536 bp, Oryza sativa
aattcgagctcggtaccccctgaaaaagctgcacatgtcttttttattgtcttttgcacaattagttggtttcacttgtagggatgctaatgcctggaatgctatttcagtgtgatttaaacattattttacaaaggttgtgggtaaaacaagcgtttgtatgctattagttgctacagttcttaaaaaaaatacattccactcctttgaccttaatcttccgcatgctttcttatttgcttcagtgaacctaacggccctcttgaaatgtgaagtctggttgtgttggcaactctgactaactagcttattaatcagcaactattcttttttaatgttcataaatatatttgttccatctccccaactattcttttctgatgtatctctctacttctgcagtgctgtcatgcttagaaattcaacaacccgaatctctgtccaggaccagccagagtacacaaacgacaaattgatacagatccatgtcttacaaaaatattaaaataaacttacaaatgcagcagaaaataaaa

SEQ ID NO: 72305 - DNA, 11709 bp, Oryza sativa
  unsure (1)..(11709): unsure at all n locations
gtgcatcttgaccttttgcttctgcattaaagtcgcggaaacaaagcatactgaaattcttgatatttagccaatctgaaattctgatttctttcgctttcatgtgccgttgaaaacttacaataactagcgaagacaccttgcgccattgagaatctagtaatgtgtcattttttttgataattggaaggactgtactacaatatctatttgctacgagtattaaagtgtagatagtagctaaattatcgaatcaccacataatgagttgctaatgctgtgtttgaggagaatgagatagacgagattggaaatatacgcaaaatgaggtgagccattaacgcatgattaattgaatattaattattttaaattttaaaaatagtttaatatgattttttaaagcaactttcttatacaatttttttttaaaaaaaacatactcgggaagcgtgcgcgcggaaaacgaaacacacaaactcacaatgttacgctgctgaacgcagcctaagggtccgaagttagtttgatcgagttagtgcattcacataaccgattaagacacctttggacccctcacacctcgtattctgtcactttttgataacctaaggtcgtgctcgatgatgaacagtatgtcacttttagatgtatcaatcaactatttatcactggacccacatgtcatagacacatgtgaacccacgtatcattgagatagatgtgacaaatagttaattgccaaatctaaatgtggcaaatagttaaaagcgggggcgggttcattttccttccttcttcccctgagactgataggtggggcccacatctgtcctctaattctctccacccttctcgtttcggaacgccgccgccgccgccgtccaccgccgcaaccagcccccaccaactccggccgttcccggcgcgtcctcccgaacgcctcagcccccacccgccagcaggtggaggcctgcgccggcgcgtcgaccccggctctctctctatctctgtctcacctagtcgaggcgtggagaatcgaacatggagtccgagggggggaagacggagatggtgctcgcggggacgtttccttcaagaaaggcagatcgccgacaagtaccccagggccagtcccgcggccgcagtggaagcacctncggcttctncttcaggccgncgacgccaccttccttccccccgaccgccccactgtaagcgcctccgatccaaaccaatcttccccccctcccccctccccgctcaattaatctgccgatttcttcattgggatcagtttaatggtgtggatttatctaccttgttggttgttgggcgcttgtgattgtactactcatcgaggatttgtgtggattcacttctataggtcaacgagcccttgttggcattgggagatttatctggttagggattgagaattcgatgctatgcattattcatgttaggcccttgtccagccaacggttgctattgtgattgcgcattagattgttcttatgttctgttgcaattttacaatgttactatgtgaataacttaatatggtttagatttggtggtaatctaatagatttttgaggctacggaagctacatgttcatatgccttgtcttgttgcgaaccgtccatctaccgtgaaaacgcaaaccaattggatagggttatcatcatttgtttactctcccaaataatctggataagcaatctgagtccgtgcaaacaacttggttctggaagcggattcttaataatcaaacgatgtttttctactgaagtccaaaagcaggtacggagctgcttttgtggattttaagcggtaatgttataacataagagtattaacatagatggtgcatttcattgtatcaaaagccaaatccacaatcagcttttaagaatcccccttgtgaaaataacattccagaagcaggattgtgagaatcaaaagcaaaataaacaggccccgacaatggtacaataaggatttttttcatacaaatattatgagagatttctagtttcagtacaaacatttctaaaatatttaatctaataagtcagcctaaaggtaaatgctcacctctacctcattagtgttaaacttttaattagtctgttaggatgagatgagcactaatgatatgggtgtctgatggcagcatgatcagcaagtgatgtgtatagaaattacaacaatattcagaaataagttatgttttacaacaatatgttcatcttaatatttttaataaatatagtactagtacatatgttgtgcatactggcattagataaacataggaacaggaacataatatttccaaaatgattaatgagtcattaagcaaagtggatcatttgtacatatcatataatcatgtattgctgtgttgttcaccatgtctaagcagatgacagaatttgtatctttgatcatatgattctggcttttggtattttgatggttgatattgatactagtattgtttatgataagggatatcatgaggtactatttttttttctggttgtgtatgagtcagcattgataggcaagtgaactaagaatcaaatttattctatgagatcataagatgtatttgtttcacttcttaacatcatgaggtatttattcttacatctcctgaaggagaagcgtgggctgtgaatgtgtcgtgatatgttgggttgtcacttgttacataaatgtagtaattaactttgattcagtttgatgcaataccatgctatgagaaatattaggatccgttgtcctacttatcattcttgcttttttataagcttttttttaataagcaagataattgggtaccatttcattaagaggagagaatggaaagggagcagtggccaccaacccggtccaaaacaggccagagtctttacaacacacgcaaaaacctcacctccgaggggctatcgacctctcacggaactcctttagtctagaagccccggctagcgaccacatgatacacttattggccactgtttggaggacagcagttacacaagggttaacaccattaagcacattgtcatttctatgcttcccaatctcccacagtaccaaaatgatgagagctaagtccgttcttggtgtctttgtcccttcctctcatcacccttgaccaccaccttgataaattggttgtatctggacctggggctatatgggccagccccatcctttggaggattataaaccaaacttgccgtggacacctcttatcttaattatttgaatggccattaatgttataaatcacaaggcatggctgaaaattgatgttaagttaattatgccacatattatcacttttccatactgaggctattgcatttgtctttattcttacattatggtgttttgtgcagatttgaatatccagtcgcccccatcaatttatccacccaagagatattgtgacataactggttttgaggttagttactttgctgtgagttcgtcttgttggatttgcatgttttcttgttattttgaatgttcattttatgctacttactactgagtttaaattgatctaaatatcttctgagctagatgggctatacaatatctcgcggtttagtaatattatcaaagtcgacattctttgagttggatctcaaatgctcaaattaaaatcccgtatatgattagcatcagatcaataatccacagaaaatgttatcacaatagacaagctacatgtctggagaattcaatcctctgtaaaggattacgaacacatgcatgtatacagcaacaaaagattccagcaattaaatcttttggaattgttaggaaaaaaaaacatgtggtagtgatagtacaccattgtcattaactcactctataggcgaagatatccaattaaattctatataataactcaaccttttgtccatgctatcatcggatccttattttccaccctctgaactttgaaatcctcaacctttacatctctctgttctaaaactgcctcagcatataccgtagtggtatttgcttgacgacagtcatcagtagattggatatcttccatgcctacttttccttcttattgttgtcaaatatcaaatctcttcctctgtctgtttaaaaaaaatacattctcaatgtgacctaggctaaactcaagtgcatagcttcatggcctctgagctccaccacaggtgcaattttccctagtatgtcatcatgccttctacatctctcctagtcagcaatccatgccacctcccaaatcctcttttgctcctgcaaacacaatacatttcttgattcatttgatagagttgtgtagtattcgtgttagctaaatgaggagctggcccttagactgatcctacatgcagctcatactgcaaagctgccatctcaaattccttccctgttgtgaacgcctcatggacataaatgagctttatttccccacctgtaatcatggtggtgcatatgagggtggaggatcgttgcttacattaccactgaatcatgtgtcgctaacatgtccaacatgagatagtatctcaaattctcaattctactgcagacaagttactgagcatgaaattgaggctgcctgagaggtactgagagcgcgagggagtgaatatggaattgctgttgttttcagttatcttgtttaaattgttactagttacctggctaaatcagcaatagaagatgacatttggagccttcttgttgccacataggccaaaactgtagtggattgggcttttaggtgtttcagtgcataagtattgttagtcgaacttagaagtccaattttggtcctaaatagcacttagttactactccctctctttcatattataagttattttgactttttcttagttaagcttctttaagtttgatcaagtttttagataaacatagtagcattttcaacacaaaataaatctattatcaaaatatattcattgttaatttggtgttttatatattgttaaatttttctataaacttagtcaaacaaaaaagtttgactaagaaaaaagtcaaagggacttataatatgaaatggagggagtattaggtgtccaatttctctacttagagagcatttaagttactgttttggccaggatacttcactgacattgaaaaatgttagagcatatgtgactgacatgacgtttcaccaagaatttcctgttctatcttgttagtaatggtttgtcttggacatcaacttatctgtaatccactagaagctttatttgcgcccaacaacgctttaatgctcacacctaatactccgctaatggggagcacaaaataaactgagacaaacattgataatatcacttggtcttgcattctctatttgctcttcgactgcaatggtgttttgtgtgcctatttcttgtgttgtgtggataataattgtatattttcttgcaggcaccatatgtggatccaaggacaaagctgcgctatgctgatccagaagtgttcaagcaaatccgaatgcttcctgatgaatatgtccaaaggtatctggcactgagaaatgctgccgttgtactgagataactatgcaaaatctatgtagaagagaaatggggatttgtgctcttgagtctgttggcaaatacatctctagatctagtgtgaatgtatatctacttgtatgcttgtttcttagcaaattgtaagagatgacttttcctccgtagtgatagctgacatcatggctggggacgttcagttcgtgctttatcgacgttcatgaattactggtaatctgttctcgtgcaccatagccgaaattactttctggattgccctgatctttatcaaggaatgcaatgacggatgaatgtgcatgcttcttgaccttataaacggtgcgcaaaaaaactttcgatatatcaatttattagagaaccgatttaaatccaaatttgagctttataatatattttcaaccacaaaaacaaatgcagttgcttgtatacacgcgtgcacacaatatctatacgagcatcttcaaaaaattgagctgacatgtttttaaattgactgttgttacgggtgtcttgctatcatcgactgttggtcattgacaaaatattagccgtaaatgtgagcaccgtgctaagcttaggacttatttaattaatttatttgtaccattatataatcgtcacaaataattcagctattcacccatttaacatgagaacgaagccaagcatacggacgggtctcatcttttcgattatacttatgcttatcaacaaaaatttgaattttgaaccttaaatttagagttgattttggtgttttttcatcgtagtttatttttcagcttttgtttttagatcgtttagaacacgtatataaaagttttattcacaaattattttttatttataaatataccgttaggcttattccaccaaacagccaaacgatgggcatcacaagatcatgatttgatgtacctaaatcctggtccattcatttgtgtggaattgaaattaaatcctgggttatacccacatggatgcattgatcaacttggatttgggttcatacaaatgatgtcttatctctgaatctctgatatcattgaagttaccgataattcatgtaattttcacaaagagcaattgatgggcataaagtgcctgagattttcttaattgcatgcaacatcatatttttccttcaagcaaaaaaaaaaaagaaaaaagaaaagaacagccaaaacagctctgcaaatgctgttcctataactgatgactgaacaaagtccgtacctatagttaccatggaatgggggcccacatgtcaatatcatagttttcttttctaaatgtcaactaaaagaaagattcgatgatattccatacctcaacgggtcccacctgtaagtttttgttttcctttttctgttaaaaatctcccccagagtcctctttcatacatactccgatttcgtccatcttctttctaaatccatttaaaatgaagtcggtaagcactaagcactgtagtatctagtattaggttggacacctgggctcactttggtcggttctttggtttttgtagattgtgtgtagctgtgtatgactgaccatgtctgtcagtagcacgagcagtacatgcgtgtgaaagacttttctagagctgactttctttcatttgttcttattaaatctaataatgttcatggtcaattcgaaagacagttactattattatcattacttttgctgttatgtgcagaacaggttgagatgaacgtattgaaaagctgcatggctgacataccaaatgattaattatgtgctttcttttgtttctagccccttttttcttgaaaactcgtcttttgcatcaagaaaccaagaaacctcgttctactgtaatagactttgtgcaacatgtgaacaagcaacagtgacatttattgtttattttttaacaggcccccgaatcccaatcaaatctccccttatccaaacatgtccacactgatgagtatattctaataaaaaggtagcaaggcaagaaaacgtgtaaaaaaaattcaaacaacctaagaaacaaggtcatctggtaaagtcaaaatccatcagagatcatacatgcactttatcttgaggaacatacggcaattgggacagtataccaactcaactgcttgagcaaagttttaccaattccgaagttactgatgatgtcaagtttaacgcctaccatgtttgtctatttaagtacctccagcgatcctctagtgttacattaaatgtacacctgtaccttcctgagaaggtctgaggtgttggttgctgcctggctgggtttatggtgagaaatctctctgtacttttacctgatattgatccctgtgatgtttttggtgatacattgatctatgctgtgtgatcgtggattcagatatattatcttgttttcatgatgaatgtttagttattgtttcttctttgtattgagtgttctgttctatttagtttattttgccagtaatctttgtttagacttattccttgactttaagccaatatctttttaaacttaagtaccctcccttcttattttgttaacttccatttattttttaaaaaaatcttgtgttgaaccagtggactaggtgatggacgggtcacacaacttactgtccaaacaaaattgtcctcagtttaatggttaacgaatgcttttgctaccttaagaacaacataaatcagtcactgaaaatttgtttttttgatggaggtctctgcaaatttcagtttcactatgtttttttgtttcttcttaacggctctcagctttcaatggttttatatttgtacctttcgttcccagctagcatgcaaagtttcacgtgggagcaagcaactaatgggctccaaagaagcattccgacgtatcatattctgcgtcttgcttctactctgtgtgagctgcaaatgcttaacctcagaggtaaacacaacccaactggcagtcctcaaggttgatgcctcaccgcagcatgctcgaaagatccctgagacactctttgggatatttttcgaggtactttagtttccttcccttgaaaaaatatcccagttcttaacttgttaagacttatcaagttttaaatacgaacgtttacatattcttactgattactttggtaaaatactgtaggagatcaaccatgctggagcaggtggaatatgggcagagcttgtcagcaacagaggtacttctactggcctgccattaatctcatctctagattgtgctgtgtgcctcttgaaataatttttgtcaagttattagatagtagagagagtttactacgtggtgtttggtattttggttgggtgaacttgctatggaatgcaactacatctataacaattactgacatttcaatggctctcttacaaaaatagatgagtattgagatcaatgcctatctggtccaaccgaggataaaagaggttatcgtaatggcttataaatacaagtgcatgctatgaagtatagaaaataatttctgcccagcactggcccatactataacagaattgttttctgtttaacaattttttgacatcgaaacttgagcataaactggaaacagcattcaaacaggcattttccttctgaagtttagttcaaccagctcatgaattttatgatacaggtttcgaagctggaggccctaatactccatcgagcattgacccttggtccataattggaaatgaatctgtcatatcagtggcaactgatcgatcatcatgtttcagtcgaaatatcattgctctgaggatggaggttctctgtggtgactgccaagctggtggtgttggcatttacaatccaggattctggggcatggtatgaccttatgttgatcagaggttgaattttcatctcatagctgtcgttttgcgaaatgttttcattaaatttaaccagaaaatacacagtttctgtttggaacttttcgttaatgtttgctttcatgctctcaagtaaggcaaatgtttagtacacattgtgtaatcctgccaattcagctggataatgtgaccttgtcatgtcaacttacagaacatagaggatggaaagaactacagtcttgtcatgtatgctaaatcattagaaaatacagagttaacagtttcactaacaagctctgatgggttgcaaaatctgtcttctgctaccatacagtaagcattctttgtttactaaaacggggtaaacttttcatttttacaattttcatcagtgtatagtattttgttgccatagagttgctggtacatcaaattggacaaaacttgagcagaagttggttgctaaaggaacaaacagaacctcaaggcttcaaataacaactaacaagaaaggtgtcatatggttggatcaaatatcactcatgccttcagacacgtataaggtaccattgtagtttgtttcacaggtattgcttgatacttcgaacagcaaacagaagagtgaacccaagtatatttcacaggtcaattgtagttggattcttcttttatccaagatcatataaaagctttcatttctgtctgtatttatttgtttgttaatccattgagtttgatctctttctagtagtcatgcttatgacgtatgccatgaggttatttccatatttaacttccatttctttgtatgtacagggtcatggtttccggaaagaacttgtatcaatgcttttggatttaaaaccacaattcatgaggtttcctggtatgtgaattattctttccatcgttgcacatatttgatcagacatattttggacagttaactagattgaagggaactattccaggaggctgctttgttgaaggccagtggttaagaaatgcattcaggtggcgtgagtctgttggtccgtgggaggagaggcctggacactttggtgatgtctggggttattggactgatgatggccttggatattatgagtttcttcaggtaccaattggcattatttcagctctacattttcttgattattccataatcatattttcctttgaattgaacatctaagctttctgaggatctgggtgctgccccaatctgggtgttcaacaatggtaattatttttgtgtttattgcatctttgatcaccactaccgtctgcctttattgaaataattttgcctcttaaatgtcaggtttcagccacaatgaggagattaataccacggctattgctccatttgtaaaggcatgttttgagctcccaattcatttttataccagcatagacatatcttgatgcagtgaatgaattccatttgtaaatacattggaaggagcaattctcacttttcctgtacatatatcaaggattagaaatagaaattttgttgctcaatcctttctgagacagctattatatatatgatgggtctgctcaaatgatggtagatgtttatccatcataatcaatattgggacattattaagatggttctttggtttatttacatgtactgcacaaattgatacaacaccttgggttaagttcagattgtttttttcccaaaattattaatggattacttacaattttttttctaaatttgttcatttttatggataaaagttagtaacaactaattatctcaccacacgttgcccatattttccccagacttggataagttataactgaggctcatatcttttgttattgtcttttctccaggatatactggacagcctagaatttgcaaggggaagtaccaactcaacatggggctctcttagagttgcaatggggcatcctgaaccatttccagtcaaatatgttacaattggaaacgaagactgtacaaaaaaattttaccatggtaaatatatcagttagtttcttatggattaaatctatttcccactacaagttgattatgtttatgtatacaaggattaagctcattctttgtcaagaaaaaggaaacataaataattttggtataagcagataagttactcaaccttttcctgtagtttttaaacacaaaatataaacacctatttttatgattgggcatattttgcaaaaaaaacatcaatacaagaattttttttt

SEQ ID NO: 72306 - DNA, 878 bp, Oryza sativa
agcgcgcccgcgacgtggtggaggtggccgatgacagggagcgcccacggcgacggaggcagccggccgccgccgccgccgccatgccggagcgaccaacgggtcaggcagaggaaggggacggcgaccagcagagcaaggagaagtagatagagaggaagctcggccatggtgatttcccgtcgcaattcgtccgcacgtgctagcgtgttgtgccggtcattactcattaacactcatcgggttagagcaagtttaatagcatcgctaactattgagtattgactaagctaacatgcatactatatagtatagattatttttttcctcactatctttactctttactacttaaaaaattcgtagtggtgatggtgaagccaacgtaaacatacgtatagacaccacacccgcgcctccccctctcacgaccgcactcgcgcctccccttctcatgcccgctcccgcaccagctaaaaacgccctgcaccgccgccacgaccacaccgccgtgccgctccgccgcccctctgacgcctgccgccgccgctccgtcgcaaataatacctcacgaaataaactcataaatataatagtcgcatacaataaatttatacactccatcaatatactttataaatttatattttcttgatactagagggtaaaatagactttatgatgtgaatttaacggtcaactaacggtcaattgacggaaggggtatagaagtgatccaaactgaaatttaggggcatgggagagaatgagcaaatctcagggggtatagaagggattaggtgaactttcaggggtacacagggaattttctctttaagtagagtagggtggttcaaacagatctaaaaaatacaagt

SEQ ID NO: 72307 - DNA, 1432 bp, Oryza sativa
tcctgcagccctgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaatgccttttgattatcgtcacactgtgacgattttaaaatcacacactgtgacgatctggataaaaccgtcacgagttaacgggccaagaatatccactagtgcacgtccacgacggaaaacaaattatcgtcacggattgcctctgtcagtgacggtttatgaatccgtcaccaagaattcgtcatggattaacaagtttcttgtagtggaattccaagttctctgtcggagttttaacacgctgatgctacaatctgaaagtcgttgtcgccaccgctggtgagttactcattcccctccacaaattcaatgctaggttaaatatgttacatgatgacaaaacccagtaatttaaaagttacagataacacttgaaacatcaccaaatgagagtatgagtctgtatatatactgatgacatgatgacatccagttgatccttctttttttttctgtatgtcttatccatttccaaatgatactgtagcaatctatcgctcatggtctcggagcggcacacgcaaggcagggacaagcaggaggtcggagcaccgccgcgtggtgagccccaacgcctccgtcatgtccagctcgccgggaagcatcccgccgggcagctcccagtcgaagtggtacaggagggcggcgagcgcgagctccatgttggccagcccgaacgccatcccggggcacatacgccgcccggcgccgaacggtatgtactcgaagtccgtccccttgaagtcggcggcgccgacgccctcgaacctctccggcgcgaactcctccggcgagtcccagtgcgccgggtccctgccgatcgcccacgcgttgacgagcaccatcacaccctccggcacgtcgaagcccatcacccggcacgtctcccggcactccctcggcagcagcatcgtcaccggcgggtgcagccggagcgactccttgatgaccaggtgcaggtaggggagatcgcgcaggctctcctcggtgacgccgtcctgcccggcaatggcgagggctcgtcggacctcgtcctgcgccttgcgcatcaccctagggttcctcatcagctccgacatggtccactgcagcgacgtcgccggcgtctcgctgctcgccacgaacatgtcctgcacaaa

SEQ ID NO: 72308 - DNA, 17529 bp, Oryza sativa
gggacatctaactattggtatgtagttttgtggtccctagacacattctatagtgacatgtaaccgaatggatctagtactggtcaatgatctaagcacacccaaaggatttacatacctgtattttagtttgtgcctaaggtccaatcagacctgtcagttgagaagtttctattaacaattcatcttctgtaacaggataaagagctctccagtgctgctggaaaactcgtggagtgccagaagacgattgcgaacctcggtcgtcagctaaaatcgctgaccgatctcgacagtgtaacagccgagcctgaaaagctagagtctggggatgcacttctggactttagagaacccgatgttgaggtgccaccagcaggctttgcaaatggcctgtacgatttggatcttccaaagagcaatgggagctgcctgtcacccattcctcgtgttcagtcgtcttccacacattcgcaaacgtcagtgttctctggcggtttatcgtcgcttggtagctacaggaacaaaacaagaaagtgaaatctgatgaaaaagatttgtgcataaacttatttaacagttcgtggatgtttgtcagttgtcacctgatgcttagatcagtgtacatttacaggaaaatgatggttacttgtgcttgttccgcctgatgattttactgctatgagctcagcctcattttctttacttttcagcgttcaccagtttctgatgcaagtcttgttgaaagttgagactgatgtttgtcatatagtaccattctcacaagctagtcagttcgagctgaagatgtgctgaacatataagtaggcaattcactgaatgcaagatgaataatctgtcactgaagaaatgcagcttgaaacttgtatagtgctttgctcgagtttataagcctggaaactaaatgcttgagatatatagctcgaatgtctgaaagtgatgagagctggttttcagtaactgtaggttccgtacgattgaatttacctctgtaagatgcaaccacctccacactaccgtccaaaactgcgacatggagtactacataagctgtggcatggttgcactctatcgcacactcgaatcgtctcccattgttgagcaagcaaaggtctttgttcttcttgagctcagctcagctcatcagcttccatccatgggtgtcttcagctcggctcccaaggtgtacaagccggcgtcggaggtcaatctcggcgccgacagcaacgagttctacatcagccccaacgtcaaaggttacaagctcttgctgaattttctgtccattttcatgtcaaagagcttttgcattcagaattcagaatttcagttcttggaagtgatttgtatgcttatgtctgatcatttttgttttattgctttcttcagctccacgggttgctgggcttctggtgaagatattcgcatgggttcttgaggcgccgatcatcggctcaatcgtgctctacatcctcaagagagacaatcttgtcaacaaggtagatgatcatcacttcttctgcttggcacagtaaaaaaacacaagttgaaatgttagctgaaacgctgtagattataatggcacttgaactgtgatcagattgtttggatgctgattagttgctgaaaatttcactgtagcttgtctcggatgccgaaatcccggagccaccactgttcactgcagctcacacctggcaaggtctgtcttctgttccttaccttttgggatttcggccctaccatttcgagccgtttttgtacttttgttcacagtagaattcacatttgaaaatcaaatttagattcagctagaacctgaaaatactgctgctcctgctgctgttgcttcattgcagacatccctgagcagaatgtgagcctgacgaagccagacatgtcgccggcagagcgcgttcaggaggccgtcgtctgcctcccggctcgcctcgaatcggtgctcgctgacccgccatcgccggggttcaggcgctggacaatccgggacttcaccagtgcctacatctcaggagagatcactcctgtcatggtaaaacatttagtacagttttactgacagtaatatgttcgtgtttaatggtttttgtatcagtagttcagtacaatgcaatgcattatgacaatgtgtagtgcattgggggtgtgaattactcactgaattttagtaggttagaggtattcttgttcatgaatgctacccaattagcttgtactgcattgctggcaggttgcgaggagatttctcgctgcagtgaaggagtgttcaggccctgatctgaacatggccttgttcatcagctgcaatcctcaggacgtcatcagacaggccgaggcatccaccctcagataccagcaaggtaaacaaaattaactacattttcagtgtacattatgccaaagaaccgtatcaacaaatcaaaatcaatgaatcattcgagcattaaacagtaattatatcatactagcagtactcagcaagtgcctcagtgtctagccttcatcaccattgacatttaggttcagagaatctgcagaaattaaactgtcataaccaccatgtttacttctgtatgctactaccaacttgcatgcttccggccatgagtttttacttgtagtactggtgaagaagtactactattactgccattgcagtctggaactgaccagctggatgaacagtatcagcagatgctttacaggaaggcattgtcagagcctgccaatgcacggactggtctctgaaagagatgtttccacaatgaaacaacacgcagcttgcagcagattcagggctcggactaatctgacatggagcaaaatgttcagacttcgaacagaaggggctttctgatgaaagattccatagaaatggcatcggcatcatcccctaatgatcatgcattgactagactagctctttgcttgcttgatcgaatctgaaagcattgcatggtcctgatccagcattgatagctcatagggacggttagttgccactgcatgtggttgcacgcagaggccaatactacattccttgcagggcctggcctgctgatctgttgcaattgaaggcatctcgttgtgctgatgcatctgttgttgcagtatctcatcgtttactctttgcattcatgcagcttttacctgatcgattgcatgcaccatttcatttcttggcttctgttaactgttaattgttcttggattatgtcaagtgtttgactgttcttgatgctaattaactgcaggagctcctctctctgccatggatggcgtcctggtggccgtcaaagacgagatcgactgcctgccatacccaacaacaggtaagaacatcacaagatcaggtatcatcaacggtgctaaggttgtcgaatcatatataagaacaggaggtaaaaagcaatcggaatcaggatttaatcagctgcaggacggtaggtagagctgctgccgccatggagaggaggccccggtacggtcggatgattctgatgacactgttcatcgccgtacacactgtccgtcgatcgtttgcttcttgcaaaatgagtgctgacaattggcatgtgtgttttggattgatactgttcatcaacagaagacgtgatccgatttgttgcaaaaagagagaaatcggtgcttttattttttaaattagctacagtaggctgtactaactcgtttttttgtaggggacaaaataaattattgcattggccatgctatgaaatactgtttgcaaattaaaaacattttttctgaagaaagagagtgtatgaatctgaagattctaactaatgtcaggaccaaatctatgtcgacatagcaaacatgataaataaagaccagttcagattactgtcaaaatgaatatttccaaaatttggcaataccaaaatttgataggttggcaacattgccgagttttggtatgataggctaaatgtgctgtcaattttttacacattaccaatatttgataacagactaaattcatccacatgtctgtcaattttaccccaaaatggtatggtttaaagtgagaccaatacgatactagggtaggccctaaatcatatatactagttttatatttaggggtggaaatgttatgtctgattggttgtactgtaccctgaaactgatcaaagacgcatatgaacaggaggaacgagatggctgcagaggatgcggccgtgcgtgcaggacgcggcggtggtggcgcagctgcgggcgtgcggcgcggtgctcgccggcaagaccaacatgcacgagctcggcgccggcaccagcggcatcaacccgcaccatgggtacgcatcacttgtcgtcgtcctgttcatcatccgcgcggtctccaaatcacaatttttttacccttttaccaatgggtttcttacctggtttgatggtttcagatcgacgaggaatccgtacaacaccggcaaggtggccggcggctcgtcgggcgggtccgccgccgtcgtctgcgccggcctctgccccgtcgcacttggagccgacggaggcggtaaacctactcaactcgtacatgcaaattgggaatttttctgaaccctaaaaacatcctgctctgacaatacaaaacattgtgttgctctggcttctgttatctgatcggatcatcagtacacgcaaaatgggtttttttttttaatctgaacaatgaaactgaaaatgtcttgctctgacaaacaaaacattgctgaactagcttgtgtgatacaaaacattcagaacataatgggaaagtgatttcatccgtcgaggggatatctcctcgtttcgtttatgtcacctaaatagttataattttttttaaaaaaaaattgtcaagatagattaatatgaaatataggagtatcactctacaaacatgcaagataaaattcaacttctatagattgtaacaaaaataataaatataaatacgaatgtatgataactattttcagtttaatttgttctttttgttgcaacttataggagtcgaatttggtcttgtatgtttgtggagtgatatatttcatattaatctatgttgtcaatttttttaaatttttttataactatttagatgtcatgcaaacaacgacggaagatgaaaatctatatccgaacataatgaatgatgtttggattgaattctgccaaatgtacgacaagaatatctgcatgcagtattgagttattgttttctttgtgcattttaatcaggatctgttcgcatgccagccgcgctctgcggtgtggtgggcttgaagccgacggcagggcgtttctccaaggatgggttcgtcatgctccacatatatgtacttttcattctacaagatcaatcactagccaaagtagccatagctgcaatggatgtgcattgttcagacacacctgacctgggctatttctgatctcaggcttcttcctcttaactggaccgtcgggatgccagggatcttagccgcgacagtggaggatgcgcttatcgcgttagtaatctctcttgtttcagaaactaatttagctctcagtgatcttgttacacttgattgtgtatatatgttgtaatgtactaaaagttttgtgttgctgtttatcattcagctatgcagctattgctgatcagtcccaaccaagccacttgcaggcaaatgctcgaactttgtattttctcttacacgtttggatgttcagtgagactgaatttgcagaagatttgatattttttgtttgtttgcagcctgaactgaatcttcccctgctgaaagctgcaagctcgatgcctaccatcagactagcaagatatgcaaaggtgagtgcttcaacactgtaataaaatcgtgtcatctgaaactgaacattgtactgatattcgccacaaaaacagtggttcaatgactgttctgaagacatcagaagttgctgctacaaagctgtccatacgctgcggactcgatacggttgggaggtagtaagaacaactctacgcttcatctaatcctgaagttaaacaatgcactcagtgacatgattttgaggaaatacactacagttcatgcaatctgacattttatttatttatttttgcaattgtttgtgctactatctgcaagactgctgatgtgacaattcctgaaattgaggagatgcggctcgcgcattacgtgacaatgggttcagaatgcaccgcctccttcgataagtatctgaagaagctgtaagcgtatcataaattttgtcatatgaaatcatttttcaggctgacatgcgtatgaattcaaaatgatgatcaattcattgtacactcaaaccatgctgatgcaggagcaagtctgagattggttgggatgtgaggatcgcgctgagcgcctacgggtcgttcagcagcagagcttacctgaactcgcaacgaatccggtgagctatcatatctaccattcttcagacattcattccaccatcaaacttagaacactatccactctgaactcgaaatgaatgaactcttctttttttgcaggaaccgtcagatgtacttccacgacaagatctttgagacattcgacgtgatcgtcacaccaatgacagggtacctatgcaatcttgcatggaaaaaatcactcaccactactactgagtgtagcagtgacagtttcagggcctaactgtgtacttcttgtacagagtgacagcgcacgaattgcaggacaacgcggggcacaccggagagctggactacataaacggaggtgattataactcaaccaatcacgagcaattaactgaagaaaaaagagttcagtttcagaataattaagctggcatctcactaactcgtcagtgttgcattgcattggatcgatgcagctgcgctggtgaggtactcgatcgccgggaacttcctggggttgccggcgatcaccgtgaaggttgggtacgacagggaagggctccccgtcgggctgcagttcatcgggaggccgtggtcggaggccacgctgctgcacctcgcctacgccatgcaggtcaccgatctgatgctggaaacgaactgatgttaattgttctttccaaatcctgcattgcatgtggggagtgaaatgtgtttaattatctacacagaagtgattatttttaattttttatatatttttttgcaggaggcgtgcggcaagaactacaggaagcccatggtgtactacgatctcctcaacaagaacaaatactagtttcagtttcaaaagaacaaatagtagctatatatgttgtgagagttgagtgacagtttgattctgagagatttggactggggagaaatttatcatcgatcattcttaccatcccaaatacagaatgtgatggacattattattgtaattgttgttatgtttgttgttgttgctgctgcttgacataagcatgcatgtaagtcatatgcatgtcgctgtatatgtttactattattgaatgtgcctactgatttactaaatatgatatttcatttcttttactctaaactactactacttactactagtacaattgtttttctcactcaactctcctaagaatatcggtggacaccaagcttagcttggtaaaattctgtgaaacacaaagtcgagtggaaatggtgaagggcccatgtggcctatgggccatggcccatcatccttcttggaggaaaattagacagcacttctggttcccggacgagcctggtccacatgtcatttactattgcacccctgtcaactttagaatttacagttagctcgttgatatcgtagcttttatggactagtatgtcctggggagataaattttctttcttatggactaatccaaaccagagtaaagataagatttatcttctcctaagacaactgtatataaaggggcaaggtgagacatttgagatttgcttatactcaatatcatatctataattaaaagagaacttcaccctatatcgttgtctacttctacaatgttgttgagggcagaggaaaaggcacaggtattctacattttcttacgtctctactgcggcgggagggacagagaatggatccggtgatctgctaatagacgtgttggtttacaacagtggcttcacaatctgtacatgtttgttgtggggtatatgggctccggttggatgaagaaatatctcaatcatccgttaagcaccttgattgtacttgtagttttcatgatctagttgaattcatggctttttcagcacaaagattgatatacttgatatgttgattttgagatgtttggtagcactctaaatccataatatgctatattagaaatttatggcttcctcaatacaaagattggatgacaaaatatctccaccaccgtcaaatcttaggagtacaatctgcattcatgtcgagaagagtcagatagatagttcacactcaacctgaatggagttatcaacatggttaatgccagggtgaattataaaaaacttcgcaaaaccccacgttgccttaatcttgaaatggcttaaatgatgactaacaaactattgtcttattatagttaggcggaagacaataggggagattgaggaggagatgacctacaagtggctttgcactgtattgtttttttcggctcccccatggccccaagacattatccatgagacaaccgaacaaacaagaagcatcaataccggtagcagaagcacacaccgtcgctcaccctgctaactgctttgtactagccgaccgccactagctgttgctaccgtatccttcatctagaccacccacgaattaactgaaaccaccgtcgtgtatgtcccataaaatggtctacttaggattatatacaagtacacatgttgatcatgaacatgaaattttgaatacaacaatggtatttgatcaaatttggataactttacattcatacacaagatataaaataatattgctataatatgttactcataagcatgaagataataatactagcactacaaaatgtcacttgatgaaaccacaattgatgttaacacataaatttcttcccttccaatctgaatgccctagattaacatggagaaaatttttatctgcagataacactaaaccggatccaaaatttcccataccaaggctgtgtttagttcatgtgtcaattttttttaagtatacggacacacatttaagctattaaatgtatactaataacaaaaaaaattggtcacgcgatttacatgcaaactgtgcaatttaatatacattattagtatattatcaaatcatggcgtaattaggctcaaaagattcgtcacgtgatttacatgcaaactgtgcaattgatttttttttcgtccacatttaatactctatgtatgtgtccaaacatttgatgtgacagaaaagttggaagttcgaagaaaaatatttgaatctaaacgaggcctgaatggaaataatcaaaaccgcaatgggctggcaaactgtcgatttcagataatttttttagtacggacaaactgcagggacctaaacgaaaaagaaagaaaaccgtgacgtcgctcgcttccagagatcttcagatcagatcagaaatccccaaaaaaaaaaaacacaacaaaaccaaacccgacagatcttctcttcttcctcctccctttcccatcttcgacgaggcgacccggcgcgagagaagaagagatcgatcgatcgatcaaccgatctcgccggagaaggaagaggagcaaagatgtcgtcggtgttcagcggcgatgagacggcgcccttcttcggcttcctcggcgccgcctccgccctcatcttctcatgtaatctccgccatccctcttcctcttcccccgatcaagcgattaggtgtagaaagctccagtttttccaatcaaagtcgccatctttttctttcccccatctggttgatcctgcgatttggttcgatggtgatggaggtccacgcccctccgattcgcgcgatctgtgacgccctgagtgtgaattttcttcttcgcgtggctagatttgacccgattggagatcggatttgtggggaaaaaaagttgggagctttggattctgttcttgatggggggatttgcttatttgctttcattcgatctgttgcaggcatgggtgcggcgtacgggacggcgaagagcggcgtcggcgtggcgtccatgggcgtgatgcgcccggagctcgtgatgaagtccatcgtgcccgtggtcatggctggtgtgctcggtatctacggcctcatcatcgccgtcatcatcagtacagggatcaaccccaaggctaagccgtactacctctttgacggctacgcgcatctgtcgtccgggctcgcctgtggcctcgccggtctcgctgccggaatggccatcggcatcgtcggtgatgctggtgtcaggtaaagatgctgcctgctttgttgatctgtgatgtagttagtgtgtatatgctgttactgctgtgcattggtgattaagtatggttttatgatggaagctacaggttgattaacaattctagaagactttctataggttgttttgctaccaaatatgattaagggatctgtatgtagtttttgtagcgctgtctgtttgataacttgtattcattgtgttcttgtattagcctagtagttaatcttgaactggtagtgagtagctgttacctacaaggttgtgcgtttcaatggcttcaaggctgtggaaatgaagaacaaagctcatataatccttatatggtatttctggatcctcctgtttgtaaatccttgtggtctggtaataagttataagtgccaaggctttataaattgttagtatttatttatggggggttctttcctcgtgggcacttcaatacgtagcatatactgaataatgatgttgttcttggtactgctctctggtattttttgctgaagttttaacttttaacaactgaaaaaatgtgctgtggtgtgaagagcaaacaagtggtcaaggtgttatgccttaaattttttcaacgatgtaatgctgagtagttgtgatttgaatgtaaataatctactttcacaattttagcacttaactggaatatgattccattcatgatggcaagtgtgttattgtataatcgtacatattgtttcttagaaattttgacgttagaaggttaattttgggatgatttattagattgtgatgttactatgatatcatatgatcgaaatgtgcttcactgcttttttggtgttcacctcggtgttcatgactaccctttgtgttgagagcttgaggctactcctaagctgcctactttggattacaattctgatatctcttgttggtgttggcagggcaaatgcacagcaaccaaagcttttcgtgggcatgatcctcatcctcattttcgcagaagcgcttgccctgtatggtctcattgtgggcatcatcctctcatcccgtgccggccaatctcgtgcagattaggcactttgcggtaccataccgctgttattccactggctatattcttgagaaaacctgaaacttacttgggagctctagtttaatgtattaaaagatcgatttgtagcttaaggaaggtggcacttccagtcctttttgtttcttttgtggtggttcatgcaaagttttttgggttaggctggatttgctgctcctgagcaaacggatttaatctcattcgtggtgaataaaaaacacggcattgtagcaaaataaaatcattacaatatattatgttcatcccttcactctaatgtattggattgcaaaaatcatcaatgctcctttttgttatgagttcaagtcatcattatatcatccgacttgtgtgataagctcatgtgttcattgagatgagtaggctaattactctcagatgttgctctaagaaaggtgatcttttcctcttgaatggccgttctgtacaatcgcaccaaatttcgtacgctgctagtgctcaaccaatctgtaactattgttgactcaattcattaccctattgcagcatctcttgtaccgaaaatctcagataacctctcaaagagctaagaaaatctcaggtaatttacaagaaacaaggccaataccacagaattccaaatctacctgttccccatttcaggaatgcttcttccaaatgcattgacctacatctgtttcatcgctacccactgatgccattgcaaaaacagtggtttttggatgtttcgaaactaggaaagaaaattttgttattgccacgagacagaactcgtgctgttgatttttcttcagtatcagaaaaacagaatgcagcggcaactttagctgtataacgccgcaaggtcatcctcgtacgccttcttgatggcctccctcttgagcttgagggcagccgtgacgagtcctgactctggggtccatggctccggcaccagcttgactttggctgggatctcaaacttctccagccgcgcttgcttggcagcctgaagaacaaacacacgtcagtacgatccaattgtcataagacttgcatgtcttgcattgatattacttaataagcttgctagattcaatttgttttgagattgttacggtgcgtgcaatgtggggttgcattgcatactgagagtgaaaaattggtatttggcatcgaccattcggaccgtacacatgatatctggttgagctcatgaatgtacatcctttttgcacgcaaaatatggagatatcgtcgcagattatgatcatatcaaattgcatattagtgtatgggttatattctctgtttactggaagattataatgtgttcttttcctgattctactgataacctatgaggtccaacatatcctccgttgttctcatattggtacggcaataccacattgccactctcaaaagagagaaaaatagaagagatcatgttttgctgaatcatccagggaatgcaatcattagtaaagtagtactagttaattttgatggaaatattgagggttaatggattgctagattaatcagatatatctaattaattaaaacgcagggagaatacacacctttgctaaacattgaaggacttctttgacagtctcttgcttctcacacaaatctgaaacatccgaatacgtgatgccttgttgtgaggcccagcttttcagttcactgtgtgcaactacaacaagtgcaacgcagtagttgtggaaggggtcagcatggatcatgatgttgtcaacatatgggcacacactcaaagcagcctccacctgtggttttataatagttagattacaatagctgactgccgctaatttggctggaaaaggaagcttagcttacctttcctaaagatacatattcaccatgttgaagcttgactatgtccttcttacggtcaataatttcaaggcaaccatctggatgcaaacgtccaatgtcaccagaatagaaccaccgcatgcctctttcatcatccttcaataaattggtgttgttaaagaaaagttatcatgggcttcacagcacagattgctttggcatattatcgtaacataccttgtagacttcatttgtttttgcctcattcttaaagtagccttttgtcacgtttggacctccaataactatttcaccccgaggcattggtgaatcattagttaaatatccaccttcagcccaatctatcaactatcatatacaattcatattacgttaggaaagaataagatctgagggataagatattaatcttctgaatctcaacatgaaggagaaaaccaaaataaactggatgggcataatacactaaatttcaaaatagatgttcttttttgagtgaagcgtgcaaaagattacatgcatagctttgtgtaaactagctatccacaatgtcactggactggctgtaaggctagtggtcaagtaaagctatccgcaattccacgcctcatgtcaaaaatttgaacacaaaagtttatctgtgatctctaatacgaagaaaaacaatatctttttgcacttagcggaaatctttcgtacatatgaatatatggaaatgaggatacaatttatatcacagtgataacatgcatggcaacaataactttactatggaaatgaggatacaatacaccctaccaaaataataaaacatattttttaatgtaccttaatgtatgagcaaggcaatggagcaccaacacggccaacagaattgtcatcatactcggaaaatgtcccgccagcacatgtttcagtaagaccatatccttgccctattggagccctgcaacagcacaacccaaaacctgtcaattgttttggtttaaaatgcagtatgcaagttagatttgaatattgtgaagttcaatcacagtaaacacaagtggaccaaaaacaataacttgatattaacaaaagagacttgagaatggcttataaaataatgaagagtactatctcacccaaggcatatattgataaatctctgagtatctccagacagaggtgctccacctgaaagtataaatcgaatccttcctcccaagatcgcacgcaccttctgaaagacaagcatatcccacaaatgcttctctaatccccatgcaccaaaccaacttccattgatagcagctaaccgacggctataggcaatatcaaatagtttctttgctgcaccaccctttgcatcaacctaattcatctcatcatgaaaaaaacaaatggtcaagatggcaagaaggccagaaagaaacaatggataatatcattgtaaagaacaatacattttttctaacaccatcacgaacacgatcaagtatagcaggtactgcagtcataagtgttggcttcagagctgaagcatcgccctgagtccccttctttattttatttgatgtatcagtcagggtcagtggtgatccataccctatagaagccccaacagcagacataactgtctacaaatcacatttgcataaagtgcatcagcatcaacaaaaccaacatgtggaatagactgagatttcaatatgtcatctgacacctacctcagctgctaattcaagaatgtgtgctaatgggaggtatgccaagtagacatccttcttgccaagtgcaggcacaatggtcataacagctgatacaacagccaggacattgcgatggctcatcatgactccctgtggaaaaaaaagtacaaatgagaggagttgtaagcagatgatctgagaaaagacatccattagtaatatccatatcgtgaagtaatccaacatgggcactacaaaaaaatcaactaatctttgaacaaaccttgggcattccagtgctgccacttgtatacattatcaccgcagtatctgacggaagaggcagctttgcttctacaggtgtttccaatcctaacctctctacctcctcaaatgactcaaccctccagctggtgcatttttgagctaaggatacttcactagagacgccttcctcgtttacgtagatgacatgtttcacagtatcaagttgcccacttatgtcaagaagttttttcagttctttccttccacatatcacagtagttacctcagtctaaagagtcaaaacagaagcaaagttagagatcatatcacgacgcagatacagtaggaataaattgttatgtccaaactgttcaagataaccaacaaaattcactttggttgaggttttgttaccataatgatggacagggtgagaaaaaattcaagtgacttttgtcaaaaaaagaaagtcaactgacctcgtttagtgagtgacataacgctccctcgcccaaggaggaataaatggtgacaaccgtaatactttgtctgaagcatgcctttcaaatagaaaagaatggttagacaatttgcaaatgattcacggagctaactgctagcataacatgaagaacataagcgaaatacaacagtataattgatttctcaactaagtgagaatatcaatatggttaagctgaagcagttcaatgttcaacaaaatcagtttttcatgagagaatgtaaatgacttcttatatactcagctgtgtcattaatttgatcatttttgtcttgtcatatctatctagatagcacatagttccttttgttctcatgagcgcatttcactttatatatgcaaggatggtgatggaacattgtgaaaaggacaggttgagacacttcaagaacagtccgcatcatgtaaattcaaaccttttatgtacacacaaaaaaactatggaagttataggagcgcgtgggtagagaaagctacctgcaatgcaatctgccactcggcccgtgtatcggcgaaaatagcaacacgctcatccctctggtgcccaattcgcactaaaccagatgagaagttgcagacagtcttgaatgcatcagcatagcttttccactcatactgccccaaatgaagcttctcaaaggacctcccatcgcgggctgcctccatttccctcgaaatgagctttctggtgccaaggagtggcatgtagacatactgctcgcaggactgctcaaacagctccgcaagcgtggaaaccccttcccagtgcgtttcaacgggccgctcgaacttgtggttacggatcacatagccgggctctccgcccacatcaaccggcactccccttttcttttcacccttcctcttggtgaacagcagagatgccagaaaagggatagcgaagccgatgaaataaggattcatatttcccagccttacacaaagctactagtccgcggagtgtcggcactgatctgcaattgacttttcaagtgataaacctgaaatgataatgtagctacattatcagatatttatcgcgtattaacagacacagatacataaaaggggaaggcattgctatccagtggtctacaatcaattagaattagaatcctccccccaaacaaacgagttttgaattcctccccagatgcagaaaatgttactagtcggactcctctcctctggagcaactcgttcgcagcgagcggagctattcaaatctaacgtagtagtccactccatcctacaagatcctctagtcgagaaaaacccactgcggcattgctctacaagatcctactagttgccttgcagagacaccaccaaatcaaaccagcggacggatcagaccccacccccgcctactggatgctgctgtggaagcttctagaaggtaatgcagggaactagtagtagtagcagtagctacctgtgtcactcaccggcggaggaggcggcctccgggagaggcagaggaggaggagagtgcaatggcaggtaggtggcgggtggggggcggagagaaatacgggggggaggcggaggaagaggacggcggcgcgggcggagaatccaacgagggggggggggggggggg

SEQ ID NO: 72309 - DNA, 39408 bp, Oryza sativa
cgatcaaactcaaaaaagagttttactggaaaaaaattaaaagtgtcttttaatatgaaacggatatgcagtagaaagttccttttcaattggtcgacacccatgagcgtttgcttactgggcccaaatcagatgggtcgggccggatactccaaacgggcctactaatcctttcgtcttctcttctctctctcgccgtcgtctcgtctcgtctcctccgccgccgcgattcatccgacaccaccggcggcatctccggcgagcggcagcgccgaacacccccaaccccaccgagttctttacggctggtgtctcccctcccatcctcgctaccgcgtcgccggcgcacggggagggtgggggcgtggcggcgaagagattcctgggatctcaggggatagtggactatggggtcggtggatctgatcgccgcctgcctcgactccatccgccaggtcggatctcttcgcgacttctctctcttaccttgcctgctcggattcctcattgtttgttcgatttctttttattatcatgtaagagattaattttgtccgggttaaactgaatgtgtaagaagattcccagaattttcagtttctaattatctgaattttgcactttggagatgaatatgagactactgcgtttaattggactattggagcgatgaaattgttctttaaaaaaaaacccatctttacagcttcctgaccgtatttctttctcgttccaaaacgataaattacaggagctgcttaacttggtaaagatttatccttttagcttctgagctgacaagtcgctgttattcgttcgtgattaacttaagctgtggataactttgagaaaacaaattcctatttgatgatttgcatgtaaaactaatggactttatcttcgtggctttcactatagaaatttatgttctttttttggtctgttgctgctttgcagattggagatgagattgcagatgcactagtgtaccttgatgcaggcactctggaggcgtttcagtttattggagctttccccttgcttcttgagcttggtgctcgtgcaatttgcagcttggagaatgcatctccgcttgatgctgtgagattacttaaatcccttgccataaaagtcaattaattatactagtaataaagaatagatatggtaataatgcatactacctcccaaggtagttagccagtaagctaatagcaatgcctcccaaaagttgcaatgttgtctgctcagtagtaatttatgtgtcaaactgaatgcagcatgttgagtgcaccaaagctcaagcatttttagtgtgtgtctggcacatgagtggcaaagtttaggaagaaaccatagttgcaagtggcatttgtttcttgatttgtgtcaacttagagctaaggactactccctctatcccaaaatataaggcatggtcaaactcgtcacggtctccaaaactaatctttgactcataatttctcatatactataaagtttgtaggaacaaaattatagccatttgaaagtgtattcaaatgtcaatccaatgatactattagcaaataaaattcaatttatattatggtatggagggactacctttttggtcctatgacatcttgaatttctgtacttcatatttctttttcattctgaacttcttatagatgagaagcagtgcacctaacagccttcatgttaaccttagtgtcaaactcatattttcttatataaaaccataattttctttgttcatgtacaaaaagtaagaaaaaattatgcttttttttaatgacaaatgtgccatcctgttctttacatgatcaaaatgccgtaacttgtgtttggcaggctgctgaatggcactcaagttttgcacatccagcaaggaagatagtagtgattacatcacgcctgcttagtgatgcacatcggtatattttgcgctgcctgggaaaccatggaactatttcacattgtactgtgttgacagctatttccgaggtacttcattcctgcaagaatttgttactttgatgcctgtattgcttctgaaatgcttgaacatccagccattattttcctacaattatcttctgttcacatcaaaatggctttagattttattttattttattttttgcctggggcttaagttcctatttaatttcctttgaaaaaggtacatagtccatgttagtttccatattatcatgaaggtatcatatactatatctggattgtttgatttatcctttctccaggggatggtctcaacactcatgtatgtagtttgtattgttgcatgttgtccatttggaagcttatctaaaccattatttattgtatgaataatcttaatgtcctcttgaattatttgttgtacatagtatagctgaacacatatgagtgtattagtatgagctaatttgtggactttgttttgtttgcaacctgtggtaacttctgtggtgctcaaccaaatgttgataaacagcaatcttgcttcaacccatattataagatttttttttctttttgcaaaacttaagagtttttttattgaaagcaaaatcatcttaagttctgcaagcaggatttgaatcatttgtgatatattgcaggttggtcactcagcatatgttgattccccatttggaccagatgccttccgggagtatgagacattacttactcaggaccatgaggaacttctgaagaagtatgaaaagtcagatgagcacaaagataccactttttacacaggaaaagatttcacatcggatggtggtagatactccaattgggaatctggggtgcattatggctctaattctgaatctagcccaacaaaaaaggatttgtttgctgatgagtcaagccagctagaaactaaaggaaaaagattatctgtaactgtgactcactttccgatgattttctctcctatttcctctaggacttttgttttgccatctgaaggcacaatggctgaatcatgtttatcaaaccatcatgaagattcccttagtccagggctacctcccatatctactggtagatcttttgatggtgatgagattccccccggagtgacattgactgcccagttcctttaccatctggccagtaaggtaaagatttatcataagaacatatttcttactagtggcttcttatttttcattcatataaccacttagtgatccgtattacaaaacatgtgtagatggacctaaagctcgatatattttcacttggagatacatcaaaggtcatcgggaagctgatgatggatatgtcaagtctatatgatgttggtcgtaataagagatctgctggcctgctgatcgtagatcgtacacttgatctccttactccttgtttccacggtgactcatttcttgataggatgctgtcctccttgacacgcaaggaagggacttcatcctattttgtgtccaaaaatccacaaactccaagcaagcattctgaagctactgttaaacgtatcccactagatataaaggtcccttttgaaaaggtcttcagcaaggaagaacctaagagtaggaccagtatgttacccgaaagtatcatgtcatttgtgtctggatggaactctgctgaagttgaatctgaagtaacctggctacctgattacgcggataaagctcatgatgacaaactcagcagtcaacatggtagtttaaatggttcattcctatccaattatgctggagtgtgctacttggaatcattactcgacagaggagcaaaagatgggttaatgttgattaagaaatggcttatggaagctttacaacatgagaagttatccttcccatccaaaggtcggcaaggagctgcctctgtttcagagcttcattctatggttcaaatgctctctcgagaccagttatccttagtaagaaacagaggggttatccaattggcactggctgctgaaatggctctccaggagcctcaaagttctcgctgggatgcctttacaagtgcagagagaatattaagtgtaacatctgcagagacaactcaaagtcttgccagtgagcttcgtgattttatcaacactagcacttcagttgaatctcacaagcaagctaataaaactgagtcctctcagggccttctaagtttccaggatgttttgcttctaacaattatcgggtatatcttggctggtgaaaattttcctacatcgattgctggtggtccattctcttgggaagacgagcggtctttgaaagatattgtggtggactctatccttgacaggccatcatctgtgaagctcagatttcttgttggcttggagaatgagcttgaagctaaagctagacctaaagatggtgacaaaagtaatgactccatcgaagcttctaagagtactgatgattttgatgaccaatgggatagctggggtgatgatgatgataatactgatgatcagaaggatgaagcttatggggacatgcaacttaagttggaagtacgagacagagttgaccagctttttaagttctttcacaatttgtccagtatgaggttaaggaaccaaactcttggagaaggcctagcagcactgagcagatttgagactgacatatactcaagaaaaggcttgctctataagttgctattagctgtcttggcaaggtatgacattcctggccttgaatatcactcatcagctgttggacgtttatttaaaagtggactggggaggtttgggctaggacaggtgagttattagtttgtacttccttggttcctttgccaccactctgtagctatcctttctcacactcaatactatctgcagtctaaaccaagctttggcgaccaaagcattctcatcgtttttgttgtgggaggcatcaatgcccttgaggtatggtccatattctttggtttcaagtattcaatcataccagtatggcattattgaagctgtgtttctattatactgtttggtgtttaaatataaatatttgtttattttgtttaaaactacagtaagaatcctcaaatttgacctatattttctatgttttgctagtgtactggtagtgtggcactttcagaaccatcagttggtacacgattcctatcttcaaaatatcaggttacattcccatgtagaaaacatgaggttttagttagtgcactttgaaaagcgcataaaattgcactcatccaaataagagattacaaaccacaatagaactaaaaggaacttgcaaaaagttctctttgtaaagaaggtacatataatgtctgatccaatctgccgccaaaacatttgttagaatggtaaggaacctttctatattggaggagatatggaaagggatatggatggttgtattggtatatcaatatccgttgggtgtggattatccaatattttttaactgattatccagtgcttgttactccctccccaaattgatcatcatataatagaaactaaaatttctcaaattgatcatcttataaccgcatggacacggatttcatcggagtgcaattaatacaacatgggagaatgtgtatatttgtgcattatgttttaatcaatgcatgcactgtgggagaatatgtgcatattgtgcatggcgtcttaatcaatgcggtttaaattatcctaggtcttggtacacaaacattatacgatcaatttgggatggagagagtatttggactatctgcaacttttcccatctatgattgttccttttctctgtgcaatttgtgcttatgtgttggcaaagtatatatcgcagtgtgaaaaagtaaatctttaacaaattaaatgatcttttctatgcaaggtccgggaagtcatgaaggcaatatcagacagcagcagacctgatgtggagcttattcttgggggaacaacccttcttaccccagatgacatgtttgagttgatgttgggctcatccagctttagttagtctcaagcttaattgttgagaagctcagtccagttaacaccaatgcatctgccttggacatcttaagaatgatccagatcatttctccggaagttctttctccaaacgtggcagttcagatactgaaactctaaagattgtatcttggtgatgataccaacagcaagcataggcaattcaattcataagctcttcagatttttaatcgcaactgaatgcagcgatacagttcgtcttttgtaggacagccattgaaaacaatgacttttgagaatcatcttctggacattcattcatgctttgctcaaaagctggagtctactgctttggatcagtcactgtatttgcaagtgaagtcaaatatgaagtgaccctgctgactacacagtaaacactcaaaacaaggtgtaattctgtcttaagttctcttgctcctagaagtagctgctcttccgttcagaagccatatgtaaatttaatctatgtaaattgtttgctgttgattcgaaaatctttggtgttcactggtcaggagaactgtcaaattaggtacagcattgtaactgaaagaacatcattactcagttcagtgaactgaagtgtacatgcactatgttgtgacttgtgagtaatatcacaacccccaaaaaaaggcaaataaaattaggaatagtttgttatgttccagaaaaaaaataaacatatcataatgtgtgtaattggcctttctttttagtaggctacattttctggtaaaacattaatggcagctttcataatccaagatacataaatgtcttttggaattgtttgtagaggagtggaggcaacaatagaagttgccatatcagaattggtcagtggttttgatttgtctgtcagatgtgatcttccaatgctcgagggacatggagaagttcagcttttcagtggcattattggtgagccatgcagcttaaggaggtttgtgatggctttcagcttggatatagtgatgcatttgaagttcattcatggtagatcaaaagggctccaattttgttgaacattcttgttcctttgaacctaagaaacatggatatgcaagccatcaaataaaacttgagctctacttagtcaacattggggtggcgcgatgccaattctttctagatgaaatgcggatgtaggatgatggatgatcgatttgtttataggaaatgaatcaaataattatattttataaacctaacaagtatatcttagaataagtagcctaagtaatacttttgaaagtgtggcgcgaataatccataaatagttctggcccagtattccaagaataacgggacaaaacaaattcctttgtgttacattttgttatcctgagctgtatcagtaatattgtttaatatatgctttacagtggtattgttcaatatgtgtgtctttggatgttagtggcatggttggaaatgacaagtctgtatgcatgttggtttgaactttgaaccacttctaccattaagctttcctatttgccatttacctgaggaatcttggggttcacatattgcagattggacccttctcaattattgtcacagaaaagaaaaaagatgatcacacacacactgacacgtacttgagaaaaaagggagcttctcctagatctgaattctgacattagacttgtagagacactgggagtgttgcttaatcaccctgcagtctctggcctgaaaatgctagtgcttgtagcattgcttggcatgtactgtacctgccaggcttaagctcaacagctgtggttagttagtgctgggctaatcaaaatatttaacctgttctttgtgtgtccatggaacggcagacatgtcaggatctgaataatccgtgctcgtggatggatgcactgaagatgcatgcagggatgtctgcttgttcctgctgcagtgttcagttcttgcaatttataaagcatcttgctcttgctgcctcctgttgtcgttctctgcaactgggctatgtatcctgtgatttcgttgatgcattctgttcttttccattcttttgtttcttgcaatgtctccttctgtcagctaacatgatgttctttctcaaacagaaagagagagaaaaaggttatttagcagattaccaagttatttggtctaacaagctttctgattgtcattttgattgagataagaatcaactgatgataattcttctactaatttcttagtcttgcagcagtagcattctctctggcaaggttaattagtggagaaattttaccttacttgaaaaagtctttgttaattagtagagaaattttacactaaaaatttttatacctcaagatacctagtatctataggtaccaagtttttcattagaaaaatataatatcttccgatactttttttttaaaggatggtaaagactaaagatttccctaattattactaggatcatatagcagcctatactaatctgaaacggttaacacataacttcagagttttcagagctaaaccccacatcttatccatggctactgcaactcaatcatcctgcactgcacaagcaacagaacactgatcaccatcaccagaaaggaattttcctgttgacagtgtgttcaggcatcaggacaaggaggtgaagtctgaaaattgtaggctcttgctgcatctctgaacttttgctgttttgcactgcactggcattgcatgcatccagcttgctgaatatgatcactgtccccggacggcccaccggagacggagaagaaggcgggcgacgacggccgctacagacgccgaggagacggcgcggctaccgaggccggaacgtaccgccacggcacatgatccaaggcatctggagtctagctgaacaaacagttgagctcaaggtagagacgagctaagctaggggtgattaatttggcagcaactccttgttcgtttttcttcagaaatgttcagagttcagaacccatccgatcgaaacagttgtggtgatggaaggcagctcatgccgtggagtgttttcctgtttggtgttcgtcttcctcccacaatccgttgtcatctagctgttagcgtttctgcagagagagagagaggtgtttgtctgacaagtgcccatggaagctgtccatgctctgaccgaagaacaattcagacacttgaagctacttaactcaataatgcctcttgctttgtttcattgtggatattttttttcttctattagaacagtagagtttgagatattataccgtttctatgcaatgcaatgtgtttcatgtcatctcatgttccccacctgcaaatttcctgaaatcttgggagcagttaacataaacctgaaattttcaatgcaatgtgttaaaaatgttaaaaaaaatttaacacattgctgatggtgcatgatccaatacattgcattgcattgcagatttcagatgttgcaacatttttttttggaataattgttgcaacatttttaactgcaacatttttaacacgtctgaaaaactggaaatttctgaccttgcaacatctttaactgcccagttagctggctcaatgcattaggattcttattaacttatcctaaaatcttaccacagatccaaactacagagccctcatgatgcaaccatatgagaagctgagaattactactttgtttattcagtcctggacctcctttgtcctgtggctgcatccatgcatgcatatatcatatatcatatatgactttatgggactagatgcacacatatggtctccaagctagtcctttcttcacatcacagtaaggacatggaccacagctttgtagcatcagcttcagttgatgtatacttatcttcctttacccttttgtaattagaattcagtatcaccttttctgggacaaaaggtggaccattgcatgcatggatgcaaatgcaggcctgcatgcaggttcttcctctgatctgcaaagcttgcagactgcatgcagattaagctttttgccctctctgtcagtcatgtgattcttcaagtgtgattgtccttgagggatgtgggtatgatcatcagttaacagcatcatcagcaccattggatgtctctgcattgtaaaggatcaaaggaggccattagcattggtgtattggtaggaccatttgatttgatacacccaaacatatgtgcacttctaaattgagtactgccacggcatgaaaagttgaaaacttgcttgcaataatacttgttcacttactagtaggaatctgaatctccaatacttgtttaaaagacagaggcatgcacaacattgcatcacagaagctatatccatttctatcaaattaattaggaaagaaatgaaacgccaacaaaaaaaaacctaactgaacatgcatcacacctatgattcagagagatacatatagttcaattcgatccatcatatatcatcatcaatcatacacacatacacacatacatacatacatacatacaggaattaatctctctcctcacagacactaatcataatcaacaatgccatgagctcgatcgccatggaagattaagatagatgatgaagctcgcatgcaatctctcaactttttttttcttctctctctgtgcatcaatgcaattatgcaacagtaggtagcaggattaattaactcctcatcaagaaattaaccatggtaaaaaaaattaaaattctagtgtcttggagggcactggtagcacttggtgaagaggccaaaggtgtcaacttggcgaacgaagttgaccgtgctcgcccatccgccgaagccgaagccgacgacgagcacccacgcgacgacgaagcagttggcggcgaacgtccccggccagccgccgagcgcgcgcggcggcggctcgacggcgttctccctggcggccgccggcgcgaacgtcgccatgtgcgccatcgccgggatgatgtagacggtgaagctgacgaggaaggatccgacggtggagttgatggggccgaagaaggggaagatgacggcgaggaaccagatggggagcacgacggggagcctcgccgccgcgcggcggagcacgccggcgccgccgtggacgccgatggccttctcccacacgaagtagagcggcgtgcaggcgaagccgaaggtgatgaactggtggatgagcatgagcaccaccgcggcgtcgcgccacggcgtccgcggcagcagcgcgaaggcgttggagtggtccagcagcgcgtccccgaacgcccagtacatcgccgccgccgacggcagcgtcagcgtcagcacgtacgccgtcgcggcgaggtagatcatcttgaaccgccgcggcctccacatggcgtgcatgatctccaccgtcacggcgtggccgccgaacgtgtagaggatgttggtggcgccggtgaagtagagcaccatcgtcttgctcggcccggcgcgcggcgccgccccatccaccttgccgtgcacgacggcggcgacggtgaggtaccacgcggtgtaggacgtcatgaggaggccgaggaaggaccagacgcggtagttgtggaaggacgggacgaacaccgtggtggcgcagcaagccccgaagatgtaggtccatgtccgcttgtcgaggcggtcgttgatgtagtagatgttgctggcgcaggcgatgagctggatgacggagccgaagaggaggaaggtgcagttgaagaggaggccggcgttgcgccaatggcggccgaggaggccgtcgagcacctcgaaccactggatgacatggttgcggaagtccaccttgtcgcgctcccgccgcgtccggtactcgacgtagagcacgctgatgaggtaggccgtccacgaccccatcagcccgtagaacacctggaacgccaccccggacgccatgcccagctgcgagaaggagtagggcagcgtcagcagcacctgcgccacctgcacagaatcacgccattgatgacgtcaagatcgatcgtagtgatcgccatgagagtgtcatgtcatgtcatatgacgacggattgaacctggttggaggcgcagctgaaccaggcgtcgtagacggagccgccgtgccagaagaggctggagacggcgagcttgccgcgccgcctgcccgacgccgccgcggctccgccgacgccttcgccggcggtggcggcgccttcacgctccatctcgacgtagttgcccgccacgatcgtctccaccttctccgacgccatgtcgatcgatcgatcgatgcttgattgatttgcttctgaattgtgatctctcgatctagctagctctgatcgatcgatccactggatgaactggggtcttgtagttaattggatgggcacaggctgtggtgcaggctggctattgatttataaagaagacgctcgtcgatttgtactgtcttgtcgtgtgtattttagaatttagagtgatgagagtagctagcatgtgtgtatgtatgcaatatatggatggggcatgcagctagcagcacacgagcggccatgccactgatataaacaagtgataacaactacacatatatctgagcttatttgttattcccgatctcttctttcttgtatttcatagtcgtaaaaccgtgtgtcgcacagctattgttattgacatttgaaatatttttttttttaattttttgaggtcacatatacatttgtcgacaacttttcttctagaaatttgacagatgtaattatggtacaatcgagttgtaattacattgtaactacaatgtcacttgtatgtaacttttaaaaatctcttcgtagcatgctattttcgtgaaatggaggtcaaccgaatcctctcacatgtacgcacaatttgattttttttccttccttgccggtaagaatcttgaaacaaatctaacaattcaaattttttgtgaaagttgcgtacaagttatattatagttatatgtaaattacaatgtaattatatcatgatagtactataattatatatgttaaatttctagaagaaaatttatcgacaattatatagcaaaactgaatggtttcataattctgaattaataaatattgagttgtactcagtttgtaatcttagttgtagcttaccgacattttgcttagtctagaatttggaatcaataaaaaccccgttgtatccagtttgaagccgggttttataaattcccattataaaaaaaaacattcatcatgaagtataaactcccacaatatgtagatgtagaatagataagtttttaacatgacctgaaaagttaaatgcatatagatcatgttaatatgatccatctaaaatggtcagatattttttaacgtacgtacgaccagtttttagcaagtaccaattaggtttagatacgtaggagagatctattgtatatataaatattctgattgttcattgtgctccaaaataaataaacataatatggaatattacatgttcttagtactacgagctatgattttctactaatatattcatgtatgaaaagatcggagtttagtgtatatattatctctgcatgcatggctccaggggatgatctaatataaggacggcaagggctcgagtctccactactggtaccagaattatgagagctcttataaagatctcactaaaactttttgtcatacatatatataaaaagggttagagttttgtctagtttatttagatctttgctatatctctctgaatctactactgcatggcttggctaggcagtgagacagagagtcgtcaaagacatggaagtacagattatgtatgtatatcttctgaataatcatttctgataatatatattgctgtgatctccagggccggccctgactttttggtggcccggtgcggaaaaaaaataaaggcccccattcaccataaaaaaacaagataatatttaaaaactcattgtcattaacgaatttcaagcctaataccatagtatacatattttggaggcccctaatttttagaggcccattacggtcgcaccgttcgtactgccccagggccggccttggtgatctctatagcagatagctagccagatcgatcgatgcggttggagcttagtactaggagacgtggcccatgcatgcaaagttggccaatgatcaacgatccatgcatgtccggattgttgagttgtgatccaaattcatttacacttaataaaggccagcttctgccgtacggatcatcatcccttttagggttccactatatatatacctcttgtaagccgccgtgcggcgatgtaacctcacctcagatatagtgaaatattttgctggctagcgcccgtggttttttttctcctgttttgagagggttttccacgttaaatctcatgtcttttgtaattgatctattgttttttatcgtttgttcgtctatcgtttcctaacacggatgtccccttatcattggccgacgatatatagaagatctcaacacgacagctagttacactgatcggccatcatctcgattgattgcaaaagatatgcatgcgcacagaggccacttctatccttaattagttaattaacacgaaaaatacgcacttaattagtttttcgatactccctcttttatgaatattgtaagacgttttagattgtgtaagaaaaagaagttttcgatttatcctaaattaagtttcattaatttttaacaagtttatatagaaaaatatagcagcattctcaacacaagacaaatatacaacggaaatattggatttaatgaaacttattcgatgttataaatgttactgcgttttctatgatcttcgtcaaacttgaaccttaaacgactaattataatacggaacggctaatactccatttctctgtttcactatacctatcaatataattttgattgtcactgttttacttttaattagtttgacgaactttcaaatcgtttgttatgatgaacggatatatttattgtctaacatacttcaataatatggtaggttttgaatactcttgaatttatttataagtcagcggtggacaaaataaaacaaagccaatcaaaattagtaaagtattatgaaataagggagtattgtaatatctacagtaatttggtcattactcagacaggaattaatactccctatacgtctaaaaagacttgatttctctaagcaatctaagaaaatttactagtgaagaaaaacaccaaagtgtctcttatttagtattccctccgtttcataatgtaagactttctagcattgtccatatacatatagatgttaatgaatttaaacacatacatatgtctagattcattaacatctaaatgaatatggataatgctagaaagtcttacattgtgaaacggaggaagtattatttgtaggaaagtagtattgccaaatgggtagctaaaggatatatgttgaatggataaaactccacgatttatatggacaagggtaggggataaaaattaattctttttttaacaaatattgaacgcagtaaattaagtcattttgggacagatggagtaataactattttagaagacaatattaatattatttagcagcgtgattaataacgatgtgttcagtggtcttgtgcgcaattagtaaatatttattttagttttcgaaagtgtttatagggataaaatgtacgtgtatatatgttcataggaataagtatgtactccatccgtttcagaatgtaagactttttaacattatccacatacatatagatgttaatgaatataaagacatacatatgtctagattcattaatatctaaatgaatatggacaatgctagaaagttttacattgtgaaacggatgaagtacgtgtgtatatgagcggttttcatctagaaagagtcatgcaatgctagctagctgtttatataatcaacaaaatattgcatacatatagttgtgcgtagtgtaatttgctagtatggaagcacatattatatatacacacacgtactgtcgaaaataattttaatttcctcaatactatactcgatcaattaattgctttactgcggctttagacaagatcagatttcatacaaatatttttttccatatttttattgttagtgacatagtgtaatacatggagggggttctatctctccatctctctcagctgctgtatacatatggtcggcaagcagatcagagagagcagtggcataactaattagttgtcacacgtgtagcacaataatgtggagcaccattgcccactcgtggagaaatcatgttcaagatgaatcaaacacagaagggaccataaaaataaaaaaaaatgaaattaattagaacggggcataatactaattaatgacatagtagtatatataaaaggaaattaacataaggtaaatatataaccatataaagaaatatcatgatcaaattaagcaattaaagtcatatatagtgtattaccacacatttgccaggtcatgaaaccgttctatatacatgaagtatatgtaggtctattatgataattgtagttagtcgtcttggtatgtctatttttcaatagacattatatatttttgagtcgttatcatggtactattcccatcaaaatagtctcttctgactcataaatgcatcaatgcatttttttttaatccatcatatatcaatgcatccggctcagaataatcatcagtgttctttgcttgatacaggagaacttctttgtgaatcacataaaagtgtcaggaaagtggggaaaaaatgtgatgtgtggggactcaaaaatatcaaaattaaattaaagtgtgcgttcacaagttatgattgacaaggttctacaaggaatcaaggaggtaggcctagccaactttttttaatagtgctcctcttttttttcctcctttaatttctatatgattcaataaacaaggggaaatatagtgtactactccagtagtactagtgattaatttggaatcggaatttcactttgcatatactcatattaagtaacaatagaagatcaatgaagtactagtcttggggcaaattcaaatcaaatatcacttcccagaacgtgcagtcatgcaccaagaagttggtaggtcttgattatgatgatgagctctcacttgttgaaacatgcttctcggaaaacaataattagggaaaaagcaaatcctgttgatgtaatactagttgcaaagtagtaatgttatgcgtgtcatcagatcacataagccaatgtacgtagatgatttattatatgaattaacaaaatatatatagtattccctcagttccaaaaataaatatatgtacttctaggattcaaattttataccacaatataaaatttccatttattctcatcatttcaatgtttctaaagccaatcaaatgcttggaaaggaaatctaagcaatttgaaattcaaaaattgataactaaagtgattaaaaaggattttttttacctaacttagtatttgtaaacaacctagaaatctttatattttataatggagggagtaattgctacgtatatatttctacattgaatgatatttaataataataaagatctaaaaatagctctacgattctactattcttaggagactgattaaccaagtgaattacaaatcgagtatatcaaaaactataaaaaggccagcccaacacacagtagaatgaaaatgaagttgcaatgtgttgagagtgccaacctaactaatgtctggaatatttctagcctattcatgaagatcagccaacttttttgacttgcaccaaactgccaagctaacttaattattggaatatatattataatcagcaatcagaaaaaagggggaaacaacaatgtctaccgaatagctagctaggccggtgtgtaattggcttcatatatgtgcatacatatatattgcacaaacgacctatgcttcatacatgaacgttactccatccgtttaaaaatatataacgacctaatataaaatgagacatattctagtaatataaatctgaatagggatttcttagtatcgagatgtatcccatcctgtattacgttgctatattttggaacggagtgaagaataatcaatcaactgagcttacttgcttggtagcttccaactctgtgtgatctcatgattacctttggagctgcagttagctgttggttactaaagaaactaaaggtgcaatataatataatggtacccttaagcttaatctctctcatcatggccgccctcgatctcatggtggcctagctacctttatttctgagactttttcatctctgaatctgccgggaccatgcatatgcatatgcatagaggtgccccaatttctctatctttcggaccatctcatcaaaaggacgttcacagatgatagatcaactgttgtgtaataggtatatttgcaagtttcctttaatttcaattttggcatgatcattacacatgttgagatcgatctagagagagagatggcaggagtctttcagctggcttgagtacgtgaaggcagagctggctggctagctagcttatgttgaattcatcacttttgggctaaccagcattatgcattatgcatatggccatatgggcctgattgatgaaagggccattgcaccttgactgaccgtgagatcgccttttaaatgattatgtgtatatcgatcggccttatattaatatggctatactatagtaatatggtgctactacctctgtaaaaaaaaacttcattattttcctatctcacacataccaatataaagtcaaaagactaaaatgctctccatttttttcgaactccaatacatttgttcctcgcttttttaaatctctaatgtatttgtgtttcacttttccaaactttgatgtattaactgtcttaaaaatgaaggcattatgggacaaatgaaaaaggtaacaataaagtctttgtgtgatggagggactactacatatgttttaaaatacaaattgttgacttttgactattcatcttattaaaaagttaatataaatatgaataagtcatatttgaagtatatttaatgataaaataagtgatatttacatactcccttcatcttaaaatatagcaattctagctatatatacggacatacttttatgcaaatacatatagctaagttatattatatatttcaggatggatatagtagtatttttaataagatgaataatcaaattaatttattatcatcaggagtcaaacacatcatatatttaagagtcctgctccggtgctttctacttggagtagaaagcaatctgagccgttcattatatttaattgtagggttgtgatctatttctactcccaccagagttagtggtagtagaaatgtacaagggtatattcgttcagggataataattcgtgcaggggtattatcataatttatcaatatctaactcatcttcggcgacgccaccgccgtcttccagcactgcgacatcgtcgcacgcttccccctccgcggccagcagaacaccatcaccgcccagtcccgcgccacaggcttctcgttccaggactgcagcatctacgctgacaccgacctcctccgcggtgcccccgccggcagcagtgtggagacctacctcggccggccgtggcatccgatcccgagcagctcgccattctccgacacagtggaaaactaatggctgattccttcgacactatggcaagaacttgccatggagctcaagaacgccctctcaacctcttcagaggcatctctgctaatcaagcacatgacgtactctatcactgatgcatcgcacgtcaacgtgatcctgccatcatcgccggcgaagccaaattcctcttgagacatggcgaggagctcgccgaaaaccaccgtgcaaaggtacaccaatggcaccctcgaaccgtgccccgtcggtggtgtacaccgcgctgtggcccttgccggcgagagacgacgacaccatgctgcagcaatcgcctgtggtgcctgccgtgcccatccaccgaacctgatgtgatgcgaaccgaacaaaacatcccatgccaaaattacccctaaactatattaggagattacttacctgcccttttaaataaacggtcgagattaattctacttgtagtagaatactgcaagtagagtgcaccggagcatcaccctttatttaaaagcagaggtagtcgtagtttttatctagatattaattatattacaacacatttattctgagacacttttgttagacacgtggaggaggataagtctacggttttcatgacaccacaggagtcatcagagcttcactagatggtggctgacactaccaacaaacgacttgaacgtggttcttataccctagaactactatgcttttgaacttcctagtcctagtattgccaaataacctcccaatattctttttttttgaacgatctacctcccaatcttctgaataccttgttcatgtgtatgagccattgatccatagatggtaagtacccacgaaccattattaatttagctagggcatttgtaaataaaatgatttaaatgatgatctgaacattgatgtaaatttacattaggcttttaaaacattcagaattgacaatcgtcttgaaatgatgatatatgtgtgtcgagcaataatgctgattaaattctcatgtctctgtcaccataagatcggtcgacacatccgcatgtgcttctgctttgttcttgtcatgtgtggctctcttccattaattactttgcattgcgtgcatgtatcatatgcttaatcatggctcctagctacagtcgctagtggctggatatctaaatgcaattaacccattcgatatcgatgtgcggctcatttctggagcgtgctcgttgaccaaggtggctagctgaatgcctgaatctgatggcatctcttttgctcaatactccgaataccatcgcaaaaaacagagtctaaaataccattgtataatgtgtcatcgacatatgattcgtattgtgtaactcatgtagtatctctattatatgtgatggtatttttcatatttctttctcttttggtaattagctcaattattcagacttgaataaaaagaactactactttcatcaagcaacatacgatgattacaatatatacacgccattgaaaacattactgctttcatcaagaaacatatatacgatgtttacaagatatacacaacattggagatggcatccatgttgacaaactccctacaaaatcattcgtgaatggaaggagactaccagcaaaaaattaggaagcccacaaagttggccaatgttcaaaataactaaccagcccatgtacatataactgggccggatttggagaaggcccataaacttgtacataaaaaacagtttttgtcactttgggttggtttggttcgtggcctaaataggccttatcaaattttgtcagtgccaaattttagcaagttttagcatgactaattttggtaaggcaaagttgtgtttgtattgaagccaaaatagtttgagttcactattgaaatggcctattttcttaggcatgtcaaattttggcttcaaaccaaatagacactaaacactattgaaattgccaaatattggtaagtctaatttaggcctcaaaccaaaccagccctttggcaatttacagtacaaatataaatttttaatgcgttaataaaattggacaatgttgtctataattttaaatgaactcaatgttctttcatcctatttgaaatacagtaatttcactaaaatagtatagttttcgtaaaaaaaaatagtaagagagatttctcgcgctccaaacattcaaatacagcatgattgtatctcgtcgtggaattgccagtatatgcattattgcatacacgttcaaatacaacatgatttgtattgtcagagcccaggtatatgcatgattaaccactacggagtactatactagtagtgaatagtatctggtccaaattaatagttcctctctgatctgggtctcagatgtgatgaactatactaacatgcaattagcgtatactaatcgctggaacctggaagcgcgcgctcatgcatgttcaaatgttctttgttgcgtacatgcgagcgagtggcttttctttataggaggacgaataacatatgccaaaaactttagtttttctttgaaactttgtccctcttctcaaattaaagttggcatgaaggggaaaaatgtcaattgtcaaaggcatttatacattaaattacaatatactccctccccgttccttttacttacaccagacacagttcatgtagagtaccaactttaatagcttatacttttttagaaagaaaagttacaatatgtcgaagatgtcatattatcagaatacttttattataaatataactatttagttcgtcaaaacatcacaacttaaaagtcttcaatgttctaaaataatacttccttcattctaaaatataatatttttaagctactcctattaatctagataagtgtaatgtccaaattcatagataaaaaataaatatataataacggatacaattcacgggtgcatgtggcagctagggatgcaaatggaccgacacgcgaacccatttataggtcagataagtgagtgacccaccggttcccatatatcgtggcagcttgccgtacctgaggatgcaagtggttcgacccgtgaacccacttatagattaattaattctaagtaaacaacatgtcaattcgtggcccgtgggttacccactgattttcggcctcgtattttcgtttatgcttatgcttatcagctaaattttgaattttcaaacttaaatttgaatctgattttgaggttcactcatcgaagtttattatttaggcattgcttttagatcactaataacacgtatataaaagttttattcataaattagttttcgcttgtaaatatgttattcggcatatttcaccaataagccaaacaataggatcctttacctgtaagtaggttcgtgggtctagcaacatcaaatcatcaaaaaccgtcgagttcagctgtgcgtcaacacgacacgtgtcacaagaagggccgtggcgtctgacgctgacaggtggggccagaaaggggtgcatgacgcagaacctgctggaagtatgcggaccgtctgtttcttgtgatgaacggccgagattgattgacgctgcctcgcatcgcggatcatgtctgctggtctccgtccgttcctgatctgtggacggccgggatctctccccacaaaatctgcacacgacgatcgtatcacagtggaattatttcttccaaatttttttccaaatcactttccaatcatcatcgcgtgcgccaatccgaaccaaatcacgcagagactgacaagactagctatgaatgacaaagctatgctacagattagccgtttctgaatctgcgatgctaatgatcttccaaagaagaaatctacgtacagaagtgctaatgattgtgagcagtgcagcagcagggctttttaggcgaaactgaagatcttatctacactgcattattacttgactctctctaatatacatctttaatttgcactcttttgactgcacagtaaccgctaagaacggatgctgggattaatccaaactaatccacatcaacctgcaccaatcatgccatcgagatcacaacagcatcttgcattgcaagcattcttcctgctgaatttcggaactgtcacattcagaatgatgttcagaagtttgatcgttaaaccatagaacagcgtataagcaaccacaaaatagtttgtgggcaaaacttcaatatctgtgctattcgtggtttaaaagaaaatgctagaaagaaactacaatgagaaagccacaaagtcaatttcaaaattcaaattctgacaatggcttataagctgaaaagcaaacaatgacattgcagaaattcagtcaaacaaaacttaagagagagagggagagaaatattcagaaatagtattttagtgcattcttgccacaaatgtagaagtattcaattaacaggtgatctttctactctcctctaatccatggctaataaaatgcagagaaggaaagaaacaggtgatcacatcacatggtctcatcagaaggtcaggattgggagcatgatggcatagcttctgcatgcccaatcgcccatgctgcaaccgcacataaagatccccttttttctccttggcatttgtgttgcatttgtgtgtcttttcattcattcccacaccacccaacaccaccacaccacatttacattacattacaaccaaaagcttcattaaggtcattagtgttaaactaatcatggggtaatggagcctaaagcttaagctgtcttgctcaaaaacaacaagtttttagcttagctaggcatagtgacaacacactcactcccctcatttcatcaaacaccttcttcttcttcttcttctccaatggaagctagtgcagccaaggagaaagacaaggatggcaagaagatgagcagggttggaagctggggatccatggcgttctactcctcgtcttcttcctccagaagccaaccagtgtctgcagcagaaggcaagaatggtggcaagaaggagaagaggaggagcagcatcagcaggagcatcacgtgtgccggatcgatctgcagcaccaaggagagttcggtgtcgagcagggggagaggccggcgccgccggagcggcggcggcggcggcggcgatggcggcggcggagggagcacgtcgagcaggtcgctgatgggtcccgggtaccacggcgactccgcggcggctgtctccgcgtcgtcgtcgttcaactctgtgatgacggcggcgacatccgccaccgcgaccaccaccaccaccaccaccagctcgtcggcaacctcgccgccgtcggcgctgtcctcgccgctgtcatccatcggcggctcgttcagggcgatgcagatcaggaagctctccggctgctacctccactgccactcggtgctcgacccgcgcaccctcgccgccgtcgtcttctcctgccccgactgcgacgaggtgttcgtcaagcccgactccctcgagctccatagatcaaccagacacgcaggtatcatcgcatcaccatctcaaaaccatcaaaatttcccacagtatattcgctcgtttcgtacatgccacctaaatagtcataaaaaaatttaaaaaaaatttggcaacattgattaatatgaaatatatcactccactaatatacaattttaaatttaacttctacaagttataataaaaataacaaatatagctaatatagctgcgagtgtatagtaactatttttagtttaatttatttttttcaacttgtagaaaatgaatttggttttacatgtttgtggatgatatatttcgtattaatctattaaactttttaaaaaatttaataactatttagaataacatggaaataacgagaggatgtctctcgagagatagaaaatccacatcccactgaatcttctcatctaaaaactaacaatccatccattgattcgattgggattgcagtttcagagctcggggcggacgacacgagcaggaacatcgtggagatcatcttccagtcgagctggctgaagaagaacgcgccggtgtgcaggatcgagaggatactcaaggtgcagagctcggacaagaccatcaagaggttcgagcagcacaaggaggcggtgaaggagaaggcgaggagcgccggcgacgaggccgggaggaaccccaggtgcgtcgccgacggcaacgagctcctcaggttccactgcaccaccttcgcctgctccctcggcctcgccggcggcaccgccctctgctgcgcctcctcgtcgccgccgccgctgcactgcaagctctgcagcatcatcaaagacggattcaggtaactcgaccaagatgttcagagcccataattctttttttcacaaattcatactacctccgtttcaaaatgcttgatgtctttaatttttgtataacgtttgactgttcatattatttaaaaatttagtatagatatataaaagtatatgttaagattatagtttctttaataacaaaacaaaatacataatatctatataattcttagacgaatgttcagatgttatatgaaaagtcaacggtatcataggatggatggagtatttcgtaataggttaatgtgtattttactgacaatatggatccgatcccacacgtcagtgagacaatgggtgtcatttaaaagatttatgaagaacattttgttgaattataagttgtttggtttgattgatgaacaaaaaaaaaattcatcagggtggatggcaatgggaggatcacgacgatggcgacgagcgggcgggcgcacgacacggcggaggtttcgccggacggcgagaagagggcgatgctggtgtgcagggtggtcgccggcagagtgaagaagctccacagcagcaattcttcagaggatcatgactgtgactctgtcagcccctgctcagaaggggtttactcagatttggatgaactgttcgtgttcagtcccagagctatacttccttgctttgttgtcatatacagtggctactagatcaaagaaaaccagtagaatagcttgattttgccactgttcttaatctagtttctttctctgttgtaggttgtagtatgtttacttacttcatgttcatcaagtcagatcataatgcaaaaatggaaaaaaaaaaactgcctgcaaagtgcaaatctttctcttgtgtcacagttgctctcaagtgtcattcaaatttgacatgtttgaaaagcaggtacaagatgggaacaaggccatgagatagacaccaaaaacagtgattttgcttgcttccaagatctaacagaagtacaaaaccattgtcaatgcagagtttttgtccatgtgtgctgagcaaacattagatgcttacacccatgaacactttgggttcttggaagaagcatctacttagacaaaaggctaagaacaaacagctactttggaagaagcaatgaactgctaaatgttatactattcctaccctgcatccagctacatccaactcaatatattactaaatgcaagtatagtacagatccctagcaaatgctgcttcttaattgtgcagctctacaaatataaattcctctaaccaatataggttaagagctaagcagtagaggcgatggtgattatacctgtattttagtcaatcatattctgaggttgtctgcttgtggacgacaagttgcacaaactgattccaaacaaagagagcacacattcaccagattcaagattgttcatcaacaatttgttaatctagcattatcgtggcctctgatctgttcactgcaaaactggacaaacgtcaacagacaattttacagcaagaatgtcatttgtcacgaaagcttaaagaagatcagtgtcctcaagttgcctgtttttgttcgtttggattcagcaaacaacgtgcttcgaacgctatgtcaggatgtgccatgatttgtttaaagaagtcaagtctgcagtagatctaaaattgattgtcttacctagttatctgcaatttcacatcaattggttcaggaacttgcatcagctagtgcttaactagttgtcttttgccgtacaattgtttgtcacaactcacaaaattaccatatgccatggattattgagctaagatgcctggtattgcaggctacattggataccagtgggtatcaaaattcctagtggtgaaaaaaaaatcgacatccttgtgagttgggaaatttggtcagatgaggagtacagcatattagcccaactcttaatctaagaaaaaacagattttgaggctataaatgtaccattaaaagtctaaaattgccaggtcaaccacattctagagtgacgtggcatgacacgtgtcgaatcaaaaggagtctcagatccacgggaaaatttgcaataatttgtatatatatataggctgtgttataaattttttttatcacacaaatatagataattagataaaatagataggttgagtgactgtcttgctcatgtatactgggttacagaataaaaactgagggccagaaagatcgcaacacaaaaatgtcagcaacgctcaatgatgatgaggccagcaagatcctcctctcaccagagcctgactaaacacaatcaccatccatggagcacgccggccgattgctgaaaaatcaaactctgcttcagaaacaaacggtagcataaattgtaaccatataactgaaatgtgtttcttcagtatttcttatagcaatgtaacagcattttgtccttataagctgttacttccttcgtttcataatacaagtctttttaacattgcgcacattcatatagatattaatgaatctagatatatgtgtgtctaaattcattaacaacatattcatatgtctagattcattaacatatatataaatacgacttacattatgaaacggaggaagtacgttattgctataagaactactgaagaaatgctacatataagagcaggtacaatagcagcctattagccagctataaacatattttaatgagataaaagatgagagagagcagcggactacagatctgtaaccagctacagcatggactccaagacgcagtgtgtgtatgactggtgggactatatattaatagtatagcaagcaactattgtataaattggctattagattggctataaataaattggagctaacagtggactatctaaaatgtcaacaccccccctccccccccccaagcaagtacagttctaaattattgaaagctccaaaatccaaatgatatattatcaagaaggcgtggtggttttacaatgcgccagtgatttgtcatttcaacagcagtacaagaacctcaagcacaactgatgcaggtaatcaacctgagcagacggtatcagggttaacattcggaagaaacctccaaaatttcggtgggtcatggtgaatgttctaccggctgaaaaaaacattagtagcaaaatatgcccaaaattcgttacggaatttcggtgacccacggtattgttaagtatcggatatcataaattaactgtatgtcccctcagatttgcttgaactacctagattgtgtttttgcaacacatttccaacttcactccctcgtttttcaagcgtacgtttttcaaacagttaaacagtactacctccgtcctaaaatacttgttgctttaagttcttgtttgtaacgtttaatcatttgtcttattcaaaaaattatgaaattattatttattttatttatgacttgctttattatcaaaagtacttttaagtatgatttaagttttttcctaacgttgaacattagtcttattcaaaagatgatttaagtttttttctaacgttgaacattagtattattcaaaagattatgaaattattatttattttgtttgtgacttactttattatcaaaagtacttttaagtatgacttatcttttttatatttgcactaatttttttaaataagacgaatggtcaacgttagaagaaaaaagttaaatggcatctaatttgggacgggagtagtattttttaaaaaaaaagtttctatagaaaagttgttttaaaaaaatcatattaatctatttttcaagtttttaattaatttaattaatcatgcgctaatgaatactaaggaacctcaactaaggaacactacccatttcaaaacatatgatttatgtaagtttttcaaaaaagtatttgaaaaacgtgtacattttagaatggaaggagtggcaatttactagtagtaaagatacaataaatatttcttcgtaaacacaacctttcccaatcataacaaaatcgaggtgcaacccgtaagatttttcttttttaaaaaaaatttgcacctctcctgtcgcggaactgcttacggcaacatcatatctctcggtgtgccgacatcaccggagcagtaaccacctccgccggcggcgccgacaccgacggcttcgacggggagacaccggcctccacccgtccatcctccgcttccttgtgcgttgccggcgatggagaagacggcggctgcccctgcatctgctgctgctgccgcaggaggcgccggaggtgaggcggggcgtaaaacctatcattggagctgaacacgaagcagcagcaggaggaggaggaggaggagggtgggtcggccatggcggtagggctacgaggctgcggatgatggggttagggtttccgagggttgtggggttgaagcgacgtggtggcgatcggtttttttttttcagagagagagagagatggcgatcgagttgggtccaggtttccaaaccgccgggccagggttaccacgccccgacagtaaacacggttatcgcgcggtaaccgcggtaaccgtgaaaaaccgtacaaaaccatgcaaatttcatcaaaaatttaaattattttttaaatttatttgaatttaaggaggttaccgcggtatttacgttaccgtatccccgcggtaagctcggtaaccacggtaaccacgcggttacgggcggtatgatgaaccctgacttgggtcgctacaatttctagcggtcaagattaaatgggctgggctagttgtccgcataatgggccagacacggcggtcaaggcccaatctgtcagaaactgatgggctgggcccaatctagtacacgatgttgcatggcctttttctgacgaaaatcgtcaaggttattggagagtaatgtaaagcagtgatcaggaaacataaagaaactgatgatgatagcacatttgcactgttgaacatattgatattcaggaagctggaagatcacatccaaatgatcattgcatgtgttagggacgcgcacgcgtgtgtatgcgtgtgttgtggtgtgagtgtggtgtgtgttagtgtgcatcctgagttatacccttttaaaaaaatgatcatggcatgaacatgttgaaaaattgcacgaagaaattggatgagctctgcaggaaaatttggctggatgaggctatcattcgccaatcttcgctaattttaatcattagtaattaattagtgataattaatatatggtgcaaacaagacgtcatgatcatacgtacaacatccgtccaaaaaagacaacttctagaaatgaatctggacatatgtttattcagattcatccccagaagttagtattttataggacagaaggagtaggtggttttcctctaaaacaatatttttacgcagctcttttaagggtgtgtttagatcccaaaaaattttggtcaaaaatgtcatatcaaatgtttagacacatctatgaagcattaaatgtagacggaaaaaaccaattacacagtttacatgcaaattacgagacgaatcttttgagactaattgcgccatgatctgacaatatgatactatagtaaacatttgctaatgacgaattatttagacttaataaatgtctcgcagtttacaggtaaaatctgtaatttgctttgttattagtgtacgtttaatagaaagaactaaacacggcctaagtaagcatagaaagtttgtgtttttgtccagcaaaagaaaaggtaggagtctgtatgtgaattggtgataaacaaattcttgaaagtaagaatgcaaaagatgaaaaattatcgaaagtagaatacagaaagaaagacaaaaaaaaaaattgggggtctgtcagaccacctctgcgccaccctgcactggtaccaccagtcaggaacgatcctctacagccgtcagatggttccttccagagatccatccaagccgttaatcacgctctggcccagaggtcatggacccatcaaccagactagagtgcttgcctccttattggtaaaggatgcaacggtacgagcctatagaacagatcctgttcaagtaaggtcgtgccccaagcctccaagctccagtttataagtagctcccgctccaccaaaactggcgaggtggtactaatcgacagcgcttgacctgcatacatttcgctggtagcataatgggcccagcccatctaaatcatctgcgagttattgaagtccacaatcacattcccaccgaaccacgtgtgctgtctgcactgtttattctgagattaagcttgaaagcaaacgttgtatggttccaattaaacaactccaagcaatatagagttttttttagataaaaacaataaagagatttgagctgcttacttatgggaaaataatactatttcaggttcaacaatgcatattttcgagtagaaactagtagcagataacttccatgtctgctgttatactaaggtcctctttgtttaggcttataagccaacttataaatcaaaaagtctaagccaaaacaaacaagcagctttttcatttggcttttttgaagccataaaccactctaacactattaagccaaaagctaggttggaaaagcttttttggcttatatgagatagatgtatgactccaccactaaacttaggacattaaatccactggcttataaatcatataagccaataagctgacttaaaagtctagtccaataagcctaagtctaaacaaagagggcctaaatcaaaggttacgagagaagcataatgctttgccagtttgtttcctggccggtgtgtactgcaaaacattcatgaactatcccatgcttttgctctcaagaaacatgcaggattgcaggttacctagaacatgagaatattcagttgcctttgccaattttttttaattgtggatgacatgatactgtgggagtagtagaacgacctgctgtatgtaaaggatgcaactttggaaacttatgtaacagatcaacaacaccagaagttcagttgtgagcagaaattcagatccatggttatgcaaaaaaaaaaaagttacatatgacaactgtcaaagatgcagaataattctatccaaactgtcacagctcacaagctgccttgggggagcactattaacctgctccaagcctccaactgcatatttgaattcagtgtgaactatgaaatggcaatcatgcagataactatatttcatcagtgttgttacccataccctgagactaggagaggaaaaaagagcacaccttcatacaaaagatataatcaacggtggaaaatgaggccaaatgaattgttcaaatactttgttgttggaatcaaaccaaacaacagtcataccatatagtattattagttagtgaactatatgcaacaagtaactctaccgaacatgttcaggtttctgcatattgagcaccagagacgcaaattggcatgcctgcatccaagcccaacaatccaaatgctcatgacacaacaaacataaaagagtacatgcttagtcagcgccagcaatcataatgttaatattataccatattccatttcctaagctcaaatacagatgtcaagaatatttcggtgaactgaacatcgcatcctaacgcatttcacttgtattacttgagcttaagtctaagaatcagtaacatcgtttgcacatctcaaattactaactgggaactcctcttaaaaacagagagatattgaagggggtaaaccctttctacaactctacagcaatatcacctagtgagagagaacagatcaacagcaatgccctgcgcctggaatgcattagcagtttagcactagcccgactactaatgaactccatacatacagcaaaaaccaaataaatagccgctgttattatagtaaagaaataaacttattgcagttcatatgatcaaaggctcaaagcaaacaggcaattagtaggtctttgatgctttccattgtcaatattgcttctttctattcatttcctttctttcccctttttcggtagaacattaagacaaacaatgacagggacgatcacaagtgactctttaatcgcttttcattctaaccatatttggttaaataaacatcaacttaggtatgtgactatatgaaatatcaattaatggactctttcaaaaccaagggacacatcaagacacaaatcattgcaatttatgctgctgagaattccataagatagtagttgtagtaaggaacatcaaattaatatatgttcggtaagaaatgcataaaacaagtcaatacataatcgcctgctaaaatccattactagtagtagatagcacactacaccatgttcttttcatcaaccgcacacataaatgtgaaatatattaattcatcagctatatgcaaaaacaataacataagacaagataacttacaatacagaactggctacatactaaaccaatgcttttccaagccacaagagtcgacctttacgcattgcaaggtttagtagacttcaatgaaattccagtgacaaactcatgagaaaaatgaactcttttatcaccactgcagaaaatcttacaagatgtaatgcaatcagaatcattttgacaggagcagtacatcaggcttccgctgcttgcctggtgtgtttggcttggagctgggtctagagctcgacgcggtgctaccagctgtgcctactgacacgattgccccagaagctgctgcagctgcctccttggcagccttgcgtgcgcttttgtcgagctcgatcaagctacgggacgccaagatagcctgtggcacaagctcatgacacgcgcgggcatagacaacccgcacagcttctgcggcggtatcccgcacctccgtcggattcagcggagctaacaggcagtgaccaagaactctcatcactggctgtagaagctcccatggaagtggcaccctcccctctctctcgccacaattccgaccattggtgtctccgttgacgcgcatctttgccatttcctcctccaaggccttcccgttctcggcctccgatgacaatggcgaaacggaccccaatgaatcagcctcctcctcttccaactccttctcatcaagctcaaatcggcacttgcagtactgccccgcccacgccgccacggcgttgcaagcatccaccttcgatgcaggcggcatctgcgaaatcttggcatagtacgcctcgaaggcaactccgataatccccgcgcgcttggtcgacttcaccgccgcctgtggctcaagcggcggcgatagcaccccgaccacaacattccccgcgggtggggggatcggcggcggctgtggccggcgaggggacttcgagctggggctggacagcggcgtgtggtagagggaagggacggagaggtcgggtacctggacaaggacgggcttgccctggcgattcttggcctcggaggagtagacggcgaggaggacggcctcgaagccggagagcgaggaggggagcgcgggcggcaggcggaggaggtagagcgacgagaggagcgggaggaacgcgagcgcggcgaggcggaggtcggggtccggggacagcagcgtatcgtagagccagtggcaggccgggtcgtcggcgccgccccccgaccggagcgccgcggacagcgcgacgtacgcggcggacgaccggagcagcgcgcgcgccgggcggtcggagtcggcgagcgccgcgacgtcggaatcggccggcgccgggaggatggacgacagcgccaggatgcgggacctcgcctgcgagaccgactcccaccaggacggggtggggtcggatgcggacgccgccgaagagttcgacggcgaggccgccccggcggcggacggggacggaggcatcgccggcggcgagagagagaggaaagcgagatgagatttgggcgatctctctccacagctctcgaatcgagggacctttctgcgtctcgcctacttctccatgggctcttttgtaaataaaccacaagcccgaggtgttattactagtactactagtaggtggtagttgaccatttctttttcttttcattttttttgagagagaaaaatagtgagacgtggcagttgactggttcacacgtcgacgtcgtcgtcgtcatcacgtcgctgcaccgagcggccgcatgcgcacccatgccgcggtgctgggcacgccggcgtggagcacgaaccagaggtagtaccccggcggcgccaccgacggcgacggcggcgcggccacctgcgcctcgtacagcccggcggccagctgcgcgacggtgcccacggccagggacaccaccctctggttcatcccgaaggagtgcgtcgcgaacgccggcgccacggccgccacgcgcacctcctcggggccaccggagaccgcgccgccgggcacctcgaacctcaccgccgccgcctccccgtacccgacctccgacggcgccgccaccagccgcggccgcacgccgtcgagccgtgcgtcgaagtatggtggtaggaacgcctccaggctgagctctgtcgggtacgtcacgttgtcgaacacgtagccgacgtgcgggttgctgccgccgacgagcacgcggccgagcgtgtccagcgtcgccgacgagtggtacatcctcgggatggttgacgcggcgagcacctcgaaccgcgcgccgagctgcatgtccggcttgtacagcaccgggtaggtgaccggctcgcgcccgagctcccaccccgccgtgccggccgccgcgccgttgacgatgagcacgtcgccggtggggagcagcaccatgtcgcccatggcgcgcggcagcggcatctcctccatcgcccacaccgggttcgcgtcggtcggcgcgatccggccgcaggtccggtcggccggggcgaacgtgccgttgcggagggcgaggcggtacgcgccgcgcggcgcgccgccgcagacgagcacctcggcgtgcgacggcgagtccggccggagcgggaggaggacggaggatcccgacgacgggtagttcctcggcacgccgccggggatggcggggaggcggcggagcggggcgcggttgtaggggtcgaacacgacggcgcggtcgttggcgaagacgaagacggtggcgtcggggaggaggtggaggaacgggtagaggttgtcctcggcgtccatgtcggtcgtctcctccaagaacgggaacaaggtcggctgcggcgccggcgcgtcgtcgtgggggaagaactcgaagttgaactgccgccggccgccgaggatgagcacgcggccgtcggcgaggaggatgtcggtggcgtaccaccgccggacggccaagaacgacgggagatcgacccaccccgtcgacggcgagaagaggcgcgcgatgcggtcgccattggagaacccaccggtctgcagcagcgtgccattggggagcagcgccgcggacgaacaccatgggttggtggcgagcgggtacggccgcagggcgttcgaccggaggtcgagcagcaccgagtgcgcggtgcagtcaacggcgccgccgccgccggcggcgagggcggtggtcgccgcggcggcgcacggcgagagcgcgtcgagggagatgttggaggggccggagtcggtgcggtcgaacatgaggacgtagtcgccggggagcagctgcatgtgcatcgccgagacgccggtgttctggtgcaggagctgccactcgccggcgaggacgacggctggctgctgggccacctcgggctcctgccatgggtcgccgccgatggcgtcaccggcggcgccatgggcaatgtagatggtgatcaggaggaggaggaggaggagggagaggaaaggtgatgcctttggcatggttgctctgcatgcatgtagattgatctttaagctgtctgatgcacggcattgctgtgatgtgatgcacaagggtttgtacaaaagtgtggtgagttttttggtacaagtttggtttgaggaggttgaagggaattcacatttgatggttaaaccttcaaactttaaaattcagtttaggttatcaaatagttttgtggctccgctctgtttaattgctacgcctatgttaatctgatcgaaaactatatttgtgttttcacatcatggtctaagtactaaaacaggaagatgagcaaataattgttgtgtttagttccacgctaaaattaaaagtttaaagaaattggaacgatgtgacagaaaagttagaatctaaacaaggccaatgacacaattcgatgatatttaattgttgtcgtttacgttagtttatttttctcatgggataattttcttagaggcagtggcatttccagcaggatttcctttggttggtttggagttagcattggaaaagagagagccaatctcttgacatcacgccctattgatgaaagggatttgtggtttctagtaggtagaaattacatttaggagaccggtgataagaacaataagataaagggatttgatgtttgctcttatttagttccaaactttttctttaaacttttaactttttcatcacacaaaatttttctacacacacaaacttccaactttttcgtcacatcatttcaatttcaaccaaacttttaattttggcgtgaactaaacacaccctttgtcactctattagtcgagtttcttgccattatgtttgttttattgggcccgcttcaataatcgggtcgaatacatttgctactaaacttgtaactaaaaaagcaccttgtgtctcaattgttttatcgatacacgtctaatccagtttgaactataaattctcatatcgatggtttcctctccacatggtttcttaaggacacgtttaaatcttaagtaagaaaaattctactcctactttgctaaggcacgagaggcatttggtacaaatggaaaaaaacagagcttttaaggcaagccgcacataaccgcctcaaaatccttgcccaccaaggatgatcgactctcctccgttgataagcaatggacgcgggcggttttctttaaacaaccgtaaaaccaaatgaacgctcctgccataggttatagccaaacgtggctgccttagcaatagcgatccatatgatttgtgtgttggtgatatatgttcatgtttacagagctgctcattatgtagtatgttgtgataaaggatataaaaaaacaatgttataggcaatttgcaccatttatagtttttttcttgag

SEQ ID NO: 72310 - DNA, 663 bp, Oryza sativa
gcaatagcattgcaactaatagttttaggaaccgaaaaataaatggtaacagaaataagcgatctagtgaatatccctccgttggattgtgaggcagaattgcctccgttggtgttgtcgatcgaagcgccgcctcctgctccgggtgcacctccagtagaagccatagcgacgacgacgatgagcagaggaagtagcaagagcagtcgtggggaagcactccccaaaaacctgatcacccgcctacccgtgcagatctcaggcaagggtgtggttccggaggccctgctcgtcccaatcacttgtgcgtgcaagcgattagaaccggggaagaacagaagcaacataggcacagaggatgaaccagcaatggagagaattcgtggagagcctattcgtgtgtcgctgtctcgtcctaatagcgcaaggagagagaggattcgcatccgttgccgcagtaacgatgcgatcaatcagaattgattcccccacccatcacagaggtaatctcgtgaattgaattctcagcacagaggatgaaccagcaatggagagaattcgtggagagcctgttcgtgtgtcgctgtctcgtcctaatagcgcagggagagagaggattcgcatccgttgccgcagtaatgatgcgatcaatgggctgcagga

SEQ ID NO: 72311 - DNA, 39787 bp, Oryza sativa
cttgtccgatatattattcttactttaatatcctgatatagagtagtatcggagtattagctgatacatgctagatctatctgatcggctatactataaacatatatagtcttgttattgacatatattttaatttaagtgatttatactgtctcggcatggtgaccgatctatcccaatcacttgatttaagtatatattgatataagaagtatatatcattagtcgatcgagtagatttagttcttctttacttgttcatgactgctgatcgatgcacagatgacatcggcttaaagataaatgatatgtcatcggcatctagccgatcggctatcatttatagatttaaccacggtttctttgcttctagttcttgatgattacaggatcaaatcagctagcacgctaacacatctgaatgcgagctttggacctgcactagagttaagcagatctctcagaccacgtgttttctgtcaacatccctctgtttcagattataagacgttttaattttggttaaagtcaaactactctaagtttgaataactctatagataaaaagtagtaatatttacaacaccaacatagtttcatttgagtaactccataattgataatatttcataatttattagtttagggttaaaaatattactatttttttttacaaaattggtcaaacttagagtagtttgactttgataaaatatcttataacctaaaacggagggagtagctaatacgtgtataatattttttatacatgtattaactgccaaaaaaaatatagggacgaatgaggttttatgaaatatttatcctaaaacctgtgattctttgaaacaagttataaacacatgctacaaatttagctggacggtttctagccaaaaattattaagtccatatcttttaacaaacccgctccaaaattgatagaaacctgggagagttctttttcctcattgatagaggcttgtttccatgacagcgtcttctgaatatagtattagcacttgaaagaaaattctacagcagagaacagctcaccgatatacaaaaccagagattatgcactaaaatatgtagtaacaaaatagattcgagcgtcatgggcggcaggcctctgcaaggctgcaatgaacctgtagctgtcggcgttgcctttctttggttcttcgcgaaacagaaaacggacatgtactacatgcctagcacgttgcattagttcttagtcaagtggcagttccattctcttctttcggcgtcatgacctctttataagtggacacatgtacagtacttataagttcaaagcattcatttaatcttttattttttactccatccatttattctaaataagtttatttataagtaatcatcacattagagtaaataaaggtacaaaataaatgcattgaaagtaaataaaaaattttttatagtgggatttgataaaatagatatattctagtcagtttggttttatattggtatgtgtaggatgtgtgaaaaataaacttattttgggacggatggaatttttttaataatataccatcaataactataaaattaacgtcatattttcaaattatcacgctacaataaacatagatgttacattaaatactccctccaattttttgaatctacattaaaagatgattgtagtattagttaaaagttacggatatttattaaatgccatgcacttactcctagataagtattaaggcatactattgtatgggttctttttttacatgaaatactattgtatgggttcttttttttacatgaagtacatttgataacatgaaagagagaagagaggaaagggaaacctcgttactatatttgatattagcttagaatcgagtcttagcatttactaatactaaaaagaatttggttgcatggagtgaaaaaaaaaaagataataccaaatattttgatacaataatagataagaaattttgttgtctcaactattaaaaagatagttgtattaacaagagcatatattggaatttacccatgtccatgcccttatctagataaataagcaggagtattttcatttcccaaatttgtctgacccatttggccagttcaatccaaaaaccaagtgtccaaaatggaatggatccgtgccattgttgccttaatgccgtcctcaggcgattttctccgttgtacacgccctgattacacgggtggcaaaaaatagcctgattcttctcttcttccttttcactgtgctccatatgccctcaatatcctatcaaatccaataaatacccttgacacactaagaatcgaattataatatttacatttctgcccctcacagggctcaactgaaattacagaaaattgtcgaagggatcaagcgaaaggcttcttttatgtggaaaatggaataaaagtctcggattaaagaagcaattgccgtttcagacgagggtggcagccatataatttgcttgcgccaaaaccaaacatagagcagcaatagagaggaggagagggagatgatggcccatctccttctcctccatccacctgccagctcgaagatttctgtctgaatcgatcggatcaagatcaaatcaaggagggaggaggttgagcaattcctgacagggacagatcgggaaagctctcacagctttttctttgtttttgtttgatttgttcctgcttttcgattggaaaattgggaggggaggaaggtgatagccattgaggtggtggcatttgctgtcaccacctttagctatcgccttcctcttcctcgtctcgctcgccccccggtctagcttctttctgcaggtattcaatcgatcgagcaatcagttattttcgtttttgttcttgttttttcttttttatcatggaagctctctgttcatctgattttggtagtgaatctttaatttgtttgtatggcacgattcacccataaatcaatcgataattttgatacgattcagagagtgattgatttactgcactggtttcatccagggaagaggggaataaaattactctttttgcaaaaaaaaaatctgaaaatagggaaaataatccagcaaaatcgcatgtaattttgatgtttgttcatcgtttcaaactatacgtattaggagaaaccaatctctactgctcctggctgattttgtgatgaaaaatggccagtttcctctaaaacaatgaccaaatttgacaccctcttgttcttgaagggccggacggaaaaaacaaaacaaaagaaggcaccagccagccatggcgatggtgctggactccttcgtcacccggtgcacggcgtcgctggaggacttcgccgggcaggaggcgtgcggcgccctcggcatcggggacgacgtgcggtgcctcctggccacgctccggcgcgtccaggccgtcgtctcccacgaggagcgccgcggcagggtgctgagcgccaaggtggacgcctgggtggcgcaggtgaaggacgcgatgtacgagaccgacgacgtcctcgacgtctccatggtcgagggcggcaagatgctcgccgagggggacagcccgccgacgcccaaggcgcgctgctccctcatgttctcctgcttcaagcctgcatccgcccccaagttccaccacgagatcggcttcaccttcagggagatcgacgccaagctgagggagatcgaggaggaaatgcccaggctccccgcaggatctttgcactctgaatcaagaagggattggttcagtagaggcatctgcagtaacttctctgacgccattaggccactcgcggttgggacacaggttcagaaatctctggatggccttgtgcctaggatgattagagagggcaagaagaaggtggatgtcttggccatcgtcggcgcagtggggatcggcaagacaatgcttgctagggagatttacaacgacgagaggatgaccgaaacatttccaattcgtgtgtgggtgaagatgacaaaggatttgacagatgtggatttcttgaagaagatcatcatcggtgccggtggtggtgtcaatgttggtgagattgagagcaagaaggagctccttggaatcgtcagttctactctttcgaagaggtttctcattgtattggatgacttggacaacccaggtatatgggatgatctgctcaaagatccactgggagatggtgtggcccgaggcagaatactaatcacaacacggagcgaggaagtggcaacaggcatgaaggccatggtccaccgcgtcgacaaaatggatgcagagaatggctgggcattgttgtgcaggcagtctctcccagagtgcagttcagaagagctcgcgtcactgaaggatgttgggatcaagattgtggagagatgtgatggccatcctctagcaatcaagatggttgctggtgtcctaaggtctagaggcaagagcaaggctgagtgggagatggttatgagaagtgatgtttggtccatgcggccaatcattcctgagctgcctcaagctctctacttgagttatgttgatctgccttctgaattaaaggagtgcttcctccattgctctttgtatccagaagaattacccattcagaggtttggtcttatccgacgttggatagctgaaggccttgtaagtgacaaagacaataagttgctagaagattctgctgaagagtactatgcagaattggtaagcagaaacctgttacagctttatgctggtaatcttgatcagtgctggataacgcatgatcttcttcgctcactagcacgctttctgataacagatgagagtatcttaatcagcggccaacagagattgagcacagacccattgtcattgtcaaagccacgacacctgacattgtgcaacatggaaaacagatttgatgatccaatttcagtaaagcagcagatgagcctaaggtcattgatgctcttcaatagcccaaatgtcagatcaatagataatctcgtcgagtcagcatcatgcttgcgtgtcttggatctgagcaagacagcattaggtgctctcccaaaatccattggtaacctgcttcatttgaggtacctcaatcttgatgaaactcaggtcagagacataccctcttccattggctttcttataaacttggagactttgagccttcagaattgccagagattgcagagacttccttggaccgtcagggcattgctacagcttagatgcctttcgctcacaggaacttctcttagtcatgtaccaaagggtgttggtgatttgaagaatctgaactatcttgctggtttaatcattagtcacgacaacggtggacctgagggttgtgatttaaatgacctacagactttgtcagaattaaggcaccttcacatagagaacctggatagagctacttcaggcgcttctgcacttgcaaacaagccattcctcaaggatctacacctctgtgaacaggcaccattgatagaggagcagcaatctgaacaagaacaagagaatcaagatgaccaaaaggaaacagaggaagaagagaaggaagtacttgatgtaaccaatagccaatttagtagagaggaatcaatcaaagcgagcgaaaagatatggaacgaactcaccccaccccagaacattgagaaactagtaattaagaactaccgaggtggaaagtttccaaactggttgacaggtccaaagctgggcatatcattccctagtcttgtgtacttggatatcgacaactgcatgtcatgcacggcactgcctgctcttggcctcctaaaccaactccagtccttgcaaatctcgaatgcagactcagtcgtcaccattggtcctgaattcctcggtgctgcttcatcatcatcggccactgcttccttccccaagcttgagatattaaagctcagaaacatgaagaaattggaagagtggtcattagccgtggaagagaatcagatattgttaccatgtcttaaatcactgcacatacagttctgccccaaacttaaagctctaccagaaggactgaagaatgtttcgctgcgtgagcttcatgtcgagggtgcatatagcctaacagaaataaaggacctgccgagaatatctgatgatctccaactcaaagacaacagagcacttcagaggatctctagcttgcccgtattgcagtctctcaccattgacaactgcccaaagttgaagcatgtttcaggccttgacacactgcagcatctcaggctggcgttccctccatccacagagacattttattttgatgagctgatcatcttctggagtattgcattcccacggtggctggagctgttgatccgtaagcgcgatgggctgtgccatttcgagcttcagtgcagcctctcattgctcaggagctgcctggacggtggcaagaactggagcatcgttcagcagatccccgaggtgcggatcaccagcaccgatggcaagaggtacatccggtacaacaaacgccggtgcatctatgagacgaatgctcaatctgaagattgaagccttcgtgaaagtcccagtgcagtacgtttttttttttcatcttcattgtgcagttcatcttgtcaaggttctcttgttcagttgtgtggtgtcattacttacagaagtgtatattttcgttgatttattggcagtggtttgggttgttacaaggacacatctcagttttcctgggtagtccttccatgagttttgtttgcaatatttgccaacacgtgcattcacacaggctattatgtaagcctttgttctatcttttctaattacatttgttttgcaaatcaaatatccgataaaatttagttatcccttgggataagggacagattgaaaaactgatatgcaggtatatttttctcacataagattccaacattgatggaaactagatacgataatttgttcggagtttctaacaggtcaattcatatatctgtataagccgtaggtatattaaacatgtgctggtttaaaaagttgatgattacaaaacctactctcttcgttccaataaaaaccaacctaggattagatttgatataataattgtggaggttggtcttttttttttttttttttttgggatggagggagcatttcacagtaatctcacttgcacatgtttttttccaggttatagtaaaatgaaaattgtagacaagacaaaacaagtctaaaatgggtagggatgaaaacggtatgaaaacttcccagattccggacctattttcgaaaacaaaaactttcagtcggattttttcggaaatggatatgtttgaagtggttcctacctatgcggaacgaatgaaaatgtagaaccttgtacagttggaaactcggataaagcagagttggtagaggacgattcaggagctgaatttgtatggattcaagccgcattttcccgctaataagtgaacaaccatgatgatttcgccatgacgttcctgctatatgcgatgggataaatgtattgatgatattcatgaaggggcatcagcagtttccggctttcccgcggagtggggcgggagggaaaggagaggaagtgggatggggtagcggaggcgccaccatccaccaggcgtcggcaaagcggatgtgctccctgccggctccaaccaacagagagaaacgccgcgggtggtggagctggggtgaggaagctgctgagggtgctgatcgagcttccctagtagcaggctagcagcaagccaagcctctccatcattgggacttgggaggaagagctatcggtggagacgtagggaggagaggcaggcgccacgctgttatgtcatggcctcatggggaggttacgggaggaggaggaagcatagctgcctagaattgggctttttgatattgggccttccggtctgcacatgtgcaaccagttgtgattagggaatttttttatttttaatttttttaattaaaagttttacaaaaaaaattttatttcaaaaaatgacaaaactaatctccccagagggcgggaaatgtgacgtggcagacggccgttggctctcggacgatggccgtcaaccgagggcaggacattttgcaggcggcccccttgccgccctcggcaagggcggttttaaactgtgcaggggccacctacaagagggcggcgagagggcgtggattttttttgcaggcggcccccttgccgccctctgggagggcaattttgtactgttgagggaccaacagccaaaaaaatcatagttttgtaatggttttgatttattttgttatgtttttgtattgaatcgtttgttataaaaatttgctaaataatcatattgaaaacgaagaaaacatgagtaatgtttgtagatttgtttgatgtaaaatatcgtatttgaccgaagaaaattaggtaaataatgagtctgaaaacaggaaaattaggtagttttttttaaaaattttagatgaatactttgcagtcaaattggaggccgaggaggtggtgtgtgactttgaagtgttaggttaatgatcttatagaaacaaacatagtatgtaaaattttgtaagtattggatggtatatttttcagccggattggagctagggatggtgtgctctagatcaaactaaactacattttacaattaacactacgatctaagtctcaattcctactaatatcttctgtgccctagatctatacaaatgtgttgtgttctacagatgtactaaaatatatggaactaaaactaaaatgcaacataaattaaaaacacaatgtatttacagatgatgaagtgagcaaaccagcaggggcttcgccgctccccttcttctaccccacacccctccctttttcttttttttggaattttgagtgattataatgaaaattcagagagggggaaggggttttattgtgtgtgtgtggggggggggggctgcaaaattccaggccactcgctgcccttttgcaggcggtcccctcaattgtgtaaaatcgctctgtgtaagggcggcaagggggccgcctgcaaaatagccaagcccacgtcgccgccctttttgcaggcggccgcccgcatagtgtaagatcgcccttagagagggcggcaagggggccgcctgcaaaactgcacgccccctgttgacgaccatcgcccgagagccaacggtcgtctgccacatcacatttcccgccctccgggagggcgatttttaaaaatcgtcccccccgagggcggcgggagattagttttgtcaatttttgaaatagaaaattatttttgtaaacttttaataaaaaatttaaaataaaaaaattctgcgattaggtcggatggctatcatttcattggtgacaattagatggttgtggtttttgttggtgacaaggcttcaccacaacatagagaattgctattaactacactaagtggggatgcattgtataggtttattataggataacacaggtaatcttaaacgctacaagtaataacacaggtatacagtagtgtagtaccttggaaagatatagcaaatcgttaaatatcatatgaatacttaatttttcttcaaattgaggaaaaaatggtggcacattatgataaacaaaattgtattacatgctccttccgtttcatattatatgactttctagcataacatatatatgaatgttggcaatgctagaaagtcttataatatgaaaatgatgaagtatacttttttcttcaaaaaaataaaataaaaattctagattatgtcgaggttcgtggtagaagtttacacgtagggattggtgacgatacatgttggtaccataataatacatcgatgatacttagaggtatgcttgttagatatgggtgatgatacacataggtaccagtggtttcgttggtacgttttagctggtatcatataggtgttggcgatgatacagcataggtatatatcaatgatgatacatttaatataaatactagagacggtgcaacataagtacatgatacatgtatgtaccaaggattatataataaggttggtgatgatacatgtaagtaccagggacgaaacatgttggtgagatatacttgtactagtgacgatattttgtcagttatgaacttgtgatgccttaagatattattacaggtaaagaacccatctttacttatggttcgcaaccccttttaatccctggtacacaaccaggataaccaatccggaactaaagatgcccatctttagtctcggttgaaatagccgggactaaagagtttttttcttttcttttttcattgtttgcatattgatttcgtgccaaactcacggatcaaataagagtaaattacactagcggtccttaaacttgtaacgaggtttcacttaggtccacgaacttgcaagcaaaatgagtatcgtggaatttttttattttttctcccttcttccttcttttttttttctcccttctgccattggcccacctgtcagtgggcctctctgacctcacattagcctcttctctctatcctctctctctccggccggttacgcaggatgggcggccggctaccgaagcagcgacgggcggagcggtcggcgagaaaggagcagtgcgtaggcaccgaccggcgggaggagaggagcggtgcgcgtgcacgggcggcggctggagaggagaggagtagcgggcgtgcgtggacggcggttggcgagaaaggagcggcgcgcgtgcacgggtggcggctggagaggagaggagtggtgtgcttgcacgaactgcggccgacgagaaaggagcggcgcgcgggcgccagccgacgggaggatgcgcgtgcacgggcagcaattggagatgagaggagcggtgcgcgtgtgggggaggcgtcgccgaccatgcccgggaggagaggttgctgactgtggccatgcgtgcggggggaggcgtcggccatagagcgcgctagcttggcggtggagatgaattcgtcgccgaccacacgtggtagaagtttacatgtagggatttgtgatgatacatgttggtactgtaataataattacattagcggtccttaaacttgtaacgatgtttcacttaggtccatgaacttgcaagcaaaatgagtattgagatccctaaacttggtttaatgtatcatctcggtccaaagcctcgtttgaccgtgatcttgcctacgtggcgtgccacgtggacgatgacaaggaatttttttattttttctcccttctcctttttttctcccttctgccacaggcccacctatcagtgggcctctctgacctcacttttccctcttctctctatcctctctttctccgaccggttgagcgagacgggcggctggcgatgggcggggcggccggcgagaaaggagcggcgcgtgggtgccggccggcgggaggagaggagcggcgcgcgtacacgggcggcggctggagaggagaggagcgtcacgtgtgcgcgaacaacggccggcaagaaaggagcggcgcgcgggtgccggctgacgggaggacgcgcgtgcacgggtggcagccggagtggagaggaacggtgcacgtgcgggggaggcatcgccgaccacgctcgggagtagaggttgccgaccgtggccacgcgtgcgggggaggcgtcggccatagagcgcgcgagcttggcggcggagatgaagtcgtcgccgaccacacgtggtagaagtttacacgtagggattcgtgacgatacatgttggtaccgtaataatacattgatgatacttagaggtatgcttgttagatacgggtgatgatatacataggtaccagtggtttctttggtacgttttagctggtatcatataggtgttggcgatgatacaacgtaggtatatatcaatgatgatacatttaatataaatactagagacgatgcgacataagtacatgatacatgtatgtaccaaggattatataatgatgttggtgatgatacacgtaattaccagggacgaaacctgttggtgagatatacttgtactagtgacgatattttgtcagttataaacttgtgatgccttaagatattattaccggtagagaacccatctttactcacggttcgcaaccccttttaatcccgggtacataaacgggacaaccaatccaggactaaagatgcctatcttttttgtcccgattgagcgggatgggcggccgtcgaccgaagcggcgaaggacggggcagccagtgagaaaggagcagcgcgcgggcggtggttggagaggagaggagcagcgcgcatgcgcggatggcggccggcgagaaaggagcggcgcacgtgcatgggcggcggctgaaaatactccacatatataataccttattcatattaccttgctatttttaacgtagagaaaagtttcagtaactgaatttaggtgatggcattaaaaggtggtcttttctcctgaagatgaagacgaagatgaagatgaatattaggtttttttacgcaaaacgaggtggtattaatgtacgattgattgagttttaattattacaaacttgaaaaatagattaatattatattttagagcaactttcgtgtagaaatttttcgcacgaaacgcaccgtttagcagtttgaaaagcgtgccacgaaaatcctaatctttatccaactcatgttggagaaaagaacaggaccaaaatgtgttgcacaattcagggtgatgagacaatacacttcttttttgtgttgttcctgtactgtatttatgctcccttcactaagaaatgtaagacatggtttgtcatggcattctccataattgaacttgtccagatatagtgtagttctttatgcatcaggtggtattgcaaaaggagaaaaacataattaattcttcaggatctatgatgctaaattggttagtccatgttttgcactgttattatcactgatctggaattattctcgcagaactcttaagggtcatccgaagattgaatttgaaagagcagtggactgatgtgctacttcactttattactttgtatgctctgagatcaacaatctctcatgatagatagcatattgtgtaatgctggagacgtggatagagattagtacgttcattacaagtgaactcgtggcataattctcttgatttttgtggtgtttgatacatgtctttaatggactgtatttgattatttcaattcagtccctatcatttgatttaaaaatatagcattcatctgtaatctctggagataattttcattttgtaatatatataatagtttgttatatgcacatagatcatgattttttatgatgttcagaagactggtacatgtgaatagaaaaaaagggaaatgtcatgttgtttggggtgaattggtgatagtttatggcaatgccaatgtatttgtacgggaggtatgttatagggagatctgcagctcatccatgacaaatactatatctaggtatgcttgatgttctagatattaaatttccatagcattcttctatctactactatgttctaaatattaaacaccatgagattgttttatatgccagaaagcttacactcggattgtgtagtggtaatagattttttgtattgaaattaatttgaattaaactacagaacaattttgatttgtagtctcttcgatttgccagatttttaaccgtgttcaacaaattttcactcaatgattatttaacatcttttcacctcatataatttgaaattgatatatattatttcacgttgcaacgcacggacacccagctagtatatatgtaatttgtaaatatcatttacatgttttagcaatgtaataatcatgttgtttacttgaatttattggagcattcagttttgtttgcaaccataaatttatttccttagcaacgcacatgcacttaatttgctagcataataaattcaaaattgctagacgagcgaaaaagttagtgacacacaagagattctcttgtgtattcgtaggagagattatattcgtaagagtaacaggaaaactcaaacgaaattggctgcaaatgaaattttgaggcttaacttgtcataagtcacggctatttgctagctgacgagtactcataatgttgaacagaaactaaacaaacaaacatcaattaagttcgcccgccctatatatctgtagaacagtagaagtagcagatatgaatcaggccattgtaaagcggggttcagagcctctcgccacggatcctcctggcgagctgaacgtctttggacatgatggtgacgcgcttggagtggatggcgcagaggttggtgtcctcgaacagacccaccaggtacgcctccgccgcctcctgcagcgccagcaccgcgtggctctggaacctcatgtcgtgctgcaccgcaccaaaacatcgcaaaaatcaattaacgtacgtacaagcatccttagaatagaatgaatcgatcggcataatttaaacgtttggttaccttgaagtgctgtgcgatctccctgacgagcctctggaacggcagcttccttatcagcagctccgtgtttttctgatactttcggatctccctgcaatcgtatatatatgatataattcaaataaatataatataatataactgcagcagaattacttatggagagagttaagcatgcatgcatatatgctatggaaagatcgctcaaacaattaattaatttgcttcatcgttcagttctttagaagataaaaaacagctatagcgtggcgctgggacatgtacatctttgacatagatgctggattgaattctgtcatcattgaagaaaagaatcatgtatctacctaagggctacggttccaggacggtgtcgacgaggcttcttaactccgatgaacggaacggactttcgagcgactcctctgctggacggagcaggcataacagcggctatctgcatgtcgatcgattaattgtaaagatgcatcgttcacaagtgaaacaaaattaattagtattgtagtaatcatttttggcaaagcatttgtacatacagcacggagtggctttctaggggcctttcctcccgtggatttccgagctgtctgcttagtacgagccatcctgcaatccatatagacaagaatatgcacattatccacattggctataacgctaagacaacaattttgaagaccctataatatgaacaagaacggcgggagctctgcggtttacaaacctcacgcagatccaaaaacttaattacaacgttcacgaaataataataatgttaattaagattagacttaagaccttaattagcgccaagaacaaaaaaaaaattctaatccagaaaaaaaaaagaacaccttaattagcgtcgtagatgaataatggtggcgcttgattggcccaacagatttgaagagggtagaagaggtggaggggcgatgattcaacggctaacaattctggaaacaaaccggtgacaacagtgtttcgggtctttggagtagaggagaagagtccggatcaggaagggaggttacaagttgcgaagaattgggaagaaaatagaaaaggagaaggggaagaagaagggtcaaaaaggacaatgcggatatttgccaataaattcttggaataaatttggaactctgaaacatggttcgaaaagtgtagagagcaagcctaaaaagtctttagatatgcatgaaagtaagacatttttcgtcaaaattgagaaaaaaaaaacaaatggccgagcaattatggctttataattaattagtcgcaataaatctaatcttgtttaaatatctcgattaagttaaactaagaaaataaacaccaattcaaattttaaaagacccgtacaaactaaaaaaaaagaggaaaaccgggatgttacagacagagagatgcttattattagtacaatttacaggaaactaactagtgtggagatcgattgaagaacacgttaattagtaggacaaggaatttcattagattaaaaaaatgataacttattttatacctctcacagttcgacgagtgcagcaactgctattgctgtgtgtgcctccgaaaatccccctcaggtatgttttggtgtgcagatctgaccggagaagagggctaatttataggcgatcgggcgggctaatttaccgttccataaaccgacttattaattagtttttatttaaccagagctcgattgattaccgttgcatttaattaatcgacggctgatatggtttgtttacgtggtggcacggatcggtgtcgatgcacgccgcactgctattggctggcgctactaacacaaggatttcctggttcctgcgaatttatgatggtaatcctcctttggataaaaattgtttcctttcactgtagatcatcaagacaaatcatgccatatatatctatatctatatctatatctatatctataatataaaaaggaggagttgtccacctccaatcctacatacaaaatcattcggattgatccctaccgtccatctgcgcgagtgatttcaccaccacacgatccatccatccacgccgaatacgccgaatacttcgctcctcctcctccacccgcgaagacatcaccccacgcgcgaatacttcgcttctccagttctcctcctcctcgctcgcttgctcctcctccccgcatgttctaccgccgcgccgctgcatcctctctggagatcttccccgcgtggactgccgccgccagagcctctgattcttccccgtcgccggagccagtgcttcttccccgcgtggattgtcgccgcatccccgccgccggcgccgctgattcttccccatcgccggagccggtgtttcttccccgcgtagactgtcgccgcatccccgctgccggagccgctgcttcttccctgccgccggagccgccgtggccggttccgacctcaactccatccgccggcgccggcgcctagatccactgccgcggccgaagccgactttccaccgcttccttgagacgttcaacgagagagacgactgccggtgcgacacttcaacattatgctctaccacaacgctacagagtacagaccaggttcggcacaatactaggtttcctcgcttttaacttcacaattgcttctgttccttctggtgtttgttcccacaaaatgcatgtggcatggaagatgcttgatggaatactcaattgattattcgatacagtatcatttgttgcagtttttagatcttccaattaactagcgcaacaacaacagattctggttcctctttctttattttctgcttgccatttatatttatatttatgttcgttaaaagaaattcagcactgaagtataaatgttcacccatttctctgtgatatcaggcttgttaacaacaatgtttttgtgcaggaattcctatttattaaaaagctatggtatgttagctacattttaaacgaacaggatatgattatctgagctttgtccagctccagtctctaaagatgggatgttcagtttgtaatcatagaacacacgcgcaacaatcttgcagtggggaataccatgatgcacaggttagaatgagagagggatggcattggaattgtcaaagatttctcatacacctaagccaaagccctttcctcttttggtctttccttctttctatgtaacaagggaatgatctggtcacagaatactgcagcggtttgatcaacgaaaagcaggtgataaatgttggtgtttgacttatgcccaggttactgtcacgcccataaattcacgaaccagaatttttaagctgaatgtgcattaaatccctgtctaggaccagccaggatatacaaatgacaattgttgacatatagatccacgtcttacaaaaatagaaaagattacaaatgcagccgaaaagataaaagcgagctaaaccgggaagcttgacttcagcagcggggcgactccactccacacaggcaatccttgacggcggcgatgaaaccaactttgacaagacagctcccactaggaagattttcagttctggtgtggggaaaaagagagcaagactgagtactacccactgtactcagcaagtcataccggaagaggaggtatgatgcaggatataaccaaaggaggctaggggttcatttgcataaagcaggcatttaaaagcagaagttgaaaacagtaaaacaattgtagtaattaatcaacattaaccaatcactgtccaatgctacaccacgttgcaacaagcccaaccaaccacctgaactacaccagttcattaagctaaactaggggtgagactaatcacggtgaatctggttgatcgcccataaccacgggcacgactattcgaatagttttactctggccagaggtgtacaactgtactcacaagacacaattccacacatgttgccatgccccgaagtatcaccatgatactgcaaagggggaaatcgtgacaagaccctccgcataaccctcccctaaccatccacaccacgctaaggtttcacccgcacccccaacgggcagtgggcggtcccctcttgcgccgcggtgaatccggcagctggacaactggacaccccggctgacccaactccatcatgcccaccctcaccaccggtgcctaggaaagggtcgagctatacttcagatcaagcagttacccactcccgcttgtggtaagcacgataagtcttctagggtttcccgtgaaccggtccttaattgccatgggtgcgaccagaaaaaccatgcacccacagcccacccttcagtgtattttaattaactaacaccaatgcggtggcaccaatccaaagctatgctcatagtcaaagtctatgtaataatgtgatccccatttgtgtactagttgaactacacatagctaagcatttcctaaaccaacatctagtcatttggacactcaagttatcaatggcataaggtaaacaatatatggctgagtaatgggacccatcccacatgacattgtaaaagaatgcaacatttaatagaaatgcgggatatttgtaaattgggtacaatatgatgaattgtaacgcatgacttgccttcctttcgcactgatgagcccacatcaacgtcttcgtggaaccgcggatcgacaaaacggccgaaatctacgcgacaaacaaaacacacaagcaaaacacactataagactactgaaaaaggaaacaaaaccatttttaatggattctagggatttttatgaatttactgagacttgaatggacttaaacggagctcggatgaattaggtatgaattttagaagataaactgtgtttttactactaaagaaaagcccttaattaattattgcgcaataaatccccagggctgacgtcatcaagggagggggcggcgccggtaagcgggccccacatctcagcggctcgaggtggccggtccaccgtggaccgggaccacatgagtggtccaccgccggtccacgggaccgacggtacagatcggcctgaggccaatcggacggcgtaggtgaggctaggcatggctcggctcggcacaaagacggccggccagccatggggagcggcggcggcgagcgcgcgccggcaacggaaagcggcagtgcgggaggcagcggcggacgtctcactggccggcggcagcggccgaaggcgatggcgagcgcagagagtggcggcgcgtgcgggacagagggaaggagggaggagaggagctcctcaccgatgagcacggtggccggcgcgaaggatggaggtggcggcgatgaccgcgatgcggagggacggacgggcggcggcgacaccctaggagaagatggagaggcgtcaggagaggagataacgaccacggcggctttaaacaccggccgaagatggggtggacggcgtgactcaccggcgtgcgaggagagaggcgctccagtgggattccggcaacgtgaggcggcggccgggaaagctcttgcggcggcggcttggcacggcggcggccctagaagcgacagcacgcggccggagatgggcggcggcgacggagctcggcgagcgcggcgcgacggcggtagagggcgtgggagtggacggttaatgggggaaatgagagagagagctcgagggaggatttttatgggcgctttgggggcagaaacggccgaggatggcccctatttggccggcgacgtggggagtggagagagagagagaggtggattcgaatgcgaatcccgcccatttttgggcgtgcgcgagagcgggaagaggtggaggaggtgggcggcgatgtgggcgcgagcgcggggcgcggagtgggggcggggaggcggaaaacacggcggcgcgggcggttactgccggggcacggtcggctggaggaaggggacgaccccgacaggtggggcccacctgtcggcgttccggagggaaggggaaggggaaacaggccggcccaacaaggggaggtggcgcgggagagagatgggccgacggcccatcaagagaaaaaggaaggaaaagaaaagataaagaggaaaatgattttcctgggattaaaaatattgcacttgctcatttttaattggttaaaattatttatagggctctgaaaattccactaaaaatcttgttaatgcattagggcatggggaactcaagaaaaattccaccacgctatttccaattattagttgcatttattaattagggattcaactctaggttaattagaacaatttctccagacgatttatttaacaaatttttaaaacaagaaaaaggggaaacttcaaggcgtgacaaagattacccaccttgattttgtgcctaccttgaaacatgaagcctcaatatgattgttcaccattccagcttaccaactatattgaaatatcaatctattatgtaagctgcctttacaaattaattattactctttgttgataatgttcagagccactgagcttgttcttgctttcaaatatggtgctgctctcatgaatattgataaagtttgccatctcttcatggtagttttgtatgtttgtgcaggtcttccaaattacacatagttcattatgcttgggacagaataatacaatagttgatataaatgtgcagaaaaaactgaaagaaatttcagattgcttaatattttgatgtgagtttatcacgggtgcatattggagtgactgaacaatgattctcattggtaatcattttctcctaccttctacttccttcagtttctcatattccttttttacgaattatatacctccgtatttaaacagctttttatatatttgttttctataaatattaaatgataattactcatttttcattttttttcgtggtggtacactatgagaattttccgaaatactatgtcctgccacatggttgctgaatacattcaagggcattgcactgtccattccattcagtactgggcatatgcattacattaggcacacacaggagaaacatgccatagattaagtcatagagttctgccttcaaatttggaaagaaaaagatattcagagtggcttcagccttcaggtaatgttacgcaagcggacaataatgttgttattaatttgatatatttttaagtgctatagaaatcgatgaaactaattcaggttttgtagacagcttggtgatcaaggcctaccaatatttaatgagttatgtcccttgattgatacactaaagcttattctcataggcaattttgatctagcaaaatatgtgtgcaatgggtgcaagtaatagaagctgcaaggcatattatgaacaatcaaattgtttctgaactgaagtagcaggtttaattttggtcaggtatttaatacagaccaaatttatagtggtaagaagtaacgagaaatgcccgtgcgttgcaccgggtattggtggggtggctgaagtttgatattaacgacttatcaaaagcacacgagatgattataagtacaatgataaaaaggtcatgtttgtttttgataattaatttactctatatttggacgacttagatgacgcttctgacgtgtgtgggcttgatggtcatggcaagggaggaatgagtggcgaacaattaatgtgtctccttttgcatatagggcgacatatggaaatttatgtgatgaaaaatgaatggaattgacctaaaggcacctccccagatttatatttccccatatttatatttgtagtttaattaaactttcttcagcatttatttaatagagttgtaaccgaaccaagggatttcttgagattcttaagttatcaatggtgagattctgtcaggtgacttctaaccttgaatttgtttcagaagtcaccagattgtttaacacgctagatgctatctcactgcaagatcctgcctttttttttatctgaagttatactgagctgctacctcctcaggcttcattctgtccccgtccgcaccttcctcgatgatgataaccctaccgcaaggtaactattcatgtcatcttctttgggtattcacgcacatgtggcaacacaacagattggtacatgtgcttttctacagccagatcattgcacaatgtctagaattttctacttatttgcagggtgacatgagaattagtttatcaccccggtcgaaggtatgccccaaaaactagattgaatatacttatgtctctataaagggatattgtgtggattctatgcagctttcagattcgtatgctaaattctatatagatgtatatgctgaattttatgccccaaaaactagattgaatatacagaactatatgcagcttttactctttgaaggtgtatatgcatgctaccatgtttcctgctaagctgtatatagtgcaatttactacgtcctctcttttttttatatatataccttcacagaagacagtaatggatgcaggtagctaactgcgtggaaattggtcttccgtcactcattcgcaaaaataaaagagaagcgtctccattgcttctgaattctggtgccttgcatttgatttaacctcaggataaaaagagtcttgggatatatggcttctttactttacggattgctcttcctgcccaataaatgtattttgcagccttcaagcagataaggatcatggaggctctccaaatgatatatgcttctgttcataatctgcttgtgggttactgtttctgttgacacggataattagtccatctctgtagtcacagatgacaacttttttcccttcaatgcagccacatttttgtgatgctttacaatcttgacagtcagtgcaaaaggaccaatgcagaaatccataaaactgaacaaacaaatggtctatgttaactgagattataagcaagttatttttatactgaaatatatttgtcgccctaggaatatttgagggctaatatatttgtcaagcttaaatattgaattccaatccatgtgcacttggcttcaaggtaaacataattttatttctaagatgtcattttagtttacagtagatgtacacactttaactaggtatgctgtttttaactgtgaactcaataggtgtaactcctactatttaaatgcagatttcaaaaccaagtataccaaaattggcgttgttaagtagttgtacagcaatactgactattatttggtttttatacaatacaactctgctaataagtatagaatcacatcagacatgtaggcatatatgtgcacatgcataaccaggtgaccaaggaagctatactatagaataatgtgaactccttccttttctttttctaattagacactttattgcatagtgttgtggtttgaatgtaaaatagacagatctgttgctcgaggtttccaaacatttatcaagctatgaaaaaaattacatatttggtatcattagatggagttgtttgaatgtaaaatagatagatctgttgctcgaggtttccaaacatttatcaagctatgaaaaaaattgtatatttggtatcattagatgtccttcatttttatagttagtgtaaagggagagttatgtggcatattaatattaaattttgtatttatatgtcctgtgtgttacacgtcgtcggaaaaccatataaatttgattgtgtttatatgtttactatgatatatagtgcgggaacgtgccttgcacgtgcactcttactagtatggaattaaattaagagatattacttatactcaaattaaatattatatctctatctatactattctaaaaattaaagattccgctaaaattttggtactccctccatttcatattactccctccatttctaaatatttgacgccgttgactttttttaaatatgtttgaccattcgtcttattaaaaaaattaagtaattattaattcttttcctaccatttgattcattgttaaatatacttatatgtatacatatagttttacatatttcacaaaagtttttgaataagatgaacggtcaaacatgtgctaaaaagtcaaaggtgtcaaatatttagaaacggagggagtataaaactttatagcatacattcattaacatctatatgaatatgaacaatgctagaaagtcttataatatgaaacggagggagtatgtcataagtgtttgagttagttctatgtcaccgtatccaattcgaagtgactccacccagcttaatccaaccggctcacaccaccttgatgctccatcccgcactgcgcgcctctccccgatcgacgtcttctctctctctctctccttttttttttttgctatttctccttttcttttctcccaatcatcatgtcctcttcctcccctttcaatctcctctattttctcctccttttctctttttccctcatttttcttccaaatttctctcctcataaatatttttttaaaaattatcattaaggtgtgtatggggcaagagtgttactttgcaaatgttttccatctacagttaaattcttttactaattgaatagtcaaaatttcaatctttgatcgatgacatatagcagaaaacataaacgtcaacttatggaatagccacccgatcgatttctgagactatggaaaggtgtacataaaagattcttcatgtgatgatgcatgaagcgagtgcaaccgggtttaatactatatatgatttatgactttgttttgtcattgttttgtttttttgtttgtcatttaaattggtaaagtttttatcaatcgtggaaattgtcttcacccgttgcaacgtacaaacatctttggtagtatgcatggcccctagtccaatttgcatctttgctaccgaatatgtttggtttctgcttccaacgttcccccttccccttctattaggtctaggtcggaagtcccttaaaaaatgtgatggccttttccacgtccaggttgaattacaatttacaccagatcgagcaatcttttgtaccctcctaactccatctccctcttccttcttgcttcatcctcccgccatcgccgcgagacatacgatcccatgaagcttgctcactcactgaaaggagaattaatcgtcctagctaagtgtaatatcccacatcgtacgagattgagtcgctaacgacgaagaagaaagcaaatacttgaagaatgggaaagggattctgatgtgaccatcaaatatatgaatacaaccaagtatgaatggacttgttctggttggtagccacgtcgcaaacgtcgcactcgatcaaagcgagagttatccccttattagaagatcgggccacgagagagagcgtcatcaaattcagagaaaagagggaggaggttgtcaacttacttcattttttctcgccaaatcctataaatctataagtgatcctcacttaatgtagttattacccaatttcctatcctgtagttcatccacgtcataaaaaaaacgtcaatcattgtatgaaatctcaaaggtttggatgcacccaaatcccaatggtatggatcagaacagtccaaacgagagagcccatgagcccatttgtacgtagcctcccgccccgcgactattaccaaaaacgattttcttgtacaaggagctctttagattgcagatagacagcacaaaatcgattttcctatacaaggagctctttagaaaattgattttcgcaggcaggcctcttaatggtccgcacgtaaaaataagcctatttttgcaggtggacctcttaaggggccgcatacgaaaatcaatcttcgcgtgcagacctcttaaaggcccgcctacaagtctattccccctcctatcttccctctcatcaatttcaaaatttttaagtcccattctttatctcctcacctctcattccacagccttatctcctctcccttgtcaagtgcgttgtgtgatagggtagctggccctcggctacggagctcgtagccgcgcgccgtgatgttgggcgaggttttccccctcagcaccgatagacagaggcaaagaggaagaatagaaagtttgtgatcaactccttttcttccaaattctgaatacaaacttaagtaggctctcgggccttaattcatggcgctaatcaaatcattgtaactaattattcctattactaaggatctgattgatccttctgttttcaaatccacgcgctaatcctgctcagccgcgcgtgatcgcgtatacggcgtcgacggcgcgccttcagtgcccctgatcttgcggcccttccttgtataggtgcggccccacatgacatctctccctccctcgacgagcagctcgtcctcgagctagaatgctggatagcgatccatgaaggtatccacatcttcccatgttgccgatgttgccggttctcccttccactcgatgaggacttgtcgcactcctcgagcaagccgcatgcgggtagcacgttcaggttctgggatggcagcaccgttgtggatggccagcagtggtggtcgtgcgtccggcggcattcccacaaacttcttgagaaggctgacgtggaacacatcgtgaagacgagtgcgcggtggtagtgccagccgcacggcaaggttgttgatgagctcattgacttggtaggggccaaaaaatcttggctttagcttgccttttgtgacttgaggaagcgaggccggttcgcggtggcgtagacgcagccatacccagtcactgacctggtaggagacgtcgcggtggtgccggtcgtagaaggccttttgaactgcttgtgcttgctccagccggtagcgtatgtcagctaggatcttgtccctgtcttccatgttgcgagctactgccgccatccgtgtttcacctggttcatatgaacggatggttggtgggtcgcggccgtacaccacgcaaaacggggtatcccgtagtgacgtttggtacgccgtgttgtaggtgtactcggcccatggcagccagtggatccattgtcgcggctggtcgccggtgaagcacctgaggtacatgacgatgactcggttggccgcctctgtctggccgtcggattgcgggtggaatgctgtcatcatgtgtagcttggtgcccatgagtcgcatcagttctcgccagaacaaggaagtgaacactgggtcacgatcggagaccatggactgcggtacgccatgcagacgcacaatgtcggtgaagaaggcttgggcaaccgactcagcagtgtatggatgcgccagggggatgaagtggcagtacttgctgaagcggtcgacgaccgtgaggatgacggatttccatcctacgcgcggcagtgcctccacaaaatcgaggccgatgttggcccagacagccatcggtaccggtaggggcatgagcagtccagccgggtgaagatgttctgacttgtacctctggcacgtggcgcatgccttgatgtagtcctgtaccattcggcggacgttggggatgtggaagtcgcgccggatgcggtggatggtgcgctgcaccccctcatggccgtcgtcgtggatggcagtcagcaactctaggagcagtggggaggacggtggtatgtatagacgtgcgtcgaacgccaccatgccgtctatcagtgaccaaggcgccgcgcgtgtgccggcttggatctcatcccccaaggccctgatggcaggatcggtatcctgtgcttgccagagtcgctcgacatagtcgaaccgtggcgcagagatggcgaggatcatgccgtcgtcggtgtcgcgacgtgagagggcatcggccaccgtgttcaaggcacccggcttgtattccacagtgaagtcgaacccaaggagcttgccgacccagtggtgttgtgggatttttgcgagacgctggtcgaggagaaactttaaactgtagtggtccgtgcgtaccaagaaacggcgtccccacagatatggccgccaatgcctaatggcatggacgaggccgatcagttcacgttcgtatgccgcgagagatcggtgtcgaggtgcgaccggcctgctgaaataggcaaccgggtgcttgtcttggatgagtacggtgccgaacccatgggacgatgtgtcgcattcgacgacgaatggcttggtgaagtcgggcaaaaccaggaccgacgccgatgtgatagccgtcttgagcgcctggaatgccgtggtcgcgtcgtcgttccacaggaacccctctttcttgagcagtgctattagtggtgcagctatggtgccgtagtcgcggacgaacttgcggtagtagcccgtcaagccgaggaagccgcgcacagcttgaacagaccgtggttggggccagtcacggacggcctgtaccttggcgggatccatggcgacgcaggactcggtgatgatatggcctaggtaggagatggaggagaccccaaacgcgcacttggaacgcttgacgaatagccaatgttgttggagagtgtcgaggacggcccggagatgtcggagatggtctgcccacgtgacactatatatgagaatgtcgtcgaagaagacaaggacgaaccgatgaagaaacggccgcaggacgtcgttcatcaatgcttggaatgtggccggcgccttgcaaagtccaaacggcatcaccaggaactcgtacagtccgtcgtgtgtgcggaacgccgtcttggcgacatctgctggattcatctggacctggtggtaccctgaacggagatcgagtttggtgaagaacttggcgccatgaagtttgtccagtagttcgtcgacgaccgggataggaaaagcgtccttaacggtgatggcattgagggcggtagtcgacgcagaaacgccacgtcgcgtcggctgtcttgacgagtaggaccggtgaagaaaacgccaaagagctccgacgaatgatcccttgctccatcatgaccttgcactatcgttcgagctcatccttgtgtgtggccgggtacctgtaaggccgaacagccaccggctgggcacccggggagaggacgatgctgtggtcgcggctccgtggtggaggaaggccttgaggctcggagaaaacatcagcgaacgcgaagagcagtgcgtcgagcaggttgtcgccggctgtggtggtgtggagtgatgtcgtctcctgtcctgccacgccctgccagcgaacttgacggtcgctgcgccaaaatgacatagtccgggaggcgaaatcccagagaatcggccccagagacgcgagccagttggtgccgaggacgacgtcatagccggccagcggtaagacgaataggtcggccgtgaaggtgtccccattgatgacgacgctgcttgccagagtacgctgaggcagggaactcgctccccattcgcgacggtcaccttcatgcgagcgcgtcggtgtagcgtcatggccgtgcgtgcggctgcgtcctcggagatgaaattgttggtggagcccgagtcgagtagcgccaatagggtcgtgtcgctgatcttgatgtgcagctgcatggtggcgctgaggcggatcccgacgatggcgtggagggagatgtgcggctcgctgtcgtcgtcgtcttgagactcgtcgtcggtgtcgtctgcagtttccagcaaaaataggcgctagcataccttgttgtggccgcggccaaaattttcgttgcagttgtagtagagaccgagtcgacgacgctcctccatcttggtctgtgacaggcacttgacaggacggccttccacgatggccgtcggcggctgagcgtttggcgcaggcaaggcgagacgtggtgccggcggtgggagccgatctcgttgttgtcggactggtggtgcggcgcattgcgctcgcagctccagtttgcgggccaaactcatggcgtgggcgagcgagttgggattgtgaatctcgacgtcgaggctgagcggaggttgtagtgcagcggtgaagagctgcaccttctgtgcttccgtgaggtggccggcgcgtggcagcagcgcctcgaaacggtcctggtactccaccacggaccctgtacgcttgcaggctgcaagttcgcccagggggttggaatggagcggcggttcatagcgcaaatgaagtagctcggtgaagcgacgccaagacggtgtgccttcctctcgctggacttgtatgaaccacatttgcgcaccatcctcgagattgtacgaagccatccataccttctcctcctccatgacgtgttgctggtagaagtaggactcgcatcggttgatgaaggcgagtggatcagtcttgccgtcgtaccacggaaagtcgagcttctgaaaccttggcggtcgatcttgggtgtgttcgcccgagcttgtcctgccgcttgtagacccagtgcactgattgttgaggagttgaatggcctgtgagtttgcctcgacggaggcttgcagcgacttgatggtggcggtgagggcttccagtgatgcttggatagctgcgtctcccatggtggtcgatcgctacggcgtcgttggagcggaactggagcgtggtggctgtggaggtggtgtagcgcggcgcggcaaggatggcctggatcgtgataccaagttgtgatagggtagctggccctcggctacagagttcgtagccacgcgccgtgatgttgggcgaggttttccccctcagcaccgatagacagaggcaaagaggaagaatagaaagtttgtgatcaactccatttcttccaaattctgaatacaaaacttaagtaggctctcgggccttaattcttggcgctaatcaaatcattgtaactaattattcctattactaaggatctgattgatccttctgttttcaaatccatgcgctaatcctgcttagccgcgcgtgatcgcgtatacggcgtcgacggcgcgccttcagcgcccctgatcttgtggcccttccttgtataggtgcggccccacatgacatccctcaccactaacttacctctaccttctcccactttccaacggcgaccgacggcgacggctcaggagatggagaggcgcggtggcgggcgtcggacccaacgacgggtgcggctgtgaaggcggtggagaggtgctcgtgcggccgccggatccgaagatggggatccgcaagaggctcggcctctagtggctggatccgtcgccggcaaccgtttgtagagtggatccatcaccggccaccacagggagggcggatccatcgcaggcaactgcaaggacgacgacggccggcctcgggcagggtgaagatgatgacgacggctaggttggcagcagtggtctcccgtcaacggtagcaccgaaaacagtgttagatccgccgtcgcggggcctcgggcggctggatccgtagccggcgaccacagggagggtggagctgtcgtcggcgaccgcggggactaccacggcgggcctcgggcagggcgacgatgacaacagttctgccggcgacaacgggaggtgcggatccgcggcgacgacgatgccgaggaggaggtggccgggagcggggtcctcggccccacaacggccgaatctgcgccgtccccgccgatgatgaggaagaggcgaacgggagcagcgccaccagcctagcgcgcacgtgcgctgaccagattcgcgcctccgccatcggattcccagggttttgatttttttttatttttatattttttttggatttttagttttccttccgggcgacataagcacccgcacgcgaaaatccaattttcgcgtgcgggtacaccacccgcacagaaaaatcagatttcgtagaccttttggcacagacgggccaggcttccacacatgaaagtaggttttggctcgcacagaaaaattgtttttgtactagtgtgccccccagctcagtaacgcatgtttctccatctcccgttctgcgagaaacagaaaccaccgccgcaaagttagaagacttcatggctgtcatcaagacagtggcatcatttcctcaacttcaagaaaccatattttctccacatcatgcccctcacatttcttctactaaggttctgaataaattatatttttagttttttactgctttgaccaagttaattgaggttctaaatgtagagataaaattatgaaaaaaaataccagtgagttgcagaggttgagtagcatttgtatgaatttttacatgattttatcttgcaccacttacttttaagattttatataggcttgacattacatatatgttttattgttaagatgcaactaaatgctaaataaaattataactagcttatgtatgaccttagatgttgttgttatgcttgatttctatctttcatgttttcataagttgcatgtatgcatattttgtgtcataataaacaaaggttaaggtgaaatatgaattatgtatgagtaaatgtaattatataattttgtattcatgagatgtattcaggtgaattgccaatttagatgatggattctaacatatgtcatgttgtaattttaagtcataataattttaggaaatgattttccatattagatgtagggtcatttactttaattactatgtgatactccgcactttgctgcagtattcatggatgagtatacgttaaatattgtcgaaatgatgaaagttgaaatgttgagaaaataatgtgtggaagatgattagatgcatacttgttgatctctataatataatattgtaaatgatgtgtaattgttagtgagtgaagatgtagcatgcttgcatggattttaaatgggtttgaatagtaattgctagtgggtgatcatgtggtatgcttgcatgttgaggtttagcttctaataattgttagtgtgtaccaactatattgaaacaatagatttgcttctagttttaagtaatgcacacgagacctattatgaagtgcatttaaaatccaaaaacacacaaagaactcaaatcacaccaaaacaatcatgcaaaaaatgcaagcacactctatgttttattttattctagaactgcaatggaaaggttttaagggcatgttcactttgatgccattttcaaccttaccaaattttggtaaagttaacaaaaaaaaagtggctacatttagtttgcagccaaattttggtaactatataagaaatcctaacaaaattttggcgagttgccaaaattgccaaaatttggtaagatttttttggcatcaaagtgaacaggccgcgcttaaggtttccggtttaggtggtaaacttttaggaaattacctaagaaacacacttttggttatgttacatccgatggcccacatgtcattctaaatcgtctgaatttgagccaatccactgccaaccgtcataggggccaacctataatctactaggaaaagttagtggccgaaggtggtggaggtggttcggccgaaccagccttggcggccccggctgcttccttgcacatggcagctgcccattagttggtgatggcggttgtggatgaaccgacctccacaaccgacattccaacaataattggaagctataataggataagctcactcactttccaaatgcacaacaaagtggagtacaactcatttttatattctaggcatcactttagtatgtggaattaggtagagagtgagggggagctccggaaggagtgtcccaaatgttgggtttgtcgacattcttccactggagtttcggagaagcactgaagttatcggctttcttctctcgcttgtacctcgacggatgctctttgaatgaagtaagtattcgagacgtctatatggtatttaatttatttgcttaagtgacatatattcctatctttgcgggttcctcgcttagtattattattgagtgctttagtactaggactcttaataaagaaggaagttcctgcacaatatagtagagtagtaatcaataacttagacatgctatctaggttagcggttatcttcatttgttgcgtactccacggaaagtgaagtagacagcaggaggtgatagtcatatccttcaatgttcaagtacattatagagccgtagtccggactctgcttggtagaccgggggagtcggtgcctgaagccatcgatagtttagtaaattaacccataggaatcatctatggcctaaacctaccattagttgttgtacttagataaagtactattcttacgctatacacatgttccctgtgaattaatactcttatctcttggaatactctaaggtaaggtgctacaatggaatccccatgattcagtacatttggaatactctgaggtgaaatgctacaatggaatccgtgcgcttgctgatttatttgtgagcgtatcaagtaccaacagtggtgtgttatttttgtattctgtgtagcatgatcctattctggtctagcagagggagagggaattaagttggggtcccaacaaaattgccttcaaattaaagtttgtggaatataccatcaagtagaacttgcacaccagtagcttaattaacttggcatacgagtagtatttataatattgaacggaaactaaacaaattaatggccgacaattaggttcgcggcgtaacaactagcgtaactgatataagctagtatcatatatgttgtcgaatagcagcagtatgtgaatcagaggcccatgcagtgtgaggttgggtggaattagagcctctcgccacgaatcctcctggcaagctgaacgtccttggacatgatggtgacgcgcttggagtggatggcgcagaggttggtgtcctcgaacagacccaccaggtacgcctccgccgcctcctgcagtgccagcaccgcgtggctctggaacctcatgtcgtgctgcacccaccaaaacatcgcaaaaatcaattaacgtacatacaagcatccttagaatagaatgaatcgatcgacataatttaaacgtttggttaccttgaagagctgtgcgatctccctgacgagcctctggaacggcagcttccttatcagcagctctgtgttcttctgatactttcggatctccctgcagttggagcaaaattacttcagtcttcatgagggttaagcatgtgatggtatggaaaacattgctctgaaattttcctcaaacaatttgcttcatcagagttcgatcgatacaacagaaagaaaacgcggagatgctggattgaattctattattgaaataaaggaacaaccagcgtgaaattagacgaaaaaaattgtgaatatgtatatacctaaggttacatacctaagggctacggtcccaggacggtatcggtgtggcttcttaactcctccaatgcacggagcagacttacgagcggcggcctgcatgtcgatcgattgtaatatatatacatcaacgcacgtgttggcaagcgaagcaaaaaaaaattatgttcggtaaactattaaataatgtattgtggaggtgaaggatatattgtacatgtatagcagcgacgagttgctttctaggcgcctttcctcccgtggacttgcgaacaatctgcttagtacgagccatcctgcagcaaaccatgcgcacgcatacacatatatagacaagaacattattcacacgttggctatatacaatagtaatacatcggctttcaagactcttataaggagagcaagcttttttttcatcgcacggaggggaaaaggaggggaaaagagatttatagatgtcggttttaaatgaatcggtttttatgaaccgatacatatgagagattttatagtagtgaagttagaatggcgagagagatctgaatttataaaccttatcccaagaccttgcaatgttcgcaataatactacccctatatatttaaataactttttttggtacttagcgtgcaactttaaccactatttttgaatcaaaacataataataataataataataataataataataataataataataataataataataataataataataataataataataataataataataataatacaaaaaatattataaaagtaaagcaaaaaatataaaaatctacccatatgatttttagttatgttttaaactaagtaatttgagagctagattgttgaagtttaagaagtttaaccgagtaaactcaatattgtcacatatttttatacggaggaattagccactcgttcacaaaattagaatggacacattacctgtcgagaaaagataaaggcgaatcctacaaaagtatttactccatctatttcaaaataagtttatttttagtcttcattatttgtggccaattaaatgaacctctatcgcttcgtctagttacctatccaccatttttatactatttttttactagtagagttattttggatagagggactacaaattagtacaattaaaaagatgcatgaaactttgcatcacatcaaagagctattgacgaagcaactatgcttgaataatcaataagtcaaaataaagctaattttgttataatatttgaattgagaactaagaatataaaacaccaagagaaactttatagagatcttgggaagctaacgtgtgcggaagaatggatgataactcgtacctctgacagttcgagggcagtaaccgctttgctcttcagggatggccgactactgatctgtttcttggtgatccggacggagaaagagggcaatttataggcagtcaggagggagggtttaccatcttgtgaaccgacttaattactcatgagcctttaacgtggggtcgtttgattgccgttggtttgatcggacggctaagagggttcgattaggtggtggcacggatcagtggtgatacatactgccctcctattggctgtcgctagtagcacaaggatccctgtgtagtaggggtgaaaacggagcggatagtttccgtccgctccggtcaaaaacggatacggatagtgttcggagcggatttttttcggatagttcgaatacggatacgaatacggatattttttctccggatacggatacgaatatggtaacgcagtttccggcgaatacgaatacggagccgaatatccccggagattaagatgcgcggatatccgcgtaacgcttgatgtctctccagcctccagcccatcccttcaatttcagcacatagttttctctcggctatctaaaccctagctgccagatgggcgacggcggcggcggcggtgacgacagcagcggcaagccggcgacagtggcggcggctgtcttagatctccttggctccttgctggagttgctgggcattggccttcaatccccctagtgcttgtttctgcttcctatctccctaaatcgtgggacagtgggaggctaggagccgttaccaccgccggcggcaaggcctcttgcatgcactaatctcttaggtaatccattgatttgttcttctcctgtaacctttgttttgtgcctttcatgagatcgataaactgatgtagatcttggatgtgcttttttttactttgtgtctagattggtgatggagtctggtagtgcaagtagtgcaagtgcagctgcaagtaccactgcatcatctccagttttgcaactcccagcacctccaagccatgctacggcagctacgcaggacacttctcctactgctggtgccttggcacacaatgatgcaattgatttgacaaccaatgatgattctgaggttttacctcctcctggtaagaagcaaaagaagtgtagttctgaagtttggcagcactacactaaatataaggtaagcaagaaagggtcagatgacactgtgattgtagaggagtatgctaaatgcaacaagtgctcatataaacgtcggtgtgagagtaattgtggcacttctgttttctggaatcacttgaataacaagcacaacattaagtcaggtcaacaacaactacagatgaaaaagagtgaagatggtactgaaagagctgttgagacatacaggagctgttgagacatacaggtatgatgagacggttagcctgaaaaagttctatatggcaatcatcatgcatgagtatccctttaacattgttgagcatgattactttgtggattttattaagtctttacgccctacttttccaattaagagtcgcattactgtgagaaaggatattctaaacatatatgaagaggaaaagaagaaattgtggcagcatttgcttacactctcatgccgttttagcacaaccatggacatgtggacatctaaccaaaataaaagttatatgtgcatcacagttcattggatagaggacacttggaacatgcaaaagaggatcattaagtttatgcatgtagaaggacatcattcaggaagtaatatgtgcaaagagttttatgacaacatagttgattggaatcttgatagaaggcttgttggacttactttggacaatgcatcgtctaatgatgtttgtgttaagggtgttattttaaaactccgtaaaatctctcctttaatttgcgatggcatcttctttcatgtgagatgtttcaatcatatcttgaaccttgttgcacaagatggtctgaaacaaatcacaggagctgtattaaagatcagaaatactatttcaattctaaagcactcgccactgcagtttgaggcatttcagaagtgtgccttggaagttagtttggataacacaaagggcctttccatggatactcctacaagatggaactccacatttctcatgttgaagaatgctatctactacagaaatgcttttgataggttgtttcttcggcatggtagaaagtatgcaaagtgtgctcccaccaaggtagactggtctatggcaatagcactatgcaagtgcttgaagccatttcatgaagcaactgaactattctctggtactacatatccaacagcaaatcattttttcggtaagttttgttccatcaagctttatattgttgattggtgtaacagtacagatggaacaataaaaaccatggcaaacgccatgcaaactaaatatgataagtactgggagaagtcgaatatggctcttgctgttgcatgcttccttgatccacgttacaa

SEQ ID NO: 72312 - DNA, 8909 bp, Oryza sativa
tccgtcaattttcaaaatggaaaattatttttgtaaaacttttaataaaaaaaattaaaaataaaaaaaattcgtcgtccgacgaagaggagtcgtagtaattccagcggcccgacctaacggcaaacatggctgcagatttagacggaaaaagcttgctcacaatgtgtatatattgatataacgtacgtactactactactgtgtagcgcccgctcgttggagacgaggatcgctgtgaaataattggaatacatagctaaaatatgctccccacccctaatcagatcaggtttgggttccgtggagcagagtttggatcggatccgtgcggacggctgtagttatagggcggtaataaagtcgaggtcgcaattgacgacgatgagctcgcgtcgtgtcgatgtgccgcccgtgccaggttcctcgttgggcttggcggtggtgaccgcgcgcggcgggctttggtacgtgtggtgagggtctggtaagcggaagcatgggccgatcgatggttggcattgctggctaactgggctgttcggccttgcccttgctgggcctggtcagcgtggctaggctaggtgactggatagacctggccggcgtggtgctggctcggcctaatctagctggctggtttgagcatggccgactgggctagcccggcaggtttccggttctgaagaacttactttgggaataagttcacttgccttccctcaactttacattaagtttgttcggcataccttaccctcaatactatatatcttcaaccctaaactatacaaaaccgtgcaatttagttcctatggcagaattagcagctggtttcgttgacgtggtatcctagtcagcgaaagaaaataaataacatacgggtcccatatgtaagtgagaagaaagaaaaaaaatatatgtggggcccaacgtgtcaacgcttctcttttttacccaccacgcatgcgaggtcaacatctggggaggcagcagcggctggggcggctaggaggtggtggtgacaaggcggcttcgactaggggcgacaaggaggtggtgatggctaggggtggtgaggaggtgacggcggcgctacaccggctgtggggtagcgatgaggcgagctcagctgggggcagccggtctgtgcggtggcgaggcaacaccgcgctcagggtgttcgccggtcatcctcttgttgcccaagcacctcgctcgcgtttcatctcctcttcgttgacattggcgagccagagccacgacagcgtcggcagcagcgcagggtggggtagaggatgtagcctcaaatccgggtcgacgtcgtgaacctcgaagggagaggaggggagaggcggtcggccacgccggcgagagagggggaagagtaggccaacgaacctaggagggagaggggggagaggcagctgaccgtgcgtggtggagagggggaggaggccgatgaacctgggatggagaggggaagagaggtggtcggcatccatttcacgcccagaaatttagccctaaatttccagactattttgtgtattaaatccctgtccaggaccagccagggtacacaaaatgacaagtaatatacagttccaaacgtaaataaagcgtaaaatacttacagaagaggcacttagtcctcacaccgaaacaaaagccgcagcagcggaaaaaggcgatcctagcggggcttcagctccactccacaggcaaaactcaactggggtctgagccttggtcctctaactccgtcttcagctcagaagcactacacttctgaaaagggggaataatagtaaggctgagtacaaccaccgtactcagcaagccacaccaatgatgcagacgtgcacggggacacaaagaggggtttgtggctatttgcgtaaaggcagttgtaaaacattttattgagcaaaatagtaaaacaattgagtaattaaggtaagattaaatctccactgatcaacgctaaaccacgttgaacaggcccaaccaacccacctgaactacagtgcattaagtcgatttattaggggtgagactaatcacggtgaatctggtcgatcgcccataaccgcgggcacggctattcgaatagttttactctggccagaggtgcacaactgtacccacaagacacaatccaccggcatgtcacagtgtcatcatgtgcccatgatgaacacgtcaccacgtcgagtgattgtgacaagactcttcatataactctcccctaaccatccacaccacgctaaggtttcacccccaccccctaccctagaggtgggcagtcccctcgtgcgctgcggtgaatccggcagctggacaaccggacaccccggccgacccaactccatcacgcccaccctcgccacggtgcctaggaaagggtcgagctatacttcaagtcaagcagttacccactcccgcttgtggtaagtattgtaagtcttccagggtttcccgtgaaccggtccttaattaccatgggtgcgaccagcaaaaccatgcacccacagcccaccattcagtcgcattttagttggataattacgaccatgaaacatggtcaaatgtctcgagcacgcagctcgtcaagatactaagatgtctaatattgtaattatcacatcaactgagctagtggcaattaagcatggctaagcatatagttctagctgtgtcacataagtaacatgagctagtcgatttatcacccaaggttgacaaaggacagatatcaagtaaacatggcacaagcgagcagataggtaaatcccgatcccatgtaattagcaaaacatgcatatttatttgcaaaaggtaaaacatttgtaaagtaggatcaaaatgctcaagggaaatgtgtgacttgccttgcttcttcaaacgatcttcagaactcttttcctcgcgaccgcggacttccgaaacgatggattatacacgctggcacgcaaaacgaggaaaaactctaataaaaaccaaggaaatagtacataaaaagtaaacaaacatgtagagctcaattttagatgaattttgcaagttgaatagctcaattcggagttcggataaattagatatgaattttagaagttttgagccaccttaatggatttatagaattattaatgatttattgcgcaattaataatggtttatgacgtcaccgaggggaataggttgcgccgacaagtgggccccacctgtcggtggctcaaaggaggtcggcgcacggtggactcagtccacgcgcgcgctgcccgcgggcgcaccacgtggggggccgcggtggacggggaggacgaggtggcgccgacgtggcgccacagggcagcgacgccaggcggcacgaggagagccacgtggacggcccatatcgccccgaagggggatggggtggccacgggcgagcgggagccggctcaccgaccggccggacggggagccacggcgcatggcccgatgatcgccggcaacgaccaccggcgcgacggcatgtgcgggaggcggcagaaagaggggaaagggagaggagatggagggggtcctcaccgaggggcgccggtgacggaaggacgacggaaggcggctggcggagctcgggcggagggaggcggcgctgctccggcgatgggcggcgcttgggaagaaactgacgagggtggccgcgacctgcggaaggggaaggagggattaaggaggggaggaccagagcggtgcagccaaaacaatggccggcagcgacagtactaggtggagctcaccttgagtgatggggatggggtttcggtgacgattcacggaggatgagcggtggccgggcttgcccttgggacggcgaagccggtggaggtggttgcgcggcacggcgatggctaggacggcagtggtggtcggctggagacggtagaggcggcggtggctcggttttgcagtagggcggcgtttgtgcggtggtttcgagggggagagcagcggccggggtggggcttgatgcagcgaagccgccggcgcaagcggcgaggtgcggcgtcaactagcgcggcgacagcggccggctgaaggttgccggcgagcggcggcgatggggagcggcgtggggagagcgggagaaggcgagggaagcgccgacgaggaggggaaacgagagaagggagcccgaggatggattttataggctcggggagggaaaaacgttgccgggcgtggcggatttggggcggcaatgaccagcgacgtgggtgacatcatgggcgaagtggagctcgatcccggcacgatttttgggggaaacgtggggagagtgtagaggaggtggatgggaaccgatttcatgcggtttgggcgtgagggcgtgagcgggaggagccggaatcggcggcgatgtgggcggcatggcggcttcggcggtttggatgagggaggctggaggtagaggaagggtctgacaagcgggtcccgcagccccacttgtcggcctgaggggagggaggaggcgcgcagggaggcaaagcagacttggggaggggaggcgcgctgggccggcggcccgaggagagtagggaggagggggcggccagccttagagagagggagggcgcccaggccgcggggaggcaaaggagacggcccaagggaaagaaggggaatttaaattggttttctttttattttaattgataaaatgaactttgtgactttaaaattacttcttgagctccgaaaattcgcggaaaaatccagaaagtattttagggtacaaagaatattacaaaatgtttccggccaataatttttaagggaaaattttaatttcccctataatttcacttgattaaattgcttaaatttttatttaatttctgggaaatgcattattaagtgatttttaatcccgaacgaaaatcggggcattacaatccagcagttgctcctccatccagtcccccgtcggtccttctccgctcagccccccgccgctccttcctcaccagcgttgcctgtgtgcatcatcggtgtcgtcgagccggtggagctcagccggccgcctccccccggcgccagcgacctcccgagaagagaagagaagaaaggaaaaaaaagagaaaagagaagaaagaagagatttgggtcccacatttttctcacttacctgtaggtgtcatattttatttatttatttatttgctgactaggatgccacgtcagcgaaaccatagatatatactgctatgggatctaaattgtgcggttttgtatagtttagtggtgaagattttttgtattggggattattgacgtcatataaactcgacgtaaagttgagggacagctgttgaacttattcatacttctactttggaagaagagattttgcgagtttttttttatttcggttgctctctgcctctgtagctatctcatagtatacagagtaaattgcctctggaaaactactcaaaattcatggatacaattaataaacaaaccaacattgaataactaaacgatgatggtacgtttatatgtcaacagcatacgatgaaatgaaatgcgatacggtgtcataattgcatgggcatctggccaattttcaagccataatagtactatataaattgatgccctatttggtgggtatcttttctttctataaagttaaggccaaaatctcaaacctcatgcttctacgtcatcatcaaattgtgaaccgttggatgaatgtattaggatgaatgtattagattgcttctcaaacgttggagggaatgcagcatagagcctaacccatcagtcaccggatgagtctcttcgcctacttagtgccaaatatagcccacatgaacacattggcccatctccacacacatctacatgtatccagcccgtcaatccgtataaaatagttttatggctgaacgctccttcagttgacatgtgctacctaaattatctacaaattttggatagggctgctaaaaagaatttcttcaagaaagctatttgtttcttttgtttcttcttgagattgtacctcctatctaacaaattaatattaaccaagtcccacaacaacgcgaggagccctctagtattatatatatgtgcgttctgaagaaccaccaaaacgaacacgatccttcacccggtcacccctactggccaacgtgttgttatagacgctacttcctctgtcacatatcaaattcatttgtagctctttccatttatctcaaaataaatagttcatatttagaaaattattgcgttggaatagttatattggaagaagataaagtatgagtattggtatacttcctccgtacttataaaggaagttattttagacaatgtttaagtcaaaccttaggaatataaatcaataataactcttaagttgttgagtttgaaaatataaaaattatattaatagatttgtcttgaaaagtactttcataaaagtatacatgtatcacttttcaataaatatttttatagaaataagaaatcaaagttgtgttttagagatcgtgtcgctgttttaaatgactttttttacgagtacggagggagtatgtgggatggatggaaaaaaacttattttgagatggatgtactattaacatgagttagtttcaactatatttagaatatgtcacgacttaatgatgatgggatggcaacattgtcaaccagctttaattactccttaatctcttatgctcctagtcttgcatacctggtgacggtggtgagccatgcgggaacgacgaactatcgtataaaactttgttgatttcttagccccacatgttatagaccccatcaaaaataaaatttggtaatagaatattataaaagttttcatctttacaaaataatgataaatttattataatgataatatatttgagaaaaaaaccgttgcaaatcacggagattatgctagtgtttaaatagcaaatctggtaggcctgcctgaagccatgctgactaggagcctgctagtgacaggctggctggcaaccactttggatgcattaaatcgaccatgagcaaataatagagaagttgctcacaaaataagcaaaaaaaaaaaaccaatacctgtatttatctcagagcgatggcactcatggaataattaattttggtaattttattttctaatccttttagtacttcaattttatgaacatagaccgttgaaaatctttacatatctatattagtccccactaccaactccttatttttcttaaaaaaaagaagttaaaatgacatggatccacatatcaactacttccaccaccaactcccaactttgtgagaagaaaaaaaaataatgcgagacattaacaaatatatgctgaaatcaaggtatgctatatacatagaaaataatgataacaatgggctatataataattttttaattaaaatctcatcccaacgtataggtaatatgcaagtaatctaaatactactacaaaactaaagttagtgctgagttcatgcagtaaaaactgcaaagctttactctgctcatgcctcattgcctgctcaagctttctgtcgttgtgacctgttctcgcttcagctttttttttttttttttgcaaacacattaattgatttataattaagagtactacagacagagctgaagggaaatatcatccgcagtacattgccagaaaagataaaatatatacaacaaaaccatccattcagacataaagccaattgaactaagaaaaactttctccaagataatccaaacaacagtaatggacgagatcgacaagggactgtggcattgcgcgacgactacgtccacgagcctctactaaagacatgcacaccgctcttcggctgcctccacggaagtgacactcttcgagatttgttgttgagttgtagattttgcttaaacttcaccagactcaacaaaggatcgccaaggagttctccatcaaatctgaggagcactgaccggtctgtactcaacccgaatggaatcctcaacttaattggatactgctgcaaggagaaccggaaaaagtcttcacaccccagctcgtctgaggacgctgattgtcaacattttgtcaaatgaagaagaagaagaagaagaagaagaagaagaagaagaagaagaagaagagaagattggaatgagggagaagaaaggtgaaataataggggcagcatcaaccatatgaacatatatattacattggttactgcaaaactaatttggtgatattatcaaagacaaaaaaacttggtgtcaaaagagcaagtgcagacaaattcggtcctacatcatcaaaatttcctagtttattaaccagtgggccaatgctgtcttatcaattattgtcagaactaaaaaaaatagatttggaaacaagttccaggatgatttacttttaaaacatcaataaggccagctagtgcagaaggttctttgggggaagcgctacacaaaacgacatccattcatattatttttaataattgcattagatcctagcgtttagttcgagagtttctagccaaaaaatattaactccatatctttaactactttgggcactccaaaattgatagaaagttgggagagttctttttcctcaacgatagaggcttgttttcatgctagcatcttttgaatatataacaaaacaagagatcacttgaaagaacattcctataccgtctattatatttcatttctaactcccgcacttcatattgggaaaagtaaagatgcaaacgctggtagaagcatcatataaatggattacatagacccaaacagaatgtaatcgtttaaaacgatgtttatttagaaagtactcccttgttaacaactaaat

SEQ ID NO: 72313 - DNA, 8701 bp, Oryza sativa
gaggaggacaacacggacgcggcaacagatgaggaagtagagtgcgaaggtgttgccctcaccaccgccgtcggcgcagagcacaacgagcacgtacttggctagctcgtcgaggtggggaaggacgtggccgtcggcgacaagctccgacgcggcgtggacggtggaggatgcggccgtctacgacgagctccgacgtgggacatggatgatgaaggacgcggtcgtcagcgacgagctccatcgtgggacgtggatgacgaaggaagcgtccgccggtgatgagctccgacgtggcgtggacagtgcaggatgcggccgtctacgacgagctccggcgtgggacatggatgacgaaggacacggctgtcggcgacgagctccatcgtgggacgtggatgacgaaggaagcggttgccggtgatgagctccaacgtggcgtagacggtggaggatgcggtcgtcgacgacgagctccggcatggggcgtggatgacggaggacgcggccgccggcgacaagctctgacatggcgtggacggtggaggatgtggctgccagcaacgagctctagcgtgggacatggacggtgggatatctggtaggtatcgtctgatacctcgcaagtatcacattctacgtggtaagaatcgcatgatatctgataggtatcatctgatacctcacaaatatcacctgatacgtggtagaatcacatgatacctgataagtatcacctgatacctgataggtaccatctgatacctcgcaagtatcatctgatacgtggtagaatcgcatgatacctgataggtatcacctgataccggttaggtatcaggatctgatacctcacaagtatcatctgatacgtggtagaatcgcatgatacctggtaggtatcacctgataccggttaggtattaggacatgatacctcgtaagtatcaccctctatgtgataagaatcgcatgatacatgatagatatcatctgatacttctcaagtatcacctgatacgtatgtgatagaaacgcatgatacaggttatgtatcaagacctgatacctaaccggtatcatcccgttcgaaaacgagattccgttatatagcagcccccgcttgaaaactaacccctcttaggacaaaaacacattgtttgaacatattttaagtcacaatatttttaacatatgaattgcatgtatgaaaaatcatatattttgatttgttggatatttagttatcttttatgaaaaaaaagcttcaattgaagactatatcgatgttgaaacgatattttttccaccaaaagtgagtactatttaggtgtccttggaagtaaatttagaggttttatttttttaagataaaggaaactttcttgatggatgtaaacaattataataaagtgatacaattaatctaagatcactcttggcaccagcatagtaggttgtccacaacctataattattttttagaaagaagaacgacatgataacaaatatcatgccatagtgagctacaaccacaagctttatactctatacacgcatcacttagaaaaccttaaaaacaacacctccaaaataaaaattgcattgtcattgccatgatccgatcaacaaaacccaaatcataggttttcatactagagaccaaattcttcgaattctagacaatgccttcaaccatgcgtaatgcgcatactgtagcggcaggaagccgagtctttcgatgatgcactagcactgagcccgaagtgtccacacttgcatagttggtccctctcaatttgcttgtgtttgtgttggagaagattatcgttatgtcttgctgaaagaatctatataaactttctacctatattaagggaaaaaaatcatgccttaccagtctacctaccaattagtaccaatttaagcaatacagtaatatatcgtcggagagtggattttgaactctcgagtgaatgacccatcgttgtttacatgtcactcaaatggttatgaaatttttttgagaagatgtattaacatgtgatatattactccacaaacatgcaagttaaatcaacttttataagttgtaaaaaaacaaactacagataattaaagtatattcatagtcaaatttattttttcgttacgatatgtagaagttaaatttgactttgtatgtttgtgaagtgatatatcacatattaatatattttctcaaattttttcataaccatttgagtaacatacaaacaacaaggagacatcccctcgagagtttaaaatagtttccccgtattacccagtttggaggaaaccagaaatattttaggccatagccatgatacaaggtgaaacggttttatttcagaatctggttacaagagacttgaatttcctttactacaacggaactaaattcaacacgaataaatctacagacaatttaatgaaacaatcaataactttccgacaccttgtaatcacatcaacccctgagcccaacgtccatcagcatgagcaactttattctccttaatatcgtgtgttgcagtctcagttaatcgctcgtctgaggtgatgagcagccgcagaggagctgccagatgctcttcttgacgttgttacgcttggacttccccattcttgctccaggaatatccgagctgcacaagctctaatgctccaaatgaaatgctcctgtaaacaaaggaaccaattgaaaatctcctacaaaattacgcgaagatgaaagaaatatacacagctaaatagcaaaaaggaaccagcagagtaaaaatagaatgctattgtaacctccagttaacttcttcaggaatcaggggatgtcaagcttggtgcatttggtgaatgagagaagctactcctatttataagtgttgcaagactgaactgtacactgcataccttggcttctgaatattgtcggactttgcaagtaaaagttcgcgagaatccacaagaatattcaatgaagaaggactgaatgagtccagaacttgaattctgtccacttgcacaaacttaattcggtggtatttgcccgggattagcttattcaacccttgtttaattgcacctcacctctgcttgttagagacaagtagaggtgaggtgcttgttagaacgagaaatactcaggggtctttcggctagctccacaagatggtgggctagacgacctgggttcaaaacctaaccccttctaattatttgatattaggtccttccctaatttttgagttttttttttttctgcttgttagaacgagtcctagacgtcccaaactgctttaatcactatattagatgcaagcgattagaatgcgcgtaattaatcggattaagtgaatggtttggaacttcatcgatctatgccatgtaaaaagaaaagcattgcgtattccctgggttgcttctactgttacataaagtgtgctgttcgtcgtcctgttgattgaatctttcatctaagaagaattcagacacagccacgggttgcgaaatggcccggatagactctgatgatttgatgggctgcgcgggcccaaaaccatgaaggtcgccatcccttgggcctagtggtagggctttgtctcgcgcggcccagctcgtcggtcgctgttggtctgctacgccaccgatcaaagaagttcacaagcacagttggtttgcagtagcgtactctcgatctgttctaaaataaacaaatctattactcttaatattataaataatatataatatatcttaatactataaatctgttctatcaaatattatgtttttgtttattttaatatgaagaaaagtaggaaactaggaatgtacgtaggggcttttcaactgaagttgaccgaagcatatgtgcataataatttgttgggattattgtattgagaggcattgagcgtttccatccagggcctatagctgtgaagaagaataaaatttgagcatacgattccgctcccgttttgtaaaccgccaacatgcccatggttttggacctttttttgtgccaaccttgcaatcttcaactacaaataaacttggatggaccagttctcaatacgaatgaacaaaacatagtactagtaaattacggcctgtttatagttccctaacaaaaattttgcaccctattgcattgagcgtttgaacacctttataaagtattaaatatagaaaaaaaattaattatacagattgcgactaatttgcgagacgaatcttttaagtctaatcgctccatgatttgataatgtagtgctacagtaaacatttactaataatatattaattagggttaataaattcatctcgctatttactgacggattctgtaattcgtttttttattagtgcttgaacactacatgtgacaccctatataatacccgatgtgacatgctaaaactttacacctctcatctaaacaccccctacagctgctaggcaagtgaaatatctctatgttctggaaccgtacttgtttccatgtcattggccaggaaaacaagaaactgcgtcagaattgagacctggaaacattattggctcctaattaacgcaattgacactgggccacagatcaaagccatacttgtactgagcttggacgaaaatattcttcgtctttccagatgattaaagagccttctggagagagaagcaccatcatggctgcctatctggcgaacggccgatcggccatgtaaaggagaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacgtatgtaggggcattgcattttttttttcttttgccttttcagtttcttctcttgttcagcaaattctggttcagaaaagattgacaggttttgcatctgatttaccgttggtttttgactttgtgtagctttgattcctctgctggagtttatggagatgaacgtgcaggcgaggtatgggatcaaccccgataaggaggtactggagatcctgcaagctgaatccaagtccaagcaggtaatgattctgcagccttctctgaattcttcatgaattacctgtgatgggactgtaaaaactagaagggaaggttgattcaaatgtaatcaaactaaaaagaaacgttgatccaaatgtaattcaaagcaaaacactgattccatattggctggatcaggttgaagtactggcaaaagtttactggggtgatgcaagggagaaactctgtgaggcagtagacgatctcaaggtgaatacctttgttcttggttgcaggggactaggacccttgaaaaggttagcatttaaacctttttcattctttgatctaaacctcttctcagttaaattgcgtgtgaatcaatggtttttacctcaatgcagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagcaaagataatagaaaaggtgcctggcagtacatcaaatgtatataaacctttatttccaaatggcagaaatatatgctttattctttaaatataacaaacagtgttttacattaaccatctgctttgaattttgtcgtacaaattgaggcgaatactctttttagacaatgagatgtctgaaacctctaacaacaatggaagcaattttggagcatagcaatcagaacatcttaccagttccatctttgcgtggaacagattcttcaagatccattctgcgccaactcccactcaaagatgataactcatcaaccttatcatacaaaccaagaagaccacctgtatgtacaaaaagaatttttcgcccttcccacttagctggattagcacccatgtctttcagcattccatatgctgcctttccactgcagaaatatgaagcatatatctttaggcaatgatatggccagtctatcatgaacttgtgatgaccttcaatattagtctaacagaacaaaactttttatacttttcgacaaatggcaagtatactggttgtaaaattagagttacatgcaaaaggtgtttcttgggattaatgtttcaacaaaaggaatatattgtacctgtagactggatcaaggacaatgcctgttgctgtagctatatctttaacaaacttaagctcctcagctgtgttcatggcataacctaagcccttagcctgtgaagcggcagttgcaggtaatcaagtcaaatgttcacaaaattctaccaatgcacattagcaggaaatatcatcaattagagttgcaccataaaattggaacaatgaaatgaataaactagtttcagaacaattatgttatatactgatacgcgcataacaatgtcataattagaggatgtaagtccactcttcaataccatttaaatatcaaatatagaactttaaaaatgtacttacattttcaatgttgactaaatcatgtgaacgcaaatcagaatgaagtccatcaatcaggtcttgaacataggaatggaaatatccaggatcatcacaaacagagaaagcatggacctatcctaaaaatggataattagtcgaacaatttcagcaggatagaaaacaatcaaagaaagtgcatacttttgcctttaagctactcaattttgatcctaaagcaagaccagcaatggttccaccgctgcataaatttaaaaatcattcaagtcataaagcagcaattgctactttcaggaactaggcatgacgcaataacaagtgagtacataagtaccccttaaaagtaaagaatggtgcgtattgacaaaatacctgccacatgcaacaacaatgtcgtcaaactgaacatcacctgatatctgaatttgatgttcaatctcccttattgcttctatatatcccctatcaagaaacaaaacaagttctgatttacaaaaagaaaaaggaaacaatacaagttacaaagataggtcaagtttcaacaatcgggtatcactttcacaaattctgagacctgtttgaactttgaagtgcaaaccttctctttacagtaatcttatattctattcaatgttgttgattaaatgtggatagaatacactacatttgtccttcagctatgctccacttgttagccaccacacaagatagaaccggatcttctagtgttgcatgagatccactagattcagagcctagggccttagacaattccaacattccaggtccaacatagtatattgaccaatagaaatttgccaaaaaaaagtgatgccctaatgtttattcaaatacaaactaatctcttcttttctgatagactgatggcaaacaccaatccatgaataataatagtccctgaggaatattcaaagtatgctataaacgcacaaagaaattgaaaatgcaaaaatggttcaatagttaggattgaacagaaaacaataccaagttcctagagagtttgatccaccaacaggaataacatatggttttcggccttcttccaaaagcttctttttcagcaagtccgctaaagcctgaaccaaataaatccatactaggcttagggacttttaagcaatatcaatatgaataaagaagttctaacaagaaaaagatcactcagatattttaataggcaatgccactttaccagtttatctacatacatattcaaagaataggcaatataatcatgatctttcctcagaatagggaaaaaatgaccatgctaattgtatgatgcagacatatactgcaggatgcattacttgattggacctttagcccctttaataactacttgagtatggatatcaagtatcagtataacaccaaaatataaaaagttcctttgctacacatggcccgatggaattatgaaaataataataaaagcaataatagcacatcatcgaaaagagcataccacactgccaatttttccatattcttcttttgaaacaagat

SEQ ID NO: 72314 - DNA, 9867 bp, Oryza sativa
  unsure (1)..(9867): unsure at all n locations
ctgtggttctgaaagttccgaatgnacnnnacnanngngcnngcgcgnggcgcgcgagagaggggcactctgcgcggcgacgcgcgctcgcgcgtgcggagcggtgttgatcggaaggagagagggagagagggagcgggagcgtgccgggggagagagaggaaagggccggggaagaggggaagatgggcccagagaaaatcggcccatcgaccccgggggaggcaaaatggacttttgcagaggaatttgatttggaaggatttggattcggagttgaactcgacgatagatcggggatcgagatcttgagatggcacgggcactagacaacaagcaaagaaacagatttcgcaattagggtttttaggagataattttcccgctaggcgccaagacggaacgggcgctacagaccaacccccctaacaagaatctcgaccccgagattcagcacctaagggagcagctccagaaactcggcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcagattctttttcagcacgatattacccaggggaatttgctcttctggaactcgaagacatttctttagctgggatacgtggaacacgttgtgcacatctgcgagaccttcaggtagctcaagctgataagccacttcgccacgtaggggccgatgtagcggggtgctaacttgccggacatcccaaacctcctcataccacggaggggtgatacccgcaggtacacatgatctcctttttcgaactcaaggtcacgccttcgattgtcagcgtaacttttctgacggttctgcgctgtctttaaacgttctcggattagcttaacttgttcttctgctgacttgagtatgtcaggaccgaataccagcgcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccagggcacacgcacgtagcatgtcttctaggatttggtttaccctttcagtctgaccatcggtctgcggatggtaggccgtactaaaatttagatcggttccgagggcttcatgcaattgtttccagaaccttgaggtgaactgagtgcctcgatctgacacgatcttcttgggacagccaaatctacatacgacatgggtcatgtagagttctgctagtttctttccatcaaaggtggttttcactggcacgaaatgagctgatttcgtgagtcggtccacgattacccagatggagtcgtacccgttaggggttcttggcaaactggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctggatgaatggaataggcggactcatgagcttcctttaggatgagatctcttaactccttcttggccggtacacagatgcgtggaccgcaccaaactttgccttggttgtctatggagaaattggtgtctttcttctcctgtattctttttattaattcttttatcccttcgtcgtctttctgagcctcccggatttgcgactctagggtaggctgtactgtcaagctggcagggacacctgactgtaccacggtcagccttaacttctccaattctctgcacaggcgatcttggtcaggccgtatttgagctacattgcaataggccttgcgacttagcgcatcagcgaccacgttggctttaccagggtgatagtggattccaagatcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcctttcggatatctggcaaggtgagaactagggcagtggttaaccttttcttcatttcttggaagctgtcttcacaggctgcagaccattgaaatttcttttccttctttaacagctcggtcataggtctggctagcttagagaatccttcaatgaatcttcgataatatccagctaagtcgaggaagctgcgaatctctgacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgatgatccctgagcttttccattatcaacctcaggtgttcagcatgttcttcctcgttcttggagtatatcaggatgtcatcgatgaataccatgacaaactggtccaggtattccatgaagattttgttcattaagttcatgaagaatgctggagcattggtgagtccgaaggacattactgtgaactcgtataaaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccatcctttttcttaaccagaagcactggggctccccaaggggatgagctaggtcgcacataacctttactttccagctcttcgatttgtcttttaacttcggctaactcattagctgccattcggtagggtctttttgcaattggtgcggtgcctggtgccagttctatggcgaactcaatctctcggtctagtggcattcttgttaattcttccggaaatacgtcgggatattcacaaactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgtaaattttgggttttccaaccatttcttttcacaaaagcttgtgatatgaaagaatgggaagctctcgaatcaaacagaactattgcgggtatggagttgacagagaacatacccatcacaacgtctggagcatcctgagcggtttcagcttgaatgtgattcacacggcctcgaccaaagtggttggaagcatgtgaaccttgtccacttgcctgagtgctaggacgagactgagctgccgctggagtaggagttctggcagtgctgccattagcatgccctgagttggtgttggtagaattctgagggcactagcatagtgacccatctggttgcaccggaaacactgaactgctgatggtccctgtggtgacttgaaagaggtaacactgtttggcgcagtattgccactaggggcacgctgctgtggctggggtgccgggcggttcatctgaggacgaggggcgtagcctggctggcggttagcctgagtgaccgactggtggtattgcatgggttgaccgtagcgagggcgaggtgcgcctcgggaggaattcccctggtggttagatttgcgtttcttgtattcttcggtagcctcttttctggcatcctcaagtagaagtgccttgttgatcatatgttgaaaagtggggaagtcatgcgctagcaactggagtctcattccaactgcgattcctttcaagaatttcctgatcttcttcttatctgagtccacttcctcaggggcgtaccgagccaacttgttgaacatacttaggtactcattgacactgctgttgccttgcttaagtctgttgaattcctctttcttcatgtcaatggtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcaaccaatcgtcagcctcgacgggctcgacggtctgagagaactctggcggacgtgacctcagaaaatctgtcagcttggatctattgttgcccatgtgagggtggccatttccatgcgcattatgctgataaccggctacggctgcggctattccttgcaagatttgtgtctgaactgccattaagtgttgcatgttgttttccacatgagatggggaagggaggcgttcttctccagaattatgactggcagtgcggtgagagcggtgagactgttccatttctgcatcacgggaagctgtgcgatgcgagcggttgctacggcggggttgctcaacttctgcattgccggaaacagtacggtgcgaacggttgctgcggtgagactgctcattagctgattcatgatttgcttctggttcgactctaccttcttcaaaaccgaagcgggctggcgcacgagctgcacggcgggggcggctagccatctaaactcccagaagagggcggggtaagagtcagataagtacttaggagggcaaggagcaaagtaaatagcaactcagatagcacacactaggcataaactagatttttcaaatcttaaaaacacctgatacaacgggtgtggacaagtcacagagctacgccgagcttgactgtgcgcacaccacctaggagaaccagactaccaaacaacacccacaatcaaacacacgcacgcactacctcgccacgactccaaaagagttggcggcggaacaaaagggcctaacacacggacgactgctgaagactgcctcctctactcctcgtcggcctggctgcctcctgtagtcggctcctcagtcgaagaaacgtcgatcggctgacgtgaagggaccggcggaacctgtcgagggccggcagcagcgcgggccgctggcggtgggggagctgggtggtggaaacggaacacggtggaagaaccaacaacacgcttccacgcagtgcggataaagcgtggaccacggcgggaggaaacaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaagcggcgtagcggcgggccagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggctaggcgacgaagcgcagtccaggaaaggtcctggtacgcgatctggagagtgggcctggccacggtgaagtggtgggggtgaaggccagctccgtgtatacctccacgagggtagaggtacacggagagctcacagtgagggggaacacggtccacggagtaccccgtgtactcgggacacgagaagccaaggaaacgggtgaggtcacgaagctgagcgacgtggtgaccctcaccaaaaccgtgggaactgaagctggcgttcactgccatctacaattttgaaagagggagaaggatcagtaaccattttagaaacaaactattgaaaataaagaaaacaaaagagaccttagcttttcgcaagtagttttgaacttagtatccttagggtcgtcctaagcgtcgggtttcgccctagggccaagcctgtgctctgataccatctcttgtcacgccccgagctagtcccgactggaattagcccgtgacgctccaaattaacctgttaatcgataccagtcccaggaaacagtgctggtatcacaggaagatagaatatcacagcaacagaggtctctttattatagagtaggagtacagtcatgttgggctgcggacagatcccgagctcacaactgcattagaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactagggggggaatatttatatagagcaagggtgagtacgggagtactcagcaagccatgggaaataagtgtttaatgcaggcttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggccaacaacttttcaaacggccacccgggcctagctgatcccgtcagctgctgatttttcaaacatcgaaccccttttcacaacagtaatttcacaagcagttgtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggttccagaccatactgtgctaggaagcccagggggggtcctctccgacaccaccccggcgaatccacatgtctctcggcatcatggctcccctgataagctagttactcagccaggggtgtcccattccacccatgtggtcgtacttgtcttttgttcggatgaaattccaaggaatcggtccttaagtgcgggagtgggaaaaccgtacacccggtacgttccccggtccgcggttttataaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaatttcaaatataggctcaagatgttcaaaggtggcttgccttgctcgagatctggagcttaatcctcgaaatcctcgcactgcgggtctacgggctccgaaactacacgcgaaacgggacaactcaacaaacggcgaaaataaagccttattaatgacctctaagcgtgccattaggtagaactcgagatttggggaattttggaagttgaacggagtcaaacggatttacggtggggaagatattgaatttctaagattattggatttttagtctaaaggaaaaggatttaattaaatcctttttggaaaggataaagagaagaaaaagggagagggagggaatatagacttccctcggacggctagggcgcggcccgagagaaagggcggctcggccgagcttaacgggccgaccggcccaagaaggcggcccagagcggcccaagacgcgtgcgcgcggaggaaggagagagagtccggtggaccgagctcaccacgcgcggtcccgggtaggacccgcttgtcagcggctcggctcaccttgcggagggagcacgcggcgcggcgctagggtggaggatggacgtggtgcatgcacgcggttcgcggaggacgcaggtgcggcgggcccacgcgcagcctcacggctcgcggtggaacgcgcacacggggagggactgaccggggtcggcccgtcccgacctcggctgagctggcgccgacgtggcgcctacgtggctgccacgtgggctggcgggaggtagacgacgacccggccgcgaatggacggcgggcggcggcggcgagcggcggagcgaaccacggcgatacgggcgaaagcgagcacaccgggcggttgttcgtgatgaggggagacgagccaacggctcggattcgccggagggagcttgacggcggcgaaacgcggcggcgacaaccggcggggagggaagagggaaacggcgacgaggccacgaggggtcgattcccggcggtgagagcatctacgcggtttcgggaactcgatgctagcgtcggattggatggagctacgccgagcgaggctggcgacgtgcgggtgctacggagctcgagcggcgacggcggcgagcacacggcgagcgacggcaacggttggggcggcgccggctagctacggggagtctactcgtgctaccaccgaaaactaaggggggaagatggagcgaggaggaagaacggagggagacactaccgtgcgggacggggcgctgtgacgagaggccgacggcgcgggagtaatctctccggcctcgggccggggaagaggaagaagagggcgcggccgaagtccccttccgcgtcctcgaacgcaccggttctcctggcgctcggcgaaggacggcggaggcgagacagagcacgggggcggcggcaatggcacggaggcgaatggaagaggaaggggaaaggggaggctggggtttaaatgggcggcaatgtcggtttgggaaccgacttgcgcggtcaagggcgcgagctggcgctcggcggtcgcggccaaagcggcgacagggaggatgacgccggcgaggaggaaaaaggggaaaaggagggggagaaaggggggcttgcccctttgccgattcgggaaaaaggaggaggtgagcggtggcgacccggcaaaaggaggagggatgcttgcttcgtccttggcggcttgcgccggagtggcggtgccggctatgaccactgcgatgacggcggggcggtttggaacggaacggttacactggcaaagggtcct

SEQ ID NO: 72315 - DNA, 10851 bp, Oryza sativa
cgccggcccgcagccacacgtatccagcgacggcgccgataccttcccttgtccaccgcgatcgggcctccacgacggcgcattgcgcgacaccatggcgaagtgagtatggctggggtcacacaccacgccgtgcaggtgcagcgcggcgagcaggagcgcgagcgcgagcgcaagcaggcgcgcattatggcctgaagccgccgccatggacgcacgttagatggtggtgagacgtgggggggaagacgagttttaaggaggaggaggaggagatgggtccatggctccatgaactccattgacatggaatggatcagcacaagtggagcgtgctttatgggaaaaactatattcattttttaaggggatatcatctcgtttttacatgtcactcccaaaataagtgcagttttaacaccgttcatgctcaacgtttgaccgttcgtcttatttgaaaaacaattatgactagtatttttattgttattagatgataatacatgaatagtactttatgcgtgactaatatttttattttttttataattttttcaaataagacggacagtcaaaacgctggacacggatatctatggttgcacttattttgggacggaggtggtaaaaaatttagtgtagcagattatggctcggtttagttccaaactttgaatcccaaaaacgtcacatcgaacttttctacacacacaaactttcaacttttccgttacatcatttcaatttcaatcaaactttcaactttagcgtggaactaaacacaccctatatgtgatatgtcacttcaaacatgcatattcaaattcaacttatacaagtaaaaacaaaaatagcaaatttaactgtgaaaagaacacgtaatttacggttaaatttgtttgttatttttgtttcaaattacatatgtcgaattttaacttgcatgtttgcgaaaagatatatcatatattgatcacaatatatatcttgataattttttttaaaaaaattttgataactttttaaacgatacgcacaaaacgagaggatgtcccgacaaaaatccacttccgctttatgggtgaaaagaggtgggaataggagagaagttgttttgccggggaagagaggaggcaatggcagccagcaaagagagaggcggtagtggggttggcggttaattagtcgtcatcgacggtaggagtgaagaagaagaagaaatgaagcagcgctcgtgcgtgcaggcagcggcggcgtgcagctcgcgaccactggccgagccgagcggggcgtgcacttgattccagggcgaagtggctacgtgcctagctcgcgaagtgaatacacacataatagtatggcagtgtgcggtcaaggcgttttgtgattttgagttgagttgttgatgatgggtcagtgcggggaaggcaatagcgtcggctttcctcggcaggagggcagaggctgcctcacgaccgggctcagtgctctgtagtctgtacataccggtagtatatgattggggcactggggcatgacaaaaggcacaatgtgtgtatgtagcaagtggaacatcatcatcttctgggccaggagcaaagatatgttcatatagcatattagcgtttgctaaacatgaagtcagcatgacatgactcggccggaagcaatatttgccgtctgattcataatagcaaaccagaaaaaaaaaggtgtcttctctttgccagaataatgcttactatattccatatcacaaataagtgtgcagatatgtgtactgtggagtatagaaaaagaatgttggaagatggagaacttatctgcttgacccagtgagtagtgaccctacaatttggatacccacccaagtttttatgttagtgtcccaaaaaggctctgcactggtagtcttgtaccataatgctcacacatattgaattgccaataggcgtcccctttcggatatgcctaagccaatttgtccactggtgcccgtaatggccttagcccctctaaagagaggtgttgcatactggagcctgagcagacaacttaagtttgaaaatatgttatcaaggctggctcatgcataatttgtttctacaatgaactgcacagaatttccaaatatgcatgtggttgctctgacttgtcttgttaatttttcttaatttctagcatagcgattttacaccaacacaaaatacttacatgatacataagttttgcagcaaattaatacaccagaatagtaaaaactgaacacaacggttcataagtagtagagaaaaatggctggccctagacgattaccaaagattcaggtatgcatgtgtgcagtttggcatcgaatgagctcactaaagtttattagggaactatttaacaatgagaatcaagaacactaaaaaaacggtttagtgcaccagcaaccaacatatttgtatatgccggctacagaaaatgatttcaggggaaaagtatatatcattatccacaagatatgtgcccatgataaacctcagcatgtgtcatgttacttgaaaaaatatacaaagcattccatttctcaaattgaacagagtgcatgtaaactacatcagcagtcaaacatgacatcttcgatatccaagaatatttccagtggtggttcacaggtatggagagtaactgacgaggttcatgaccaaccacatatgacaaaagaggttcctgataagacaaaagatgatcattatagagaagtatcatttctcaggaacaacagaagatggtctcagaacatttgtaaatttcatgtgtggtaacagttcaactccagaaaaacaaacttctgaaagtgattacttggttgtatttagagtgccttgaatgccattcctgggctggtggtttctctttttattaacaaagggaggacatcactgcctcgcctttctaagaaagaccatttttgccttagaaaaatacaacagaaatacagaatacggtgagaagtaactctatccatttgttcaacgagaatttatctcatctttgctgcccttagcccttaggtttttgtgggacttttcgagtaacaaagatccactggcattgccgttatagcatcttaaaggttttttgaactattgcaacattatgtaaacttgagattgcaagagttaaacaaaaatgttgtccatgctatcatgttaacgaaatgtgtagcatactaaatatgtgaaacacaaaagctattagtggtttgttggatttagagtataccatgaactagtaaaaaagattcaaaccgtcttagaagctcacccaatgtagcaaaaacaccggttactcagtcttcttttgcttggttgattctccagtcttgctaatgatggtatctaagtgccttgatagtacactgtgcgccataccaatcttttcatcgacttggtcctggtacttctcatacaatggtggaactaacagagaaaacattacacctagagaaaagccagaatgatacaattattacatatgagctatcataaaagaacgattgatccatacatgaataggtccaggaagttaaagagaaacaaattcagtagtactcaccaatgtaaatgagcgtaaggaagttgaagagcattccaatgtatgaaaccacccataaaatcaatataacctatatgaccaaacaaaataaggggcataagaagaaagcatacaaaggcaggtacagccatatagacgtacagttgtgtgtgtactagtgggcatggatgtgtgtgtataagagagagacctttataaaaacactcctatctctcttgatggcaatatcatggccaacagccaacaccttgttgatccatacaagagcccgatctgcagctttctcaacaaccacatctgagacctctagtttagggagtggtggaagaggcctgcaaaaatcacaactttgtgtcaaacttggatagatgatatgggcaatggaagtacaatgccagtcacagagaacaacataaaacaaccaaagtgccaaaaacagctctttctttttcggtttagcgatacaatcgcagagacactgcataaatgcatatcaattctaggcaacaatcaagtcagatggggaacacaaactcataaatgagccgataaggaatggcaagcgcggtgattgaccatgtaatgtaaatctaggaaaaaaaccttgtggattgcttgcagaagagaccatatagcacagttacaagctctagagaaaatgacacatgctagcagaattaacttatcgaactgctatcgcggcttagctttaaagtaaagcagcctctttactttgtagataagggatcggatagatgcattattggtaatgtaataaaaacgaaatatgcaggtttcaggaaaagggataattaggaaaccccgacatatgcagagttcaaacctttgaacaatctctaatcttaggagatcatcggatcacttccaattacaaactgctctggcctgaagtttagtttcttactgcaacccgtaattcaaaaatgctaagcaagttagtgtatgaaacagtttggcagtgagcttcttgaagccaaaaagatgcaacaaccaaacggttggggaaaagaaagtccacattattcagcaaaacctcatacacattacagtgaacaccgcagttacaactacagcgaatcagggccgcagggcgcggcgcgactctacatgagatcagaaacacgcggtgctgtagagccagggcaaaaacccacctgttgagcagcgaggcggacttggcccagaagaagaggatggcgacgaggaggagcagggcgttggccatgactgacgggaagctgtaccccgcgcgctcgaagaggaaccacaccgccgtggcgcccgccacggccgccgcggacacgttcctccgccgccacagcaccaagtcggcgactgcgagacgagagaacacgagtgaggagaaaaccgaacccaaattctcgacccggatcggagagcgccgggaatgcgcgtgcgtacctgcgccgccgccgaggagggcgtggagggatcggcgggaggtggtggccatcgggatcgccgcggggagggttagggtttggggccgcggccgaagcgaggagaggaagtggggtaggtgagtggagctcacgaggcggaggcgacgaggacgagatgggatctctctctgtgtcctttgctggatcaggaaatggattcggtttcggagacggcgcgagcgaatgaattccgtcgaattattttgaaatattatggtgagttattgcaattttgcgggcaagtgatgcccgatggtgttggaataactccttccatttctatacttttaagatttaaattttacaccataatattcttatttttcactgatttttgtgattcccatcatttcaataattttaaagctaatcaaatgcttggaaagagagaataagtaaatttcatttaaccacccgtattatgatctacctcttaatcacaaataataataacctataactagatgggatacattatagtactacgaatttgaacatagagcatataatacccaacgaatttctgtcgagatttatagtactatgatgtgtcctatctagtactaaattttagaacaaattgagtaaattaaaaaaacatacgattttttagcacataaacatatgtattatggtcatttcaaaaaacacaatatttatcattctaactttgaattaccataattttaagttatacaatcgcatctcgaatttatgagttatttatccatcatataaatgttacatccatggccttttaaaaatttgatatatgagtatgtcaaattggttacaatgtggttttgtggaactttatatccatagtacctatgggtcatgtgctatgtgtcaaaatccttgtagttttgtgtaattttgatcataacgagtgtatttttacaaaatttcccaaaagaaatacaagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttggctgaaattgaagatgatgtgactgaaaagttacgtgtgtataacaggtggaggtggatgtgatggaaaatgattgaagtttggatccaaacacagcccataccaactcacatagttcgtggaagggagacaataattgtgatcctctaaaatatcacagtaaatttctatttttataataaacacacaaacgaacctgaacagtaaccgtttcatattaaatgaatatacggtccttacctgagacctgttttttcagcaaaactatatagtcatggcatgtatctatatatagaagaccaagatgcacttatagaatggaatgtgtgatttcaattttgagaccccgtgttcaatatctaacgcgcttacaattttttttaaaaatgtgtttggaatccaaatatcgtcttttatctatagaagaacattttgttcagtacaccatattgagtctggtggatatcctagaaaattccaactccaactgacggtacgccagtacaccgccattggcagctagcctgaagtgatccaatttttaatttttaaatttttctgatctttttaactcttatctcatcatactttaagtgaacaaacacttatccaaaattatatcagaaatgctattacattttaaaatggagaaggtatggcacgaaaagcaccaaatccaatagctagaagccgcattcagttcaagatttgaagcaatatattcaaaactcaaaaatagcctgaactcctcaagattagctcacacgatgatgacatgactcaactgaagaatcctggccttgtaccaaaaacaagtccaggttcagagaaccgcccccttccgcggaaacggcagctgttacaaatcccacccgagcagcagccacttccaacacacacgctcacccgattccccgcttcgccgccggcgctcgcatcggtcaagtcaactcgacgcccacacacgcaccggccatggccgcggcggcggcggagcagcagcagcagggcttccgcccgctcgacgaggcgtccctggtggcctacatcaaggccacgcccgccctcgccgcgcgcctcggcggccgcctcgacgccctcaccatcaaggaggtcggcgacggcaacctcaacttcgtctacatcgtcctctccgacgccggctccctcgtcatcaagcaggtccctatctcctccacgcgccgccaccgtcgccgctgccacacatgtagtacgcatcttctgtctccgttctttcgctgacgacgctgcaatccaggcgctgccgtacatccgcttagtgggggattcatggccgatgtcgagggagcgcgcctatttcgaggcctccgcgctgcagaagcaccgcgccctctgcccggaccatgtccccgaggtctaccacttcgaccgtgccatgtcgctcatcgggatgcgctacatcgagccgccgcacatcatcctccgcaagggcctcgtcgccggcgtcgagtacccgctgctcgccgagcacatggcggattacatggccaagacgctcttcttcacttcacttctctacaactccaccactgatcacaagaaaggaggttggttgatttattacaggtttggtttgcctgtgaaaattgagaagggagaaaaatgagaaccgaattgatggcatgttgtgttatgtgaattgcagttgctcagtattgcgataatgtggagatgagcaggctcacagaacaagttgtattctcagatccatacagggtcgccaaatacaatcgctgcacatcacccttccttgataatgatgctgcagcggttcgagaggatgctgagcttaagttggagattgctgaattaaaatcaatgtaactagctctcctgattaaaccagcgtttctctttccttttcattggagatgatggacatgatttgcatatgcaggtttattgagagagcacaagcttttcttcatggagatctccacactagttccatcatggtgacaccagattctactcaagtgattgatccagaatttgctttctatggcccaatgggttacgatattggggccttcctggggaacttgattttggcatatttttcacaagatggacatgctgatcaagcaaatgatcgtaaggtgtgtatggatttattggctaataatagtaaatgaaagtgcgtaatcttacctgggtggttaagttgttttgcgtttgctaagataatggcaaccacatgtcttcctgtgtactaatttcgataggatagaagtttggaacatgatacttgtatcctatagaataactagcaattgatattgttgatatatgccgtatgtaacagagggaggagggtgctcagcagacgatgaatgtccctgagtattactccctccgtttcatattataagttgtttgatttttttcttagtcaattttttttaagtttaaccaaatctgtagaaaaatagaataacattttcaatacaaaacaaacatattatcaaaatatattctatgttaaatttaattaaactaatttgctgttgtaaatgttgctaatttttttctataaatctggtcaaacctaaagaactttgactaagaaaaaagtcaaacgacttataatatgaaatggagggagtacttaatgggaactgcagaaatgacaagttatgatatggcaaagtgcaattgcaacatctagattctagaaggtattttcatgatgtttcgccaggcataaaataagttctatgtctgtacatattttgcaggcttacaagaaatggatcttgaagacaattgaagattcatggaattttttccacaagaagtttgtcgaattatggaataaacacaaagatgggaatggggaagcatacctgccccctatatacaacagctcagagcttttgagccttgtacagaagaagtacatgacaagcctatttcatgacagtcttggatttggttcagcaaaaatgatcaggtaattaaacagtacaattatgtagagtctgtactactaagtcaatttgctgaatcttatttacgtctagactatgaagatatactagacctgccctttttaaatgtaagaagctcaaaggcacagtaagttagtccaaagtagaggtttccgatgccaattttgatgcagcacttctttttcataaatgtatatcagtatgtgctatcctaaaagagatgttccagaagaccacctttgacgattataagtatgactgaaaaccgtcataaatggttaaattggaggctattcaggatattatgttgtgagaagctaagtgtaaagaacttaaaatcacatttaaacgccattttcaaattttttatctgtattccgatgccttgtgcatgatcctcacgcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgggcaagtgattgtgcatgtacaatcgtttgatcgggactgataatgccaaccatctacacgacctttctgattgaggagacaaaagttttcatctgtttaccataagcgattatctgtgcctattacaaagcagaattggccagttatttgtgcttttagtactttggatcatgaaaagtgtgtgcactctgcaagatcgatgttttttttcaccacttggctaagccttccaccagcttccgggcttcttagtttatgagctgaataatggaagttcagcacaaacgtttgtccatggatatggacgagtgtgttattacaaataaagttgatagttttcggcaaatagattgttgttgttttatttcaaagagatgtagtcccccttttgttccttttcatcacttaggctgcgttcaagcgcaggagaaagagagaaagatagttttgttttccgcgtgcatgcttcccgaactactaaacgatgtgtttttttgcaaaaaatttctatatgaaagttgctttaaataatcatattaatccatttttgaagtttaaaataattaatactcaattaatcatgtgttaatggctcacctcgttttacgtatctcttcaatcccctccttctcaaacacacccttagacctgattacttacagcttgtacaagttatggttggaggttcagtaatttcagctgtaccttttcactcttcttttccatcttaacataaaccaggcaggaccgcaggagttgttttgttggcacaatttgcgagttggatgggg

SEQ ID NO: 72316 - DNA, 34898 bp, Oryza sativa
  unsure (1)..(34898): unsure at all n locations
atcaaaagtccgggtcttcgcataatgacaaccattagcttttttactttgccaccgtaataaaaaccctcaattaggaagccgaggctttgcgttgaagtggaaatgaagatgaaagatgcaactattccactcagaaatattccctcgttttttaatagataatgttgttgatttttaaacacatgctcggctatttattttattaaaaaaatatgcaaatgtataagatataagtcatgtttaaaacattttaaataataaaataactcgcaacaaaataaattataattatgtaatgtttttaataaaataaattatcagacatgtgataaaaaaagttaacgggctcatcaattagaaacggaggtactagtatttaaaaaagaaaagacgaactgacattagggcattaggcttaatcaagtggagtacatgcatctatatgcgccgaaagcctgggagcagaacaaagctgctttccaacgacgtttcctctgttgctgtcacactggaatatcattctacttatcaactgtgctctgctaaaattgcttctagaagagtaggaaaagttgcttaactgtactttagttgccatgctttgcataaagtttatagtatgggttatctattttgataattaaaattagcaaaatgagtactatctggtctaagaaatacgatatttttaaaaaaggaaaaatatttttagagacatgatcaaataatccgtggcaataatacaatgagctattccccttattttaaatttagctgtctaagtcaatcatgtctatattaatttgaccatcattttttaaaaatacatatagttttaaaaaatataaattatataatttcttaggtgattaaaacataaatcttactatcaccttccccaaatgtttggcgttggttagttaagttttgaacaaaccaatgtcaaataaaaaaaaagaaagagtatgatgctaaactatataagtttttacaaatcgatgatcaaatattaaaatatttgacttagagaaaaactgaaaacacaagtaatttaaaaagagtagctaaggacatccacaatgtagtaaaaaactacagcaagcattaaatattctcttgttacctagcaacaagtattgtgagagtgatgaataactactacttggttatatggctactaccgacaacaagtaataaaatgttatttgtacagtgttgatgagtattaatgaattcttttcttggaagagtcacgacagctgaggattggtgagtttttatggtgggctcatgttataccctaccatcaaacaaaaacaatgtggagttcatctcctactactagggtttaatatttcggaccgaaatttcggtcatatcggaccccccccttacgatatcattttgacagaaattttaaatatttaattttttatgaatgttagcaatatttgttcaaatttaactaaattttgtttaaaattttagaaatctcgccatatcggcatcctcttatacaaataccgaaaccgaaagattgagctctgcatgctactactgcctgttgtccggcctacattactaccgagctcggtaggaaatggcctacattatagccctaaaacaaatgggcgtaaactttttatgggctttattgggctgaatgggttgaagagaccgaggtcaaagcgccacggtggacaaaaccagcgccacgtaggacaaaatcgtgtgaaatactgccctaggaccacttgtgaccggttttagtacaatactgccctaggaccacttgtgaccggttttagtaagttaagggacccccgatatctggttttacggtttgaggatgtttttttttatagtgacaagttgagggaccttcggtgtactttttccgaagagaaatcatataggacttaattgaacagttgttcatgggctaagttagggcaaagacttgtttatggtccaagtcagcgcaaacacttgttttgaggtgctcgccagtaaaagtgacagatatgaatggcctcaccaattgctttggaccaatgtatgggcaagtccgattcaaaacaagaaggtactgtactgaagtctgtaactgtgcctctcatcgttttaaggagcatcaagaacttaattaactaataaactgataattccaagagctaacacagataaactagataaatacctatcttagttaacctcaatatagattaacagtgtctgttggatacttggacgccatcatattacaagctaaaaaacctatcctctgctgtctgctccatgcgtgaaactggggcaggaacctatgcaagatttgcatttcttccccttgctaacaaactcatgtatcatccaaccatgcccaatctcaccccaaaaaccatccataacttttcctttgatatagaaagaattagcgaaaggaggaagaaaacaagtgaccagatgatatcttctgttatgttacaccgaaatggcaaaactccgatgccatcatcacagctctgaaaacaatcgggggttcagacttcttcagtcttcagagaggtagccgagcctgtgttctgtgctgtgtgcagtgtgctagtgctgctctgattcatcagcagtccagtatgtcttgaccgccacaaggaccttctccgggttgaagggcccgtcctcatggtccaagatgcggctctcccaccgcatccgcttcgctatcgcctggaccttggtgaggacgtcgaccgtgtcgcggatgatcgccgtgccctcgggcctcaggatcctgtccatctccaagaggatgttggttatgtcacacctgcaatgttgaagaaatgtgcatcagtaagcaggctataaaccaataatgtgatttgcagttttgcacattcagattgccccactaattcagacattattgctggcatgggatcatgtgtcagcgaaagcatgagcaccggtagaaatatcagagatgcgttttcaaaattgtataaaggctagcggtttcacaggcataatgaacagtgctgtacaggccatacaagtcatggcaatgatctaaccagtaccaaaggactatgatgccagtagtcttcatttactacttgctcattttctccatcttttggtgtataattgaaattcagctaatatggagtactcagtactcacagctgtgtagcttaagctatactcgttctatctggattcacctagaaaatgatgcagaatgaacacttgaaatatcttctgagggtaaaactagaccagtagattctttaatggctaagctaaaatcaacatacttgggagggtgtccagtgtaatgcacaaccaaatggtggcagcttgaacatggttaagcagaactaagagctagcagaaatgatatgtagtataaaagtttctcacctgtcctgatagatgctaaacaaattgtcagcatgcaacaggtcgtaggttctgggatacgtcgagaaagcttcacaccagtcctggtacgtgccaatgaatcctcgctcataaattgctccaagcgtgtcccggtctgaatttacgggaacgacgttcatcacccacacagggtacttcactaaagaagcagcaaatccgcccaagtttgcgttcatgtccatgacatttctgtatctcccatcggctatgggtagggtgcgcttgtagtacgccaccctcttttcccacaacttcttgtcctcctcaaatttactcgcatctatccctggaatcatacccctcttcacccttggagggaccgcgaatgccctctgtggccatctctccaaagctccacctgcgatctcaccctggttgcttacttcaggcaatggagtaacacatgcttccatctgcttgtacctgttcacatgaaggggtaaaagaaactaattcagtggcagacatctaaatgaattatcagatagtcttgttggtgcagcgattccataccaggcagcatcaggattgtcactcttgcatatatggggtgtcttatacttcttcttgatgttggcacattcaaggtggttcttaggcttttgccagatggagagatcccccttctcaaccaccttgttccagcaaaggctcctcgcgacatcctcaatattgtcttgctcttccttgaggtcttccttagtcctctcccaccccttgtagtgtgtcttccaattgatcggaggacccgagagaatccagtatcccccgggccttagaattctgtcgacttcagctaggtatattccatctaacaaaaaattcagaacatccaactcaattagtgaacaatatttggacctaaggatagcttgaaaacttggggcaagatacattgaaaccaattcaaatgtattgaagtgctcaccaaactcatgccaaggaatcaagcagcgtgaacaatgtgccatatcaaatgacctagatgggtaaggcagccgttgctttcccatcacgccgatgatggccggcacaccccgctccagcgcgaattgcacctgagcttcatgggtgtccctcggtgcaaacgacattgcaaggatgttcctcttcagcaagtaagcaccccagctagcaacctgcaaagaagatgcaaaagcatgagcacattgccacgacatcaagaaacctgaagctagatgtttcttctgatcttctccccttaccccgcaacctgtgtcgatcgccgtcctgatcttcccgtccgtcaacgagatgagcttgccaatgtcgtcaatgtaggcgtcggcgcctcgcgggaacatggtgccgccaccggggaaccggaacctctggccgtccacctggatccagttctgcacggccttctcgatgctgagctccttgtgggggatgttgttgaaccaggcgaagtccctgctctgcggccacttgaacggcgtcctgtacttgggcggtgccgggatgaggcaccggatctcctcgtccttgccggggcaatgccgctcccggtacaccagcatcgcgcgctcgaaccgccggccgcgcttcctgtcttcgcacggcgtgtactcgctgaagttgagcgggcacgccgggaacggctgcaccgccgcctcggcgcccgtgtcgtcgaggctgagctggtggtgcgcctcgaagtcgagtgactcctgcgaggccgacccgaacgacggcacggcggaggactgccccgccgccgccgggtcgcagccaaccttggtgatcgccgagctcgccgccggcttgggcactgtggtgttctgccacgcaccgaggacgtagaaggcgacgcagagcgcgctcaccacgaggatgtaggtgagccgctgcttcttggattcttgcagctgctgagctttgggggaggcaggatactctttagccatggctgctgcaagtttcaagaactcgtcagctaggagcttaatttagctgaaatctaagctttgttggatgcagaaaaaggcatgaaattgaagaacttgagctacaattgcctgatctgagctgaaaacgaaaagctgaattgatatgcaaggctctaaagttgcctaatggatgaattggagttgtattactggagtatggtacaaatttaacactatcttaaaaattccccatggcatgtactgcagcacactaattgtggcaccaaccttagtactactagtgaagatcacatggcaataaatttcggattacaaatttgaatatggagtcaaatacaacagatcattgtaaaactctgggatctaccgagcaaaattgtttaatctgactactgacaacaccaggaaacatacacctgactgtttgtcttaaatttattaagctgcagcagttgaaacaattcaagactatgaaaacagacgaacagatagcattcaagaaagcaggaggggacgcaaaataccactaataactgtagatcatgaaatgattcttaggaagaaaaaaaaaacactatgcttcactcaagaggaggaaactacacagaagcataggctcatgcttcttgctgaaggcttatgcttcaccaaaatcagtacaagcaagatttatgcttccagctgaaggcaaagaaagttgctactaggataaagggcaaagaggctaaagaagataaatattctaggcaaaaggcaaagcggaagcagcaagatggtggcagctaagcaccacaggccacagagatccagaaaatctcacagaaatggcaggggcaacccacatgaatgccacaccacccagcggtagctagcacctccattccccaatggatccacacacaccgacaccactccaatccaagaaacaatacgagcaagaaaccaagctgaaaaaactacggacctgtagtaaagaagccagctcaggaagaaagatgaagcagagacccctcctcttctcttcctcctccagaggctgagagggagaggagaggagcagcagctctgcctatttatgcgagctcttgcactagcaatggtgaattggtgagtgagtgaggcagccactgagccagtggagtgaagtggtgtgatgccaaacacggtgtcacatgtcagcagcggcttccttcctcttcccagctaacccaacccccctttcataaataaaggagaggaggatgtgcgtgtgaaagggggccatatgccgccatggtggccatactacacccgcaggggcagaaagatcacgccgacacggggattaaaatagggtggaattgggcaggaaaagaggggggtgccccactaccaacaccaaagctagggttcttggagacctctgtttcttggctcacgtggtaatggcacattggtacagtggcagtggaccaaaatgtccagatgaccaatggaaaactaaattcagaatatctccttatttctgcatgtcacttaaaaagttataaaaaaattgaaaaaaattagtaggatagatcaatatgttatatgtcacttcacaaacatgcaaattcaaattcaacttatacaagtagaaacaaaaataacaaatttgactataaatagaacgtgtaattcatggtcaaatttgttatttttgtttcgaattatataagtcgaattttaactcgcatgtttgtgaaaagatatatcatatattgatctatcttaacaatttttttaaaaaaaattaatatttttttaaacgacatgtacaaaacgagggaatgtcctctggaggaccaatatccacttccgatggtgacccagtagtggatttcttggtttcctgcgaggaagaagagccccggtctccggtccttgcaattaggcctcttgcactgagtgtggctgtggctactggctggtattttgctgacgggttatctatgttctttaataagctaaaatgatttattagaaaataaaaactaatttataggtaaactattgtatgtgtgtcattagtgacttaaaaaccaatatgaaaaaactaatcttgaaaatatcttaaaattaacttctaaattaagtttgaaaatttaaattatagctttgactttagtttaggccaaccgatggagcctgaatgttctagcgctattgttttccgaaccgtcttggacatctgagaaactcaccttcagtggttggattatttttagctcttggggagggaaacatggaccaatcatcttccatttctgtgctaagcttcggtttcaaggtgtaacagttgggacttgggagtttgtgacgctaaaaggaaaatcacttccactatgcagaaagatcaaaattcaaaagtgctttgctttggttcttgtactttattttttttgctttttcttcgacaattcacttctcaaagcattgcaccaacagtaaaaattcttttaggtattaaaaaaaactgtctaggtcatacaaaactatagcatgactattctaacaaagagaagggggaattctagcaatcgattttacgataaaaaatgagcaattgcaaccatatattaatcatttctaccagaatagggatagttcgtctactttagaagcacaatttaaaaatatgaagaaacgaccacaagatacataaaccatacatctccaggatacagaacaacaatgccacaggaatcatcaacaaaaggaatgcaagaactagagaattggaatttaccttcagaatgcagagatcctagatcctccctgtgacctcagcaattgcgctctgccgacctcacagccaaattgtgaatttctatcattaatctgggcagctttgcccggccatgatggtggttgtttgcagtagaagcaggggggtaaaaaacccaaaaaagcgcaactttttagctattccctttttttatctcctcacaccaacttcctgacgcttttaccctttggctgccttgcaaaatctgcatgcttggagtggacaggatttggtcaatggcgaaacgacaacgcacacagtggttttttttggagagagattgtcggccctccatttgcttccctgcattttcatcgtttttcagctttttcttttgaacttaaaaatgaatcttgacagtggatggaaaaaaggatgcttgtttcatgatgcagtatgatgcaggaggtgatggagtagtgtcggtgcaatgaaatgcatggaccacaagcaacataatacggaatctctatgcctttgtcacacttgttctgcatgatgatattttgcatttgatttttttttaggataaagagatatttctgcaagtgattttactaccaaatactaacagtttctagttcatgtctccgctataccaacagtttcattacagaagattaaattaaagttaaaaactaaaaaagacgtgaacattaaggaagaacttaatatcaaataataagaaaggggtgagacttcgaacccagttcgtctaacctaccacattgtggagctagccggaagacccctgggtgtttcttaattaaagttaaaaactatgccaaacacatcagtttttttacggatttgagaggatttttaagaaataattgaaaggggtcaaggaatttacgatcatccagatatggcttgaaaatattgagaagaaaagactacttcgtactatatgatgatcttgcagctggaccaaaagcatttgtggacgatacaaatttttggatcaaaaggacaacgaaacaaacaaaaaataatagtaaaacagaagatttgcacgcaaccggaagaatctcaacaaaaggaatgacatcttcctcctttctaccgaatcccgcatcgaggtacctagggtttcatcaaatccatcaactagaccctctccctccccttcgtgcgatcgccacaaagaaaaaacgcaagcgaaattgctagtgattccagccatggatccactcacctcgaggatcaaagtagagctcgaagtcaatccgcgcaaccagggaggggggagagagagagagagagagactcgcctccgatgatctcccagttcgttgcaactcgaacgcttttgaattttggagaagcagatgagaagagaaaagctcggtgccgccattaatgggctctccgtacaaaaagaaatccaaatccgaattctccaagcccattaggcccagtagtagtaagcccacgaagcgagggcttctcgcggcttcgcttgaggcggagaggcgccgccgccggccgccgcgatgtcgctgccggcgcggctgctgctcgcgcgggggaagaccacggcggcgcagcacgtggcggcgcggcacctggaccacaccttcgagaagctcgcggcggcgcacctgccgctcgtcgcggcggcgccgctggtggacgccctgcgcgcgtcgcccgccgagcctctcgcgctcccgggcctcgcccgccgcctcccgctccgcctccaccggcggggcgcgctccacttcctccgcctcttcccgcgggtgttcgacctccgcgccccgctcccgctctccctctcgctcaccgcgcccgccgccgagctcctcgccgtcgccgcatcccccgcggcggcggctcatgccctccaccgcctcctcgcgatgtccgcctcccgctccctcccactccgcgccgtcttccgcgtctggcgcgagctcgctctccccgacgacttcgaggtctccgtcgtcgccgaccaccccaacctgttccacctcgctcccaaccccgccgagcccaacacccacatcctacacctcgtcgccgatccggcgaccgaggagttcactccggcggtcgacaagacacggccggagaaacacgccttcaagctgcagttcccgccgggattcaggctgaccaaggaataccgtaagaaggtgaaggagtggcagcagctaccatacatctcaccatacgaggtatcaattcagaagggtgtgggaagcaagagggtgtctaagatggcgaggaagaagatggagaagagggcggtggggatcgcgcacgagttcctcagcctgaccgtggagaaaatggtggaggtggagaaattcagccagttcaggaaatggttcgggatcgaggtcaatgtccgggacgtgttcttggatcacccggggatattttacctctcggcgaaggggaagcggcacacggtgttcttgcgtgaggcgtatgatcgtggcaagctcattgagccgaatgatgtgtcggaggcgaggaggaagcttgttgagctcatgctcctccgtcgtcgtgggcttgggaatgccaattcaaatgctaacatggcttcacgtgcctgtgctggtgctaaagaagacacaagtgatttccaggaggaagagatttgatagttatgtccaagaagctggaggagaaagtatgctgcggatttcatggacaatctttcgtctaccataacctgttcaacaggtgcttggactaccttgagtggtgaagatgttggtgatgcataatcatgggcagtaaatttcgcgtggcatccattaaccagatgagggatatggatttttttcagggatttatgctcattgtttggcattatctgttgatgcaatgtgctggactgagtatagttctggttgatgctcaaaactgnnnnnnnnnnnnnnnnnnnnnnnntgattggtaggtcagaattgttgttgaaatgtagcggcaattacatgtccgataatgtttttttttcccagtatggcaatttgcttctgcatgtggaatagtatcaccaagtatttaccataccagaatattttagtcggaacacatccttttatctttcactagtttattttcataatgaaatgtgcttcatatagttcatctgttcttgttagctcaagatttttcatgcccctaaaccagtcacatactttactagccttgtttacagcattgggtacacgaagatggcatttggcatttttttttcttcttcttgattttctagctttataagttcctaccaaaatttctacagaagctaacatgacaaattgtcatttaacaggtctacaattacgccagagcaaaagcagtgtgatgaaagatcttggctgaagtttgaaattgaatatcccttgtttcactggagatgatgtgaaccgaagatgattcatataaactagagaatacaaaattgcctttcttgctactgattgtgaactgcggaaggccactgggatgtgattcacaataccacgggacctatgatcaaaattgcagtcatctccgactagagaatcctgtagtttttatcgacaaactaatatgcatcagttgtcattacagcagctcttcatcatatacagtttaacttttgagtgtacttttgtcgctgtgatcatgcccttgtaacagttatcccatatgtctggatgtcttccttttccagtcagtaaagatgtacatttagtttgactgaaccagggtccacaataccgacgaaaactgatcaaaatataaaccactcaatttctcagtcatgttaaaaaaataaactgaatctttgtttgacaaaatttatctggatttcatcggtatttgtcggtttatcaacgtttttccgcttgtgggcaatttttcatccgggtatcggaattgcgaaccctgtgcagaaccaattcagtatctaacattaaatctgcccaggtgaaactaacttaaatatatcacagtgattatacacattcctacttcttctaatatcctaccttaaatcctacctagctgtatacacacacaagtcaccaacatagctgcagaattacaagggattatggatgtttaggagtgaaactcttgtctgcagcaacctcctgaacaccttctcgctgccactctccatctcaccaatgcattcttccagctcctccagtttctccaatgccggcgacgccgccttcttggccgcccgagtcacgccaagccacgcccacttgtgcgatgccgctgtctgcaccatggccggcacgtcccgcgacattgccgcgcaccggaggaggatcgcctccgacgccgccgcggtcaccgcggccgcctccgccacgatgccgaccacctcgccgtcggcgtcgttcgctgtcctcgacgccgccgccggcgtgcgccgcaccgcgtgtcgcatcgcggcggcgaggcggcacagctccctctccgtccgccggtgcgctcggagcgccgtggcgaccgtcgcgccgtcgccacgccgcgcgccggcgcgcagctccgccgcgctctgcctgagcgcgagcaccgccgactcgaacgtgccgtaggcgtcggcgagcgccaggaacccgtcgagcgcgcgctcgcatgcggcgccgccgccggcgcggtggatggccgccgcggcctgcggcagcccaagaagctcgccgagcaccgccagcacgtcctccacgagcgcgagcccgtcgcacctcccgtcgccgtcaacaccggacaacctcgccgcggcggcggaccatgacctgagcgcgctgatgccgccgtcgagccgcgccacgaccgggtgcgagtgctccctcggcaagctggccgacctcgccgccgccggcctgatcgtcaattgcattccaatcatcgagctcaccgctgctgctgccactgatcaggtcgcttcttcaatcttgatcggtcgaatgaatccttcgtgttcgtgaggaagacggcgtgcggggttttatacgggaggcggggggcaggtgatggtttgcacacacttgcacgttgaaaaatagagaaatcgttggctttttcgtgtgttggctaaggtcatttggcttgggcagctcggcttgcccactttggagttggtggtgcggtgcacggcgccacggcgagctgctgtttttctctcctccggcatgagcgcaaaactgctaatctaatctgctgctagtgcttagtactatactggtgtcagcatgagctttactgggaacagctgtgactgcctaaatggcttgaaaaaaatggcacatggataggagcagagtttacgaaaccgacggcaccgcgcttaccgccgagatacggtaattggtaaggccacgatgaattcaccaaattcaaataaattttaaaaataattagattttttttatgaattttgtacgttcctcttgggtaaaccgtaaccgtgcttatcgttggggtgccgtaacaccagccccgaaggtagggaaaaacctggataggagtacaaggtgtaggtgagctggtacatcactctagcagagtcagctccacacttatatttgaatttttttgggagtgacagatggtattatactactactactactatactccatgttgttgaattattttgtattgtatgaatttaaaaaattccatctccatgtcagctgtgcgctgcgctgcactgaacttcctcccctccggtttgtcaggtccgctgttttcttcacctgccaaaacctcccaggtttcagagaagagccacaaagcctgttcctggttggagcttatcttaagctcaactactaaaggcaaggactctttagcctaatctaatcatctccaaagattaaaagaaaccacttgattttgtctagtattctagaaaaggcagataaaatatcaatctgacccaatactggcaccatagccttggtagtggttgttcagtgcacctgttcctgtgtcatctctcggtgccaacaattgcgacggcacgagagcaagaagaagacgacgacgacatcgctgaagccactaatcctgtcctgtgatgtgcacacgcccaaagatggtggcgccaatagccaataggcgcacgcacaatgcttcgacccgtcgcgtccttctccgacgagaagcaaagccactgccatgccatgatcaggctcgaacaaggtttggttggatcgatcgctgggttggatgaatgcgatgtcaggcacggcatcgcgacaaatccaccctctgttgcggttgattcgcactgccgttaagtcaggtgactttagagtgacatatgagttctcttttctatgcacccatatatcagtgattataaaagttatttgacttaaatcaaaagatctcaatccaagtcgaagtcgataagtaagaagatttcaatccaaagctgtttttttatatagaaccctgagcttctcaaaacaggtgtaactttttagcatgttttgtcagacgataagaaatcgtttcggattgactagccaattgtagattgttcgtgcgttgtaattggaaactggaatgtaagtcaaatagacaatgtggaaactgctcgtggaaccagccattgtggactcgaatagaaatggatgtgcaaaggggttaaatatcgaagaatgtatgaaaatgaagatgtggtattggcacggcaaaattcagaattttctctgtttctttatctgagaaattacaagggattatgaatgttaagaagagaaactcttgtttgcagcagccgcctgaacaccttctcgctcccgctctccagctcgccaatgcattcctccagcctctccaatgccgccgccgtcgccgtcgccggcgacaccttcttggacgccggtacgacgtgcaggtgcagcctcgccagccagtttttggatagcggcgagctggccatcgacgacgacatgtccggcgacatcgcggcgcaccccaggaagaccgcctccgacgccgccgcgatggccgcggccgcatccgccaccgcgtcgcccacgccgtcgcccgtggtggcgtccgccgccggcgtcctcgacgccgcctggcgcatcgcccccgcgaggcggcacagctccttctccgtccgcctgcgcgcgcgcagcgccgcggcgaccgcggcgccgtcgccgcgccgggcgccgcaccgcgcccccgccacgctctccctcagcgcgagcagcgccgactcgaacgtgccgtacgcgtcggcgagcacgaggaaagcgtcgtcgcgcgccgccgccgccgcctcgccaccgtggagcgccgcgacggccaccggcagctcgaggacctcgccgagcgcggcgagcacggcctccacgagcgcgagacccgagctcccctcgccgccggagcgggacgtcgccgtccacgacatgagctcccgcacaccgccgtcgagccgcgcgagttccgggtagtggcacgggtggctcgccgtgcgggcgtgcgccgccttcctcccagggctaagtgtcaagtgcatcgctgcgtagtcgtcgtcttcgtgatcagtagtaaaacgaagcgacggcgacgaggagtttatattatacgcgacgggaggcggacgcgcgggtggttgcgagttgcggctaaaaaaaatcgcgggatttcacatgacagcgtgggtgtttttttgcagttggcacacggcgccgcgcgcgctgctgtttctggcattgtcgaccgaaaactcggcgttcgactggtggtatcgcggagttgacaccaatattcagtgggaacagctcagaagctcactgcctataggctaaattatagtataatttttcgggtgaaaaagtaggtgcggcgttgacaggattgtcacgatattaatacgatgaatcgatgataaaagtaaggcacaggtacaggtgatctatcagcgtcgctcgagtcgtcggtttttgaagttgttcgtgcggccaaaaccagaaaccacagcgtgcacaaagggtggaaggctaagcgaatcattttatccgggataaataaattaatgggaaaacgaagccatctgctgcttttctggtcggatcggaggtgacccgtgcagccctgccgccgtgctgcggatgcgggtgtcatccggggaagcgattttggccggcgagtccggtcgtttttggcaaatccaagggtcggtgacacagttgggtacacgaccactctcccatccatgatccgtctctgcatctcgcagctcatcgcgacgcgaaatcaccggcatctgctcccctattggctgtttccaccggccagcgccgaacgtttttgcacacgaagaatgtgctcgtgtgaagtaacttcccacctgacgtgatcactgacgtggttggcacgtgaatggtgaggcctacgtagccatccccaacccaaaaactatcaagtagtttctatacttgccatgtcatataaacactctgtgtagaaactatgtatacaatggatgctgtctttaacttaaattctcatcaaatcacccctcttctctctccttttattcacatatcatcttgtttttattcttggtactttatgtagagatggttttttacatgaaaaatagttttttttttatctttttacctctctctttattaactttcttgccatataggatttttacttatgtgacgatgtatttaatgctatagaaactagataacatggaggattaaggatggcctaaccgcctaagggaccaagtccctctaaggtcctattcgtttccactgctagcagtggatgaaattttggattttcgtggcacgcttttcaaactgttaaacgttgtgtttcgtgcgaaaaatttctatatgaaagttgttataaaatatcagattaatccatttttcaagtttgtaataattaaaactcaattaatcacatgttattaccacatcgttttacgtgaaatacttaattttcatattctaacattacgttaaaagatcttgatcgtattactttagcctataaacaatcatgttctaattgtgaaaataaattctctaacctggattagaagccattggaagccgatatttgttttccttttattcctctgttccttcttcttattcacctgcacgggaacggtttgcgctacgaagcatcccagcattacgcaggatgaaaacacaagcagcgcacccattatgtaatcctttcgagaactgatgtaaatcatatttatcttagaatcttcagctctcccaataatacaaataccgacaatttgagaatatgtaattatataaccctgaaaatgaacaaaaagctacaatttgggaatcctagcattttcatattttcactagctagctacttcttaaaatctcgacctccccaaacaggggcatagtatcttcaagtagtacaagctcatgacaaagaggatgaacattgcaaggttgcagactagcagttgcggtactagaaaagttcaagaatctcaaatcaatttatgaaatcaaactacacacataatgttcttgactccccacgtacttacggaataattatattggcatacacaaaaaccggagctaatcagagtagatacacccatagacaagccatcagacccaacaatttttttgtccatgaaacagccagctaatgctaatagacaaggggttctgatggaagatacagctaggccacatctagaagcacttcctgtggacgatagctgggccagattcttcatactcagcccttgagatccacatctgcacaaaaaaaaggaaagaaacatatgtcaagaaccttctcgaacaatctagaaagtgtatcaagaattaactgttggatgattttgcattacctgctggaaggtgctcagagatgcaaggattgatcctccaatccagacactgtacttcctctctggcggagcgacaaccttgatcttcatgctgcttggcgcgagcgcggtgatctccttgctcatgcggtccgcgatgccagggaacatggtggatccaccactgagaacaatgttaccatacaggtcctttctgatatcaacatcgcacttcatgatggagttgtatgtcgtctcgtggatgcctggagcttccatgccgatgagagaaggctggaacatgacctctgggcatctgaagcgctccgcgccaatggtgatcacctgtccatcgggcagctcatagctcttctcaactgatgagctgctctttgcagtctcaagctcctgctcgtagtcaagagcgacgtatgcaagcttttccttgatgtcacggacaatttcccgctcggcagaggtggtgaatgagtaacccctctcagtcaggatcttcatgagggaatcagtcagatccctaccagcaagatcaagacggagaatggcatgcggaagggcataaccttcgtagattgggactgtgtgactgacaccatctccagaatccaagacaatacctattgacaaaaaatatcaagaaacaaattacgagagaacataatgacagtttttgtgtattgtaacatctgtaaaacaaggcagtaacttaaattttatttggtttgaatggttcaatttaagtttactttagacaatatattgctaattttggttgtgagcatagcatttgatttgaacatcacccggtttgttcctgctctattgagattccagagtagcaaaacagaatttacaaatgaaaatgcttattctttgttcacttaccagtagtacgtccactagcatagagggaaagcacggcttgaatagcgacatacatggctggaacgctgaatgtctcaaacataatttgtgtcatcttctccctgttggccttagggttaagtggagcctccgtaagaagaattggatgctcttctggtgctacacgaagctcattgtagaatgtgtggtgccaaattttctccatgtcatcccagttgcttacaattccatgctcaatggggtatttcaaggttaggatacccctcttggattgggcctcatcaccgacataagcatctttttgtcccatcccaaccataacgcctgtatgtcgcggacggccaacaatactcgggaaaacagcacggggagcatcatctccagcaaacccagcctatgaaaaatgaaaacagttaatacttgatgagcttctcaattgtaacaataattaccatcaggtagaaattttgttcaacaatgcgatgccaagtcatcactttttattaccttgaccattccggttccattgtcacagacaaggggctgaatgtcctctgcgtcagccatttattttaactgatctgcataacacaaaataaatcattcaaaacagtgtttacaaagactatagattaatacagaaaaatgtaacttgaactaaacattcatcctacaaaaacacgagtcttcatcaaacatgaatgacaaaatacatgtctttaagatatcacattcaaagctattaattgactaactagtattgcaaattgtgaaagagggaggattattcaaacaaaaaggaaggcgcagataggaagaagtataacactttagttgtatataggaaactcccaaaatgaatggtccatgatgcgtaaattataactagatcaagtgacttgtagttaagaaattcaaatcaatcaaccgaggctggtctgaatcaccaaccctccaaaggaatggtgctctctcctaagagcatacaatgcaatgtgtatttgaatcgatttagaccaatcttcagggagaaaaaagggacatgcttcagtggatgaaatgaatgcaacatgatctgctcatatcctggattgtctgattggttgatctgaagcattattttttttctgatcagacagccgtcatcaagatgtgaagcatcttagaatagtggtccataagcatacattttttagtacaaaatttaaactccatgatttctgaaactaggcagttttcagttaagcaacttgcttctttaattcagattttagaagccatgtcacataatgaaatcgttggtatgcttgtgtttttgtgtgaactatgaaatgttttgttgaggagaaaaaagtctcaaaagaaagtcgatcggtacagtactgaaaactgtttttttcccacgccaacaagaaagcaaccgtggaaatgaaaagaaaggaatcagctttttcacaagtccccacctacggaatgaccaatcaagacagtttcttgagtaccgcaaacaaaccggctatgagcatgcgaaagtctgtcagttgatctacaattcagagaaactatacccccaacttcacgccttaggccttgtttagttcgcgaaaagaaaattttttggtgtcacatccgacgtttaaccggatgtcggaaggggttttcggacacgaataaaaaaaagtaatttcatagctcgcctagaaactgagagacgaatttattaagcctaattaatccatcattagcacatgtgggttactgtagcacttatggctaatcatgaactaattaggctcaaaagattggtctcacgatttccatgcaaactgtgcaattagtttttttaatctatatttaatgctccattcatgtgtctaaagattccatgtgacatttttgggaaaaaattttgggaactacaagaccttagcacaacacaacataaacacgaagagatctactgcaagactactcgtcacctcagcacaaacaagatcggatacatcctcaactaaagcaatggatcggatcagcattcaccaagaacaacaaacaaccagtatacgcgcatccctgaactcctacagtccaacggatccaacatttgacaacacacaagcaaaagcaaccagccacacctacttcagcaactcagttcagtagttcacccatctaacagaactagaacacatctccgattgcaagaaacatcaagcattaaaacagaaagcaagcagggtccgggagggcctggacatggagaggcagttgctcacctaaagaagaggagagaaccgaaccggggatggcggcggcagcaagaaggaggcgaatggcgtgggagggaggagggggagggcgagatataggagaggtggtggcaatggcgatggtggtgggaaattgggggaatgagatgtaaagaggcgccggcctcactggaaagttgagagcttgaggctgtctctgcgctgcggccgtgccaacgcggaataatttgctgcactgcacacctgggccaacctagaaaatctgccttttttatgtttactcctacgtgcacatcactatgtacccaatactttcttattctattaaaaaatgatattttatcattttgcttttagaaataaatagtagtggttgatttttttttttacagggatggaatggaaccctcactgctatggaaggtggacatacacactagtagagagacgaatctaaaacgaaaatatcgaggagactgatatgttaaagtcataactaacttaagcatattgaaactatgtttgtcgatctactgtcaatcaaatttctaattcacactaccaaaacataatgttaataaaagaatgtgcaacatgcattttttttattttgttgtacacgcaattaatagttcggttagctataaccaaatgcagctagtatagctttttcagccaacaatccctcgctcatttattgttataatgcatcactatatcatgccaacatagggtacttggtagaacatgtttggctggctagagctgaggccgaagccccaacaagctctaaaaatagacatatcactaaacgtaaactcaaggaatcaaattagttgatgtaggcatggaggatccctaatagagagtagtttaagacaagaaataacttagaaaggagagctttaagaggcaacggcaacacaacagccgttaccgatgcctaaactagaatggttcttttcaacgcagctcttgattaaacacacatactaaactgatatacaatgtaaccttgtggacgcgtagcgatttctctttttctttttcccatgcgtgtgtcaaggaggagggccatcgatcaactgtttgtacaaactttgcaatctattcttcgtactaccatcgcatcttccttttttccccttgttgtcgtatgccttgagctgtcgctgctttcggttgctacctggagtatgaaggccctgtttagatgtgactaaaacttttaaatccctatcacatcggatgtttgaaaattaattataaatattaaacgtagactattaataaaacccatccataatcttggactaatttgcgagacgaatctaatgagcctaattaatccataattagcctatgtgatgctatagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccgaagtttggcacagctctagctctagctccatcatttctggagttggagctcaacaaaacagtttcagctccaccaaaactataagtgaagctgggtaagctctctcataaaatgaattagagttgtagagttgggtttaggcagctctataactttattatagacccaactcttaaagtgaaatttaggagttggagctgtaccaaatatgcccgaagaaaaaacgagcacatgaatcaagctacgaaagatgaggtggtggacggtggcgctggggccctgcaaaggaataggcaaaacaaaagcgattgggtggggggcaccacggcagccttttcataactttattattgcttcgttttacagctgctttacggctacgcctcccttccatccggccaacgtttttctccctccgtcttgaaacataaagaattttagataaatgttacccatatagtattacgaatctctatgatattaggtgtatttagttcttctggtgtaaagtttttaaagtatacggacacacatttaaagtattaaacatagactaataacaaaacaaattacagattctgcttgtaaactgtgagacaaatttattaagcataattaattactgtagcatcacattgtcaaatcatggcgtaattaggctcaaaagattcgtctcgcaatttacatgcaaactgcacaattggtttttttcgtccacatttaatgtttcatgcatgtgtccaaacatttgatgtgatgtttttggccaattttttttaggaatctaaacaaggcctttggctttctatccaaattcatagtattatgatgtgtcacattcatctaaattcttttatattttggggaaggagggagtagtacccagggttcacaattccgatgaaaatcggtcgaattccgtgaaattttgaggtttcgacgaggctcgaaagtagaagccgtatgagatttcgatgagtttcatctaaattcaaatttaaattgataaaaaaataaaaatcaaataaaatcttataaatagtatgatattcatagaacttattgggttataaatttttgaaaaaaaaattgatgtatcgtgtgtatttactgaaatttacgagaggaaagtaaagaataatgaactaaaaaatgaaaacaatttcagtttacctctttttctttttctagttaccggttgaaatttcaaagatttcgctcggaatttcaccaaagctggctggttttcgcaagcttatcgataaactcaatgaatttgtattcaaaatttggtttatgaaatttgttcaaaatctaccggctttccaccggatttcacgaaaaccgccattccgccagagcccgaaacggaataccatctcggaatcgtaaaccctggtagtaccaccacactttgctccttggagggcgtcaatcctctcatctttctgcatcctttacattttaatctttttttaaaaattttgttttacaaatatgttcttgcaaaaacttattttagaaacagactttttttctcgacgcttgcaatgaccctagtgtcggaatttcaacgtcttggtgccaatgatgctagcacctacacgctcgctccctgtaaaagttaagtcactgatataaagggggtcggcgaccatgacactggtgctgagaaaagggtatgtttctaaaataaatttttatagatgtgaattcgtaaaataagttttttaaaaggtgctaaacataaaaagaaaatccagtcgtccttcatcagtacaggagtacagcaatcatttttttttcctgaagtctgatttcacgctgcgatcacttgggttggttgttgacagtggctttgctcatggtgcgtcttttttatgtggcttttgctcacctcacctgattcacttgctgaagtttgtatgagctttgctcacttggtacgtttgctgtaagtctgaatggtgagatcagcaatgagattgacaccgtcgaatcaacgaatttttttatttaaatatttacataaataattttctatttgaaaaatttataaaactagtcacccattgtcgtctggagctgccaaaggacaattttgccgacttggtagacggccgttagctctcccataacggccggccatcaaggacgccaaaattgtctaggccggccccttgccgccctctagaacggtggtttcttaccgtgcggggttgcctactgcaaaagggtgacgagggtgtcttggcattcttacggtcggcctccttgccgttctttgggagggcaattttctacagtgcggggtgccgccggattaaaaggtagtaggggtggaattttttcaggcagcccacttgtcgccctttgagagggctattttctactgtctgaggggctgcatgcaataatgtcaggccgccctcgccgccttttcgcaggcggcccctgttcagtaaaaaaatcaccctcctagaggacaacaagggggccgcctgcaaattttcagcgtccttggtggccggccattatggaagggctaatgactgtctgccacgtcgacaaaatggccctttgggagtgcgatgaggtattaattttgtaaattttttaattagaaaattattatttaaatattttaataaaaaaattccgaatcaaccgtcatgcaccaccaaccagcagcccaatgcaccgaccgcccatctctaagcccatttgaccgcgatggcgtggcccatgccggccagcccaaatttcgccatttctaagcccatttgacctcagaattcggaagccttcgggccaatggccatgctaactcgattggtacatcatgtttctggtcaggaataagttcatctgtggtcccttaacttgtcaacgaatccgattattgtccctcaaccggaaaaccagatacaacgggtccctcaactatcaaaaccagtacagattaggtccctcggcggtttggatggtggttttgactgacgtgacacctacgtggctaatttgactcggtcttcatatggtgtggcagtgacatggcgcttacgtgacaattcgatttggaaaataataaaaaatataggccccacatgccagtttcatgaaaaaataatttaaaaatggtggggccgatgtgggccccacatatcattctcaccactcctcttcttcctcctctatcccaaactcccctgtattcatctctttccccctcttctctgtcctctcttctccatgcatgcatgaggagacgcggcgcgcggcggccaggcaaggaggggcggcacgcagcggctgggcgaggaggaatgcggcctgcggcggctgggcgaggggggggggggtgcagccgggcaaggagagaggcggggcgcggcggccgggaatgagggatgcggggcgcggcaaccgggcgaggaaggatgcggcgcgcgggacgcagcgccgccaccatggcgcgatggatatccgacgaaccgtgcgctcctcctcctcccccggggcatcagtttcgtcacatccttcgagacagtcgcggtgacgtctcactgcattgcctgtcgtatcgtcttctctctagcctctcttcggtccaaccagcgacgagaaatgcagagactccagtggtgctgtgaggattttcgcggcttccggtctccagcgaggtcgccctggccgcagcggtgcgtgccctccacccttagtttcgttttatacccaccacagcggtgcgccacctccctcctcgcccggccgccgcgcgccgcctctcctcacgcacgcatggagaacagatgagagaggagaggggtagagagatgaataaaggggagttgaggagagaggaggaagaagaggagtggtgagaatgatatgtggggcctacgtggaccctaccattttaaaattattttttcatgaaactgacatttgaggcccacattttttttattattttccaaatcaatttgccacataagtgccacgtcactgccacgtcatatgaagaccgagtcaaattagccacgtaggcgccatgtcagcaaaaaccgccatccaaaccgccgagggacctaatctgcgccggttttgacagttgagggacatgttgtatctggctttctggttaagggacgaaaatcggattcgttgataagttaagggacctcggatgaacttattccttctggtcatcacgatgatcgccggagaaaagctccagcgccaccgttgaggcttcttggtggaccccacatcgccgttgccggggaaggcagcggttgcgagacccataacttccttcaccacctgtcacgaactcgccacaaccactgaacgtctcgcctagtgaagattggttcaggaattagagatatgatcatcagatttagggatttgtggagaaaaaggcaagagaagcataggagtacgaaggggatttgatctctattcttccttccccaccaacacaaccgcgtttaatttgcaggtacagcaatccaagacagtagtacattgggtctgtttaggggagctttagattctgagaagcagctatttgatagtcagcttttaagaatctggaaaagctctgaaacccagcttctccagcttctggcttcttatttcatttttcagaatctgtaactacagattctcagaagctgtgaactgtttggggcagcttctagcagaagcagcttttgagaaaagctgcagctgggagaagctcccccaaacagggccattgtcccacctcgtggatcacacaaattgggtgcttcaatccactgcatctcaactatactcccatcagagcccaaattttcagaaatacaaaaaaaaaaaaactaagaaccgtagctagctattgtatttctctgtgtacataggagatagtactgaactactgatgtatgatgcgcaagatcacaaacttttacaacacccaaggatggtgccccatactatcaattacttaggatatggaggccaccacaaaatttcattgagatcaagctggctggcaacaattttggagataaagggtgccatgcagtgtttccaacatgtgcaagtgtacaagataaagagagaaatgaatagggtggcgcacgatcttgctagaatagcaatgagtactaggtctaatgctgagtggaggctatgcgccccagcacaaatcctagacttgttaaaccaagattgtaaccatttattcagtcattaataaagctctctctttaatgtaaaaaaaatacttaggatatggaggccaccacaaaactcaaaatcttggcatcacctccaattcctccatactgctgaatttctgtggaaaaaatgaagtttgtgtccggtacatcatactctctacatctatttttgatagtcatattttcaaatctgaaaaatttacttttgatagacatatttcaatccaaccatctattctcttaatgaatttctcggatttaatagtgactctctattcttcttcacaagattagctacatgggtatcgagaaatgtaaatattaatgaatcgcttgtttacgaggaataactagtagtttgtttaaatgaatgataagtagaattacttatccttggtcattgtgccaaaataaaatattactatcaaaagtagttggagttggagggagtatgttacagtgaaaacagctcatcattttcaggggataaaaaaaaagtaaagtgtattggcggtccttaaatttgtagggttgtgtcatataggtccctaaactcttaaaatacatatttaggtctcagaacttgtcaaagtgtatcatctatatctcaaattgacacatcccctctaggatcctacgtggcactgatgtggcaatgccacatggacgtgacgtgtcctttactttttttttcttcttttctttttctttttcgttttcttcttattcttttttttcctttttttctgcacaggtcacgagaagaaagggaaaaaagagaaggaaaaatgaaaataattaaatgggtcccatttatcaatcaaaataatgccatatcatatccgtgtggcatgccacatcaacgccacgtaggattctaaaggggttttggcgatttgggatctagatgacacactatgacaagttctaagacttggatatttattttgagagtttagggatctagatgacatacccctacaagtttaagaaccgcccgtacactttacttaaaaaaaactcaaacttcacttcagactaaagaaaaacccaacttactaccaataatgcatcgccattgatacaaactgcataaattcctacccccaaaggcccatccaatcattggacctggaagcaaagcatcagcaatgggatttcgctgcttctgctcgaaagctcaagctcagctcatcctactgctaccactactagtgctagcttcagcctcgtcatctgcagccaagcagcagcctcacaccgcctgcagcaacacttcaccagcgacggggcagccgccatgctccggccaccgtggtcaagtccctgcgccgccaatcttgggacttcttggtcgtaggcgagcaatcagagctccgcctccgccgcagccacatccaataacgtcgcctacctctccattcccggggcggccagtcccgccaccgccgccatcgccgtgcttgtagccgtcgactctgtcgttgcaggttcagtagaattcagaactttcaatcagcaagaaagttccatggatttactctgtttcagcgcacttcagctctcggcccctcccaggctctcaccattgtaaagtacgttctgctcgtttctgtcaagactcaagaccctttttttctgctcatttcgaacgagttagaagatcacaaggtttgtagtggatctttcgttttttttctatttttccggaagatgttttgtaattttaatctttactcctgagtacagtctgattatcaatcataatgcgtttgtccacaaatgttctattctggtcgagattcattcatgaaattactgttcaagattatggaaaaatatgtccaccgatacacagctggaagaatgaaagttggcgttttgatttttacagtgtacgaaactactgcactttgcaaacccagaagaacaaagaagttgaaagaaagagggaaaataaattacaagttctttaagaccaccaatgaaatctttgatctaacaacataattctctcctacatttaacaccaactacaactatgaaaaagctcgctacttcacaaagggccttctaggacaaaaccaagaagacggcgcccaatttgtccctccattctgaagccttcttgggtaagggatcacttccaatgcacgcacctgatcccaaatcgaacacaaatgcccaatgctgtaatccgtgatcctcatgttcattgttgccgcggcgcgccaagtagtagacatgattccccttgatcgtaggaaactccattgcagagaatgcgaaacattcgccatgccccaagaggagagcatgatcaccaagcctcgtccctctcttttccgggaatacgcaaggagcgcatcatttgtattaagaagaaataaagtttatgtaaaatgcaggctcgtcactctctcatggatctcaaaatgttacgggcagtacatcaaaatttgtccacttgccatcttggaattcacatgtcacattggattgcgaatttctcataccaccgcaaaactcaaaatctcgaccgtatctccaattcctccataccgtacgtcgaatttctagagacacgtctttgtctggtactacacgtgttacaatgattagctcggcattccagtttatttgttgataaaaagaaaactcaaatttcagttcaggcttcagaaaaaacccaactcctcaccaatgcataggctgcataaattcctgagacaatgagagcttcggcatttgtcaggaatgggatttcactgctgctttgtggctcaagctcttgtgatcttgctagtgctagtttcagactcggcaactgctggcaagcagcaagtgcagcaacctcgtcctcatgccgcctccagcaacacttcgccggcgccgccggagcggcctccgtgctccggccaccgctgtcaagtcccgccggcgccgccgcggttggggcttgtctacagcgaccgtagggcgcctccatgcgcacgccgatgtccgcctacgccgattccgaatccgaatccgaaccaccacccggcgtacgcatacctatgggctatggccacatccgctgcgtcgtccattcccgattagccttgcgccgcaaccgccgccgccgccgccgccacagctcttgtagtcgccgttgcaggtttggccgggccaaatccaggatcttcaatcagcaaggaagctagctgacggatttgctgctggttcatgcatgcacttcggttattgctaattgctaaattttgctttcagctgattttttttcagactttttggggcttttttttttgttttagaaaaaacgtgttctaagatcaccaggtgtgccgtgtgcaatccctcaaaaatgttttctttagacggacaacggtggcaactttggtgtcattgccttcttagaggaggcgttgtgtaggaagtctttttccccgtctttgacttcttctctttgtctggtcgtagacggttcttggttgtcgtcattaggttatcgtaagaggcgagtggatcttcttctctctcgtcctctccctatctccaacccctctacacgaggataactagaaacccgtcaatgatcttctaagcggagtcggtgcgcgggaggcgtttgtgaccccctttagacctagctgcgttgggtcacgtgagactagctgccaacgtgcggcgatggtgtgttgtcttttgtttttcctatttacgatcttccagtgttgtaatcatgtaatttttatatgttatatcagtacgaaacttcacactatcttgtgtgggtcgtttgaaaaaaaaatcacctcacttgtatcaacatctcaggtgattaaaattgtgcatcgatccttgtttagatgggagggactaatttcactaaaatacaagcctatatagtagtgactaaaatttatgtgagagggattaaaattagtatggacttatatttctgtgagagggattagtcctcccatccaaacaaggccttaggaatagggcacatagggataggtgacaattagcatatactccaatgtataatcacatcttaactattttctgcatccttcaactgagccttccaaacctattgaagtggcctacttgggggcaaatcctcatttcagtttgatttttacccagcctttgccttgacaaacacacatgtctcaaatagtgtgcatcacataattgtactttaatcctctcttcactgtactaatttcatatagtacataagcaccaactaaactaaaccatcgatttaaggactctctaggaatctatttaggaaaacataagattatgagaaccaacgggttggtagccagattttaagaatctgaaacaaaaaatctgacttctagttcatataactaacaacttctttgaatctgaataaaaagggcctctttgatgcgcaggatagaaaaaacacaggaattaaagtagtaggtttctcaaatcctacaggaatcagcaaacacaagaaaggcaatataagtcctttgatagtgttctgtgaaaaacaaaggaaagttcacaaagaggtcacaccgcttgctaaatgtgaagaatagaaatacaatcctatgaaaaattttctttctttcctatgaatcaaagggacatataggaaaaaatccataggaatttaaatcctatgaaaatccttcgccaatcctataaatcaaagggagccttagattctcagagaacctgcagttgtcagaaactacacgaaacagaccttaagaacaaagtacaagtcagcttgtatctgcccaaaggatggtcgaatcccatattgtggaatactccctccttcccaaattaatcatcatatcgtgaaacctaaatttttttaaattgatcatcatataaccgcatgagaatgtggcatgctaaagagtgtaattgtgcattattttttaatcgactacaattaatgtttaattgatgcgatttaaattatccctgatcttggtacataaatattataggacaattaatttgggatggagggaatacttaggatttgaactttcagtccaccacaaactcaaaatgttggccttacctccaactccaattcctccgctctgcagaatttcagaagaaaaaaaaatgtcttcatccggcacttcacatgtcaacagtgtcggtaggtgattaaaaaaaaacttagatttcacttcagaaaatccaacttatcaattatgcataaagccccatatgccatccaggcattggactcggaatcatccctctgcagccagagatgggattcagctgccgcttggtgatggctcgagctctgctcctgctcatcctagcagcgctagcttcggcctcgtcaatggctgccaagaagcaggggcgacagcctcgcggctgcggcggccacacctcgacgtcgccgacgccggagctggagctgccgccgtgctccggccaccgcggtcaagccccagcgccagtgttggggcttcttggccggaggggatcacctggagctccgcctccgccgcggtcacacccgccggtatcatacgtacgcccacagccgcgcccgtggccaccgccaccgccgcatccgcagcctccattcccgatcagcccggttgcgccgccgccgccaccaccgccgccaccgtgcttgtagtcgccgtcgttgcaggttcagtcggattcaggattttcagtcaggaaggaagctcaaatgatttgctaatctgtttcgggcacttcggaactattgtaaattctttgccttttgggggttcaagattttcttttgctcatttcaaacttgttcgttctagatcagctgatgtgtcatgtactcgtgtgcaatctctcaaaaatgttcatgtactcaggtgcaatctctgtcctcctataaatatgaaattggcacatcctgtgccggttcgttcagaaaaaaaatagtgcaatctctagaaaatgttttgctcgtctcacttggtcaccgcagtatttcgaatctgaaaagctggaattcttatttttaaattggaagctcgaattcttatactctaggatatgcaaattgcaaagaactcactggtagagtatcattcatgtgcgcgctcgaatcgcaagacaaacaaattcaggtcaaccatcgaaagtttcagtataaattcagtttgagttcagcagccgccgtgcgcctgcagtcacaaactgttcttggctacgatgaggctgttcgagctcatcgccggagttgccatcctggctgctctgtccaccaccacctcaaacgcgccatcgccggtcgccgtggcggcggggagggcggtgagggcgccgccgtcgccgaagccggcgccgcccataaggccgctcttccgggcgccaccaccacctccggcgaggtcagttcaaccaacgtgttcgtcagcgccgccaccacctccggcgaagtcagaactagctatgagttcgccgcctctcgccggcgaagtcggttcaaccaacgcctcagagctaccatgaatccgtgatctttcgtttactttgcaactcaacttttttttttcatgagaaactttgtaattttaatctttggtagtctggttatcaaatcatgttgtccgagatgtttgtcatgttgagatctttatcaacgaaattacagatccagatcacataaaaaccgtccaccaatccacagctcgaagaaaaagttggcgttatgattttgtaaaaagaatctagaacatacaagaccgaagaacagaagtttggcgttctgattttgcatgcataaaaacgaaaaaaaacatattaacagatcaaaaagaaactagggaagggtgaaagattaaacgaaatgttcttaagactactaga

SEQ ID NO: 72317 - DNA, 2787 bp, Oryza sativa
taatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctaaagtttaagtccctaaatccaaataccacccgacaaagcccacctcacgggcacccctaaacagaagtaaataatttcaaaatagtccctcaagccgtcgccttcctcacgctctctcccactccgccactgctccagctccccctccccgcaaggcggcggagatcccaaggtcgtcgggggatggcggcggtggcggctacatctccggcgctaaccctcgctgtcgcggccgcggtgatagcggccgcgtgcctcctcctctgcgcggaggcggtgtggctggacttgccgcagtcggggaccaagtgcgtgtccgaggagatccagtccaacgtggtggtgctcgccgactacgccctcatgtacgagtcccacccctcctcccaccccaccatcgccgtcaaggtaattccccacatttctagccgtctctcgcttcggattctatgatgcagtgaggcgcttccgttgttttggaatttttggatgggctccgatctaggttgcggtagttttggacgaattaggtcaactccatggtagaacgatagatggatgattattccgtgaaacggagcggtggcgtgaagtttttggttttgctgcgggtttagagatgcttagcgcacattatattgtgctggaataatcgttgaactggttgagtccttgagtgcgagggattatgtgttattggtgcagctgtgctcgcgaaagacagaaaaagtttgtgcctagtgttcaccggattgcgatgggagctgaaacttggaatcatatattctttgtgtaacctgctaggaatttgttgttctctaggatctagtgctctgtctagattccatttgcatcgcagggaatgatgatgatagtattctagaataactggctgatgcgtcaagtggattggtatgattcgcattgatgacgcagggtatgcttacatatgatccacaaaccgcgtcgattccttctgtctaaattgcggtggtttctgtccaggatgtcactcgtaacagaatacaaggtgattcatcttacagaatcacacacttgcttttctagcgacttctgtaagaaactccatgggttgtgggaagtaaaaggtgatcaataagaatcgcatcgatgcgaaataatgagaagacaacgatgcaatcatgttattatgtgatgtgaaattaatactgtaatgacttggtaccatatgtgtatctttttattcggaatcatttgcatgaatatgacagtgtgttgccatgctttttgcgttcgaacaaacaaggggacatactgaataaatagactaacgtgtagacatatggttgataaattgcgagtgccgtataagattgaataagtagatagacttaggtgagataatggtaatgtcatataaattattaattgtagaacccacttaagtgagcaggtgatatctcaactctttcttaatattattttccttgaaaatgcacaagaggaacttcatgggactaaaatttccaattccaaggcaaatggatggagtagattgtaagggttactagggttaaatggccatgcaactcgctatatactagtttctttagtctttactccaatttatgtccactgattgtaattttatttatgtgaagtataatattaattcattaggagatctattttcatccatgaattagtactggctagattagacactaagcatactatttgtgtttgctccattttgaacagtccttatgttttttcttttcgcagctttcgaatcaagaatatggttttttttttttactgtgcgagtatcaatctgcagttactgcagtccactaatggagtaaacgatgctactccaatcctctcaagcttagcatttcttcgagaagcttagcaatttgcttttacatgatttgttgaatgaattactatctacttgtgctgttatagttctgcaaatgcttatgcttggtgcaggttacatcaccatatgggaacaccttacatcacaatgaaaatgctacggttggtcagttcgcattcacaacttcagaagcaggaaactagaagcaggaaactatcttgcatgcttctggatagatagcgcagagaaagggtcaggaatatctattaatcttgattggaagattggaattgcagcaaaggattgggatgttatcgctaagaaggaaaaaattgaggtaggagtaggcttagccaaactgctgacggtccatatgaccatatttcactgatgtccagtttaattcactgcttctctaattgctgcaatctaattccttttgtagggtgtagaactagagcttagaaaacttgaagtggcagtacaatccatccatcagaacatgatatatctcaaagcaaggtaagttttacttccacatgattgacttactgtggttgaggctttaaaacgaatattggtggtactaatagagggttcagtagaatgccaatggaacttggaagtggtaatgaaacaatcatattgtcttcaattctcagcactagataccattcaaccacaaagagcgagcattgtttacaaaacttacgatctgcag

SEQ ID NO: 72318 - DNA, 8392 bp, Oryza sativa
cgaacccgacggcgccgacggcgtggtgcggcggcgaccctagcggcggctagaggcggctggagcaatgaaaaaaaggcggcggcgggtgggagcacggtgcgggagcgatggggagcttgggagaggccgacggaaaaaaggaaaatgaggaggaggatgtgggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatggacgctcctccccaaccaacatagcacctagccgctacgagtccatggccacgccgccatcctctcactgcgtgtctacgctacattgtagtcgtcatggttacatcgtggtgcccccctctctatttaagatagttgccgggttacagagtccgactctaactccacccctaacacctattacaactccaagtccaactataaccaaataggactagtatattcgacacctattctaacagagctggcgtggtcaaggtggggcgagcgcgtcagagcggcgacgtcatcggcgtgcctgcctccgcgtctccccgagctagaggacaaggtagaggcaaggaggaaaaaggaaaagcgcgaggcgaaaaagcgaggcctccctctgcttgactgcttctggtggcgcgactggcaaggcggactgaccggcgtcgacgccttggacactagcggcggggccatggtgagacgccggctgtgacggtaaaggcaggcatggtagcttggcgcctggcggcgagcggaggcaaggcggcggccagagcggtgactcgcacgcgagggcgggaaacggcgaggttgcatggctggccgcgctggcgagcgagcgaggttgcctactctcctgcatgtgcgcggcagcacgtgatgagcagccgtggcgagtcgggctcgggcagaccggagcttcggcacgcgagcgtaagggagagggatctgctgggctgtcctgcttagataaagaagggagaaagcggcctgattggagaaataggcatgagagggatttatttggatgaagtttgagggtgatttgatttggatttgaaattggacgttacggagatttgattcaagtttgatatttgaatgtagggactactcaaggaagggaaacacggtgggactcaaatattttggagttgtaagattacttgaaacgaggattggatttgaatagttgaaaggatttactgatagacttaaggagggaggttcaaacaagcaaatttaaactccgagtctatttcgaaacggtaattttgaggagtcaattttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagttttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagtttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtccacgcggctatggtgatcaggaggagcatcttgaattggagtaagctggatcttatcggggccggatcgtccggcagggtgtacaaagcggtggctgagtaagtccgcttgcgatttaccgtttgccttgctcatgaactgttcgatgcaatgcttcattgtacttcgtgtctggttgtgtgttctattctttcagcagaccggcaatttcggatgagttatctctgtatttctcaatgcttcttcgtattattgccttgtcagggatgggtttgtatttgctgtcaaagaggcttcgttgattggtcccgaaagctatacgaagcaaaccgcatgtcagctaaagcaggtagttttatctcttatcaattaattaggtgaaaaattatcttgtaagtgtttaattaagcaaattgcaatttttgtcaggggtaaaatttcagagtattgatgttctccaattctaaatgattccaagtataagctaattcagtattagtaacaacatttcaggaaatcttgcttcttagtcggttggagcacaagaacatagtgcagtattttggtgccaaaatggtatgccagttctcatatgctagttgaacaagtgtcttcattatgttgctgatcgcctctgcaaactgttgcctcccaaacaccttcattttaggttatttttcttcggtttgagcttactatccctgtttggatttgcttgcagggagaaaccgtgctatgtattttccttgaatttgtgagtgaaggttctttggtatctgtatatgagaagcaacagctggaggaatcaactatatcatctttatacaagacagatcctcaatggattggcttatctgcatcatcataatgtaatgcataggtgataacacattatctccacaaaaaaattcttgctgctggcccggtcatttgaaaatgtacttgttatagtagtgatcaagttaagtacagatgtacaactctcgatcaaatgactaaatgagtgaagtacttctttgtcatattatggtaaatctgcactgtccttcccttttcaatgcagagatattaagtgtgcaaatattttggttgataaaaatggagcagtgaaggttggagattttggactggcaaaggaggttacttcatttttggtttcagtgtccttttttcccctggtttgactgacagattatgaaatgattttgtttgatattgacgatgtgaattctcaacccttttaattgatgtaatgccagataaaagtctggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctccacgccgttataaaaggccctcatccgcaacgcgggtctctttccggcgtcgccttgtcactcgctcgccaccacccctcggcgccacggcgagcagcgcaccgggtccaggtcaaaagcgcacgcacccacatcgcacggccgcgtcgccgtcgtcgcgcgtgagccccccgtgcctagtcaaaccccaccacgagcagaatcccccaatcttctcgcgatccgctcgctctgctgctgcgccgcgggagcgcgggggaggaggaggaggaagagggaggggcactggccatggcggcgcgccagcggccgcaggcgcagctcgcgcggatcaacgccatgaggcactcctacaccgccgcgggggacgatggctccggggacgacgtgtgtggggagctcgacgacggcgggggcgagtacgcgtcgcagaccagcttccgcatccgcggggggcgcggggccgcggaggtcaccgccatcttccgcaagctggggctctccgggcccgaggacttcaccatcccgcccgcggtctacgccgccgccatgtcccacctctccagctccgcccgccgccgcgcgtcgctcgaggtggcttccccgccggagcttctagaagcttctccagccgaagccgcggttccga

SEQ ID NO: 72319 - DNA, 14995 bp, Oryza sativa
tttttattgtttatttaataaattatgtatcaaatatactatttgtaagtatcctataaaatgaagtattttgtattggcatcatatgtttattttattcattttctcttttattaatgtgatgaactaaaaataattaattttttaaacagattattcttgaaatatacatagttctacttacaaaccgaactcgatagtcaagctcgccccaagcctatctaaaagctggaaggtttcgtaggctcggctcgagcttaagcataggcaagcgagctcggcgccacgcctcggctcgttgacagccaatacacctaatactagcttgaaactgatcaagatgcctgtgtatatgaatgcatgtgcagttttgtaccacagtagcagttactctcagtcaaccttgcagtgttgaccaatgaccaccagcctattacacacaagtacacagtgcctttggcctcccacgtagcccgacagagcttgtgatgatcaccatcattacctgttgatttgctcagctcccactccctggcacgtgcctcgtgcgagagagccacagctacagctagggcctccacggcctgcagctagctagctagccactggctcgagcattctctgctttcctttaatatgagtgagaaacacgcgtgaatgacgctccggccccgtgccatcagcagtactcgcgcgctagcttgagactatatgcatgctacatgcaatgcttgcacgcttccgatctgcctaccttttgatctttttttgttctgaacgcttgcacatggtcaaagtgtacatgtacgctcagctggtacgacgtagctcccctattgatatcgttgctcatcacaagcaatgaaccaatcgtggctctccatgtatgtaaaaaaaaacaacgagaaaaaaacactatggcatttggcaggtgaacacgcgcgaggacaggcagagttacgttgcagatgcagacatatggaccggtgcggcggtgcgtcgttgccggctggtacgtacgtttgccttgcccgcgggaatgggcaaccgggcgcagcgcagcgctgcctccgcggattcgcaggggcgcgcggttccgtggcgcgcgcgcgcgcgtccgcgtccgcgtccgggaacgcgagagtgtgcctgcctcgcctgcgcggcgcgcggcgacacagcgggcagcgactggcattgtcggcgtggccggaggggtcggggcgcgcgcgcgcagcagcagcagcagcagcgccggggtgggccgggtcccgaggcacggcaccggccggacacgcccgttcggccgtggcatcacgcgttgcaggggcggtccagtggagagcagcagataccgtactgtgcgagataatagctgtatgtaaggtatgcctgcctgactgactgactgccttcaatccttgtaggtggtgtgacattatgtaatggactattccatttcttctcctggctagctagcttctcctcaaggaagaaaacatgcgtatgtccatcagtccatatgtctacacatgccatggaaccaacgctttctgatattagttgattagtattacaaaaacaatatccatttgaatatgttgttttcagaatttaccggtgttctttcctgcatgatgagcgcctcaaaatgtacgtagtgtagtaatattccccgtatttcgtggccaaaaagagagtgaacaaaaaatctggtgaatctggtgtgtttagttcgtgggtgtcacatcggatgtttgactgatgatggaaggggttttcgaacacaaataaaaaataactcgcctggaaactgcgagatgaatttattaagcctaattaatctatcattagtacatatgagttactgtaacactttatggctaatcatagactaattaagctccaaagatttgtctcgtgatttccatgcaaactgtgcaattagttctttttatctatatttaatgctccatgcaagtgtccaaaaatttgatgtgatgtttttggaagagattagctatataactgtcgataactttttagatgaaaaactttcaaatgtaactccactataattacaacgtagttacattgtaactagactatagttacaatgtaactggcacaaaaacgctcagaatcacgttgttgcttagttggttaacatatgcaccgtgagatcgtgggttcgatccatgccccaagtgtggatgtgatttttttaatctgcttgtgcgcatcttgatgtcgaataaggcctaactcgcaaaagaagtggacatcaatatgttagagaaaaaaaatgatgaatcaccgtccttggacggaaaatttagtccgttggacttggaggcgtccctcgcttacggagtcaacaaaaagttgatctcgagatccgcgtgcaacgtcgggtttgaacggccacgattaagtgacgatcacacgcgaccgaccggccctggcccacgcccacgcccacgcatggcgaattggcgatgcttgatgcttgcaagttggtgaaggattctcccggtcgtacgggctcttttcgcggtgaacgcgcgcgagaaaaagaaaagcaacggtttaactcttgtgcatggcttgtggaccatagaccacagtacacgtggccaacggctgttctactgctccagcatgtactagtgggtactactcctgccagtttcacatgcatgtgagcccctggtttcacccagaattttatcgagcagacggtgcacacttgttgggtgaactgatgatgaccagttgagtgtccattgtccatcaacttggacataaacatacacatgctgcataagagacaaaaaaaaggtgatcagtaaccagcttaccgagaagcgagtggttgcagcttgcaggttctgactctatcaacttgctaaaatgggggatcgattgaacgattccccttgtcatttcctgttccacgcacgcgcgcgctcgatcgttcgggccagctgctgcttgtatggttcaagccacatagccatgcaaagccaaagcaaacctctctgaactctgggtagatgtctccattatttttgctagctaggttaacagtggcgcataatgcagcaacgggacaaggaggtagccggaggagcccaagagagagacagagagggagagagttgagacagggtcatgtgcggcggtcagaagagccttggccgccgggtagactggcgctgtggcagcagcagcagctgcgcggcgcggccggtcaattatggacaaatgatggcgccggtgattaggtgaggggacgacgcgggccacaacgccagtacgtacgtcttcggcttcgatcagtcgcttcccgccgcgcgacgacgccacacggcgccagttaccagttggccgtttgggctttaggaaattaataattttatgattaagtttatttcgggcggtgtactgcttcctcttctcgcggccatcggctgctgaagtgctgatcatgtataagccccggcccgttgagaagttatgatgtacattgaatattctgggacggaaggaaaccgtggtactaaactcctcatcagtgacggaaattaaaccagcactactaaactttcggcactaccatccttaagcgtgtatataggaagacgcaaaacccctacttacttttcttcaagtccaatatacacattttgaaataattgatagaagttatcacggagcgaagatatgatatgaactcatggcgagtttacacggtgagtgcgcaaacttgtgacatgttcgcaatgttagcgcggagagaagtgaactatcgaagttagtggctcgtatatacgagaacttgaaattatcataaattttgacaatttgatcttttccgaaaactaattttacaaatgaaccgcggccaaaacttattttagaaataatcttttttatcagcaccaaatcgtatggcgctgaacgtaatgtcttaaataagttttggccgcgatttatttataaaattagtttttggaaagggtcaaattgtcaaaatttgtgtgaaattatccgaatcgaagttaacagcggttagtcacctacatcgatctagatagtcggtgttgatctacatgtgcatactgactacaactttgtctcgttggttaattagctatccatccgcaatggataagcaaaagagtacgcaaggaggaaagaagtgagaggggttattaatttcgtctgcatccggtccagctagggcaatctaagcatggagatcggccaggtgaaacaagcagccggagtacagcccgtccaccgctgctcaccggtgcccaaagggagacgggcgtttgcgatgaagcggcacatgtacgcaggattggggacccacgcccacgcttgcgacatcgtcgtgcgcaaccggttcggcgtgtggtcacggcgaaaccaaaagtacatcaggaagacgcggtatttcaagttcgtcgcgctcggttcggcgatgtccaaggtgagacggaagctccaggagtggatcaagcagcacggcttgttaacgtgggctcagtactcggcgcggcgggaggagttggaggccgctgaggcaggtctgcagaagcttttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctaggcgaatccggaagccgcataggccgtcgcagggcccatccaaactccatcacgcccacccttgcctggatgcgtcggctagaggaaagctacactacaagcccagccgttgcccacgctggcttgtggtaagtacgaggaattcttccagggtttcccgcgaaccggtccttaattgccatgggcgcgaccatcaaaatcatgcacccacagcccaccatttaatatattttaattaagcaacaccagaacggtggcactaatccaatcattaacataaggacctacagtctatacattaatatgatttcccccattgtgtgctagttgaactaatcatggctaagcactccctagtccaatctctagtcatgttatatcccaagctaacaaaggaacatggtacaaaatagcatggctatgacagtaggtaaacattccacagtaatattataaaacaatgcagtatttgaagaaaaacaatagagcatttgcaatataggatcaacatgttcaagtgacaagcatgacttgccttgctctgctgctggaggaatctcgacgactatctcaaagtacaccggagcgtcgggagagccggaatctaagcgacatacaaagcaaataatacaaacaggctataagactactgaaacagagaacaaaaccatttttaatggattctacacatttttcttgatttactgagacttgaatggacttaaacggagctcggatgaattagttatgatttttagaagattctctgtgtttttactagtaaagaaaagtccttaatgaattattgcgcaataaagcatcccagggctgacgtcataggggggcaggcggcgccgacatgcgggccccacgggtcagcggctcgagagagagagggaggggcgccggcacgtgggccctactggcagtggcacaaggcgggagggggtgcggctggcaggcgggccctaccggtcgcggctccaaaaaggggggggtggcgagacgccggccgggcccgacatcaagccggccggcctgccatggcaagggcggcggagcgcgcgcgtcgccagcgacggcaaccggcggcggaagacggcggcgcgaaggcggcggcccgacccggctcggcgctaggagggagaggaaggggaaaagaggaggaggggcgcctcaccatgagttggccggcgcgggggaagacgacggcgaacggcgacggcgacgaccggggaaatgacggtgaacggcggacgggctccgagacaccctaagagagaaaaagagacaggttagagggagagagggagtccatggcgagcgggaaccgtggccgacggcggcagctatggaaaggctcaccggcgcacggcggacggcggcctccgatggcggaattcgacggaggaggggtggacgaggtggagctcggccacgcgaacccgacggcggcgacggcgtggtgcggcggcgaccctagcggcggctagaggcggctggagcaatgaaaaaaaggcggcggcgggtgggagcacggtgcgggagcgatggggagcttgggagaggccgacggaaaaaaggaaaatgaggaggaggatgtggggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatgggcgctcctccccaaccaacatagcacctagccgctacgagtccatggccacgccgccatcctctccctgcgtgtctacgctacattgtagtcgtcatggttacatcgtggtgcccccctctctatttaagagagttgccgggttacagagtccaactctaactccacccctaacacctattacaactccaagtccaactgtaaccaaataggactagtatattcgacacctattctaacaaactccaccttggaaaatatacgtcacctagaagtagtagaatcaccatgccgatccacctgtcctccagacttggattatttccttttgcagcttcaccacgagccgcccgacgagcgtacaccagactcaccgtcttcaagagactccactctccctgtaatttcttcctcttgactccacctgcaacagcgctccgccttctcatctatcatcacggtcgtcttgccaagcgaaattggattccttcctagttgtcccatcatagactccccaaagaccatgttcacctccacattccgtctttgatttgattcaatctaatccatggccagataaccaatgtcatcactaaatagacaaatcaaactcaccaggcatgaagaactgaaccctttcttccttgttgtcttatgaaccaagctaacaaatccaacatccacgcttcttgcatctgtagactgaatccatgatattttgagaaaattcaccgtcgcctcgaatcacttgaagaattaccatgatagccttcgctcttactccttcagtgacgcagatttccatatatcccatcatgccgacccgcatattctggatatatcctgtactgccaaacagtatcgttgaccccatcaacgatatttgacccgatgttgcccgggacttctcgcatagcaaaccacccgtttgccactgccgcaccggtccaaccaatctgctacacggccggtctacctccgtcctgcttctggttcggtccggccaacactctagcatactccttgttcctgagccatacctcgccaccttgctgagcaacctcgtcaccgtgagactatctctacagagttcccaaggagccttctcgccaagtcactattttgcgccgatttctgccaattttgtgccatatcgaatcttcccaagccagcttttaccattgcccaagaaagtcccagtcaaactgaattccaaacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaagggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagcttgataaagcagattggtctagcacacacaataggatattttgtgaactatgcgtacaacaaattgaagacggcaataggcctatcgggataatgactactagatggtaccagatcatagccaaaaagtacttccaaaagacagggctaagacacaataagacacaactgaagaaccggtgggatgtgctgaaatccatgtacagcttttggcttggtctccttaacgacacagggcttggatgggatcatgcaaaaggaacagttgctgcacctgttgagtactggaaaaaagtcaccaaggtaataattcatgtctcatgtacatgattttcatgaaaatgttttaagtgcttgcaataattgaagatttgatgttttatttttagggacattctgaatggaagaagctacaacatggaccaccagaatgtttagaattgctggatgaaatgtttggtactattgctgttgatggttcttctgcttgtgcacctggagaaaatgctggaggggatgatgcaagtggtgatgtacaggaccttggcgacacaccagtagattgctcattgggtaaaaaaccagtgaagcgagggtcttccagcaccgccactagtccatacaagaaggttaagaaccccatggttaggataatgaggaatattcaaaccactatggataccaattgtgatattgccaacaaggtgatgcaaggtgaatttaggttcaattccattaaggaggtgatggatttggtggtggattgcggggcagcagaaggaagtgcggagcatttcatggctacaagattatttgtgaaagctgaacatcgtgatatgttcaagactcttaccaccaaggtgggaaggctctcttggttgcagagatggtgcgagaaggaagggcagcagtagaaaattgctaattatttatatgcatgaactagttatctctgtttttactttgtcagacaatatgtattagcaagattgctacttatttattcgcatgaacttatgtactgcctggccatgtaatatggcgccttaattttgattggatgaactactgtttagtgatccatcaacatggtctttctgtgactattgaggtgatatcatttgttgcattgtttgtagatgggcatgtatggaagtgatgatgacgatgaggaggaggatgaaactattattgttgctagcagacaactagatatgatgagaaaatttggaccggtgttgacatcatttggtatgttctacgctgaaaattatttgaacaagtccaagtatagaaaagctaatttagcgggtcatgcttgggttatgagaaaccttgaagttccacaagattgttatgacatgtttagaatgagtaggccactctttgagaggttacataatttgttggtctcatcttatggtctgaagtcaactagtaagatggattcagttgaagctttagaaatgtttttgtggaccattggggctccacaatcatttgttcaagttaagaaccgatttgagaggtcaaaaggaaaaattagtagaaaattcaatgaagtgttgcagagtatctatctcctttcaaaagatcttgtcaaacctagagacccaaacttcacaactattcacccaagactacttgatgatcggtttgagccccatttcaacaattgcataggtgcaatagatgggacacatataccagtagttgtgcccgcatcaaaggtggttcaacatgtgggtagaaataaatatccgacgcaaaatggcttggccatttgtgactttgacatgaggtttgcattaattgttgcggggtggcctggatcggcacatgatatgagggtgttcaatgatgctttgcgcaaatatgccgctatcttccctcatccaccacctggtaacttctcttatccgtttaatagtctcgtcgaactagcatcaattataaaataatgtctcatggtttatgtttatgctaacagggaaattttaccttgttgactcgggctatccaaatcgactaggatatctatctccatataaagggaccaaataccatttaccggaatttcgagagggtccacgtcctagtggcaagaaggaggtgttcaaccacttacattcatcgcttcgtaatgtgattgagcgctcttttggtgttttaaaaatgaaatggagaattctattggacttaccaagttatccaatgctcaagcaaacaaaaataatacatgcttgcatggcgctgcataattttattcgagatagcaaattgagtgatgaagagtttgatctgtgtgataatgatgaaaactacatgccgatgccttcatctcaagggaatgccagtcacatgggagacgaagatggggacgcaaatgccttccgtgatagtattgctgatgctttatttgctaggagataataatttggttttaagtctaatatatatgtggaagaaatattcatgaatgtataattataaatatttgtcaaatttttatttatctacatcaaatttatatctattgtataaagtcaccgaatgatgacaaaggcatccaaaaaaatagttgagggcattctagactttagccatgcaaactcaataatccaggtttccaataatctagagaaagaaacagctcacagcttattttcctctagcttataataatccagcttataataatctgactcaataagttggattataataatcctaagctgaaaaaaacagggccttaatctcagcactgtaacatgcagcttgtgcatatgcctgacgaccaccatgcactagccatcctatattttaatgcatgcagccatgatgattgtatacaaatcgtgccgcatgaaagtgtcttctccgatccatgcgatttgctcgactccgttcaagttgtacgcaaagaacagcatccgtactgttcgtctgtacctccgcacgcaccgcagtcgcagccctcgtgttcaccgtctacgaccccgtcatcatcggccatgcacgtccgccgcgccgcgccacgctcgccggcttcgcccttccatcactagcctccctgccgccgcggatccgcgatcgccgcgtgcgtcgggcgcgccgtccatggcgctacccctccgatctctccgaacgccttcggccacgcccggcctcgtcttccagtcacgctccgccatcgtcggtctgatcgcgagtgaggtcgtcgcctccgcaacgtcctcgttgtcgccatcgatctcatcgccatgactgacgatctcctgtcgatgcacgatcctcacctcgtgtttcctcctccacatgtcttctcgatccaatactgaaaccttctgctcgatgggt

SEQ ID NO: 72320 - DNA, 618 bp, Oryza sativa
cttcatcatatacctcctctgataccaatgctatgaaacttccagcttttttcttgattttcagatagcacaacacacctgtggttgcatgtacatgtaactatacaccatgtagtcccaccttgcataaaatagttttctaggtttaatatacttgatacagggaggtggaatctagtttcttgtatgcataaaatagttttctaggtttaatatactaatccttttattttcccttttcaatgcaacaggctctgtccagagcaataacagaagatgagcttatctacatcagagcacagtacaacttgctagaaccaagtagtacagatggtcgactatgcattgaaaacttcaggatggtaagtgatcttatgctatcaagtcctcgcaatcatgattttgagtaggttgttcacgttctttttttttttgagcatttgaattactgccattgtgacactgagactcaattactcttttcaacatttttactctccaggctcttttacaaaactctacagatgctatgaaggaatccagagcccttgatatcttgaatgcggtatgaaatgcccactcagctcacaatttcattatcttcatataaacatatgc

SEQ ID NO: 72321 - DNA, 5924 bp, Oryza sativa
ttcctgcagccctatgaataatcggtaaaaagataaaagtatcaactttttttttgcagaaacaacaaaaagtagtaccatctagttcgttttgttcatagtctatttatgggcttggttgtcaagtttcatacagggcacatttatataaattttgttttcgttgcagtatccgaggctttccctcattcccggtaaccttgagatgcttaacacaactgggctcgcggcagatcacaagaaaaataaggagcccatgctgactatctggtaaggccaattttgttttttttcacaaaatcggcttctgagcccagcttacatcaaaatttgttgggcctctgtttgatttgctatcatggctgtgaactcaattcaataagccgaaccacaaaccaaatggttgactaatttctggattgccaattgttctggtttggttgagtttgggcacaaataaacaagccctgtatctctacgtaaaattagacatgtttggcttttaaaaattattttacaagttattcaccttaaacttgctctactagatagtaaaaataaaaatagattgcacacaaaagctagctttggaccctctcatgtatttccatgcctacagcctactagtcgcagtccttgacctgcatctaattattcctaacatcaaaattacttgaaatttgcgtgaccaatccattcaaaaacaaattgaatgacctaattattggtctacagttggacttttattttccaacccacatgagtaccgactactgaactctttgaagagacatttgacattgtccatttgtacctgccatttgagtttgttagacgctctcgtcatcaaaataaggctgtgtttagttcacatcaaaattaaaagtttagttgaaattggaacgatgtgacggaaaagttggaagtttgtgtgtatagaaaagttttgatgtgatggaaaagttgaaagtttaaagaattattttggaactaaagatacagtgcaaatgcaaagcacgaagaaagctcatgcagaagatctggtcttacaaatttgaaaaagccaaatggaggacggatgcgagccgtgtgcttccgtaagttttgactttataataaatgaaatgacatagtatcataatatcaaaacgaccaaatcgtctacaaataaactctatagtatatatgcagtctgaatgcaacgaacaaattaagaaagaaaccccctaaaagaaaatcgatccacatgaactgagtgcaaagcataagcatcaagcaacgtgatggcctgcatggttgatatggaaagcgtcttttgcggcctctaccgacattcagaagtcagcactaacctcccctgcatcctttgcttggatgcatgagacctaacctaattgacctgcagcattaacaatcaagtaggagtactaatcaactcctagttggaacgtagaagacctgcttggatgcttgcaggctagctagctgcagttagcagaggcgctacgctttgtcttagaattttccctttaaacaatttagattttcatacaaattctgaaaatttgatgctataaaatgcagaaaataaattagaaataagaagctaaaagaacctattttttttaactctcaccaacaagttactttatcggttgtttcttctaatcttaatattttccaaacagagctttcatctaaaaaaacaatttatctaaaaaaacagagctttcatcttcgactgttcagcgccatttgcacactaaattatcctcagagcaggtacaatagcagactattaatcagctataaacatattttaataagataaaagatgagaaaaaaaaacagcgggctatagatctatagccagctacagtacggactccaagacgcagagtgtatatgataggtatgaccatatattaacagtatagtaagcaactattgtataaattggctattacattgactatagataatttgaagctagtagttggctatactattagagcaggtacaatagctggctataagctagctataaacatattttaaaaagataaaggaagagagaagagcagcgggctacatatttgtagccaattacagcacggactccaagacgtaatgtgtgtatgacatgtatgaacagataatttggagctagtagttagctaatactattaaacttgctcttacaactaagaacaatgcacgcagtccatgcaaattatgtattcaatcgagacagaaggtgtctatctccaagcgtcaacgctgctgtacgccgtagaagacggtgtgcaacctttaatttgccagcgaaagcttgccatcttgaccccaattaattaactatccagcgattcctccccagctcgtccccatcaacatccagatcagctcgtcaaccgagaaaacaaagaagaactgcaaaccaagcggtagtactagtaccagtttccagaagtacagggcattggcataccgtgtctgaatggcattcaccaaaatctcggaggtcggtagttgatacagcaggacaatgaagagataaataaatacagggagttcttatcctatgctatgcaatgtaaactcccacaactacggaagaagatgcgttcatatactctcaaattacttgttatttatagtatttgtttagtatatatggtttttagtcaaacaattgtaccttcaacaattgatttttgagaaatttatatagtttaacattgtaagatttacattttcttatatttatcactgaacatacttccataatatataatatactccatttaaactttaactacccatctttaaaaaaaacaataaatacttgaaaatatgttatattaccgaagtacatggtgtcataaatataacccaataaatttcatccatcatactataatagtaacttattaggagtaatttgtggtcaaagtgagaccgccgtagtgaatatctatagttattcgagaatagagggggtaattcgcatgttaatatactatatgagtttttgcttgtgttcgtgaaaaaaaaaagagtttttgcttagctgtttggaggggcattgagcatacagctctagctccttgttagtctagtggcggtcggttcgatgctagtctttttatggttgtgtgcgaaggcgattttagtgtgtggtgaggacgtttttttgttctcttttccttggctatattgttttagggttatagtcaatttactcatgctttgttcactgaaacttcgcactatctaggtgccactgttaaaaaaaatatgattgtaaaatatagaattatttaatttttaataaaaaaaaagattgacgtcagtaatacacaaggctaaatccggtggatcttaattttttaaaaggggaagtacagaaggagagagtgacactccaaatctcaaaagcccttttgtttgtgaaaaggaaaaacctggatgcatcatgctcctgcatgactggatgtaggctgtgcagcatcaccaaacttctgggcgcggcaaccaaccaaaccaaccaacaaacaacaaacaaccatgcgtgcgcgggctatctggggtaggccccgcgccgaggatatcaagccaaccccgcacagcaccgcccggcacggacgcgtagccccgtccatccgtgtcgcgcgaccttcacctgatcctgcctccctccccctccccacccatccagaagaaaaaactgacccgagatatgagatatgcatgatcccgttcccagtttctaggcttgctccacgaaacgtgccgccttccctcattcgcatgtgcatctccccaaactttgctaactcttttctcgacggtccatgcatcgaaatccttcgtgaagcaccatccaccatcatgataaccactaatattacgtgtatgtaagagtgtttgtaacaaaaatttagtgagattagaaatatatatatatcattaatttccgtctggtagagcatgtgttaaggtacacgtatataaggtgtgagtccggtgttatgtgtgtagtgatgtgtatgcgtggtgggaaagagaacacaataattaaggatttgtcacttatagtctatgacacatgattaaatatctctggaaactaacgtgcgccggtgcgcgtacgcggtacacctttgcccgtgacttagcgatgaagtcgggccagctagagactgcgtgtgacatgtgcaccgaggcggccggcagcggagagctagctaagctaagctagatcgacgaatcgtacccgagaaaagccggctcgggcgcgcggccaccaccgccgctagctatctcctcgcgcgcgcgaggggacgggacgacgaatcgattccatctcccgtgcgcgcgcggcggccgtcccgtttcgtcggctggtgaatggccgtgcttttcccatgtggatgtgggattttttttgcggtggcgcgcgcgcgcggtccaggtgatgaggagattattcgacggcgcgcgcgtgctgcggcgtacgacgtacgcacgtgtgtgggactgtacgtgaggtggtccagtgcaacgatattgcgcgtgtagcgtgtgcgtgacagcgtgaggggacgtggaatggaacggatcgtcctactgtgactcctgcggctgatcgatctgtgcgatgggtgactgcgacgtcggcgatgtttcggtgccgatgacgatggagttagctgggaatggtcgagcatggtttgacttgaccccacaagtctactgcaacgcaaagtatcaataggaggtgttatgaaacgactgataaataaacgataaaaaataatagatcaatcacagtagacacaagatttaatgtgaaaaactctctcaaagcaggagagaaaaaagacaggtgcaaaccggcaaaatatttttactatatcggagtgaagttataatgccgaacggtggcttacagaaagtatatatatgaaggtaaaaccctccgctttgctccgtccgaagttggccttatcgatcgtgcgtacgtgagacaagcgtctaatgctagctagctcagctgtgggcaattgtgatgatcaggtcaaaccagttaattaaaagcctgtatatgtagcatttttcaactacccttttgttcttgttggtgaatctatagcaaggattagtttcactgcaacttgtacacatgctggttggtagctcagttctattactggtacagacagtcagacgtactagacatcatgcatgtcacgtatggatgagatttctctccgcaggagcaagccacgccagtatgagtatggcagcatgcaatgtctccactaaccttgcccccctgccacaactccaaccccatcgatcgatggccgatcgatttatcactctctcagaaaccactcctgctactccacgacagacttgatgcatgggtcctatcaattctgttgaatagtaaaagaaggggatcacactgtataatattaaacatctctgtaccaattttgttatatatttgtcgacaaatgttctcctaaatatttgatagatgtaattacagtacaatcgtagtgtaattacactgtaaattgtatgtaaactttcatatgattttaaactgttagatttgtttcaagatttatgcaagtgaacaagaaaaaagtcactgtgcgtatatatgtgagagaattcatttccacaacctccgcttcaccgaaatagcatgttacggagagatttttgaaagttatttgtaagttacatgtaattagcagtgtaattacatcacgattgtactataattatatctgttaaatttttaggagaaaatttatcgataaatgtataggtgatctattagagtttcattcatatatactttaacatcttcggcaatttaaatgtgagcttgacgtttgaaa

SEQ ID NO: 72322 - DNA, 3305 bp, Oryza sativa
cccagaatgaggctagctagaagcagctatgactatgatacgatcgagagacgcttcaagactgacgtgaagcgaccggtcgaaagcgaagagaagaaagaatccccttcaattcgttcgcggtggcacgcgcgccggccacacgttcgccgagccgcacaaacgagagatcgagcatcctgcgtgcggtcatgtggcgcgccttctctgcgccctgcaaaagatctcgcgcgcgcgcggagagaatgatccaggtaataacacgacgccgacgtgcggcggcggcgcggtctggaggcggtgtcagcgcgcgtcacgtcgcgccgccgtgcgcgcgcgggcagccgtggtgaaatcgctggctaccccaagacctgttcacttggatgataaaaaaaaaacttaccaaattttagcaatgttaccaaaattttaacatgatttcttatatagttaccaaaatttgacagcaaactaaatgtagctacttttttgataattttaccaaaacttggtaaggttaaaaatgacataaaaataaacaagcccttatttgaacgacgaatttgtctgggcaccatgcgcagattgtattacgtagtaaacctctgtttcatatcacgggttgtttgactctttttacagttaaacttgtttaagttcaaccaaatttatagaaaaatacaataatattttcatcacaaaacaaatatattatcaaaatatattcaatgttagatttaataaaactaattttctattttatatgttgctaaatttttctacaaatatagttaaacttaaccaaattcaactaggaaaaataaataaaatggcttataatatgaaatagatagagtatttacgtgcgactttgtcactttgggtagataaagatataaaaacttaatgaaatatggctctctggtgagaaagcgcagtacttaatacacgcagagaccaaatcgaattatgcatccactataaatataggagtttatccatgtttgaatttggggcaatgtcatccacgatcaggataattaagaagacacggaggagaaaatttccggtcaaccagcgaggcctatagcacgcttacgtttaagcccatcatagttcacctcatatgtgaccaccacaagaatatccttcatttccgtaatccacccaaaccgcctcgaaacagaacgcaaaaacaaacccgaccttgaactcgaaacaggcgcacatcccacacctacccatttgaccgtaccccaaaacaaccgagaaattagcgggagagatcgacaagcaagaaacacacccgaaactaacccaaacacgaacaaaacccccaaagctaataaaaaaagccatcctaatctgaatcacaccgcccctagccgcaaccccaacaaaaaaaaaaaatccccttatccccaaacgcgactcgcgcgcgcgcggtcgcggcttggctaacgacgcgcgacgcgacgcggccacgacgtggtttggtttggtggttacggcgcaacggccggttcagaccgcgagatcggctataaaatccagcgcgcccgcgtcgcaacgaggagacccctcctcccctcggcaacgtaacacaagagaagaagagatcgccatgtccaacgtgcccacctccctccgcgactcctccctcaccgtcttccgcctcgccatctccagctccgacccctggcccttctccctttaaccccatcaaacgcttcttcctcttccaagaagatcacaagcttcttcgtgttcttgttcttcttcggatcactcggttggtttcttggtttcttggtttcttggattgttgcgagatgcacgggaagcatcagcatcagcagcagcagcagcagcagggggggatggtggtggtggcgccgaaggggtgcgtgacggtgagggtgggggcggagggggaggagcagcggcggttcgccgtgccgctcgcccacctcaagcacccgctcttcggggcgctgctcgaggaggccgagcgcgagtacggcttcgcgcagcggggcgccatcgccatcccctgccgcgtcgaccgcttcgtccacgtcgagcacctcatcgtccaggacctccacggcgccgccgcctcccacctcctcgacctcgactcctcctcccaccaccacacccagatccacctccacctcccccgcttcgccggttgcttccgcgcctgatccttccatcatctccatggatgcatcgccatggcggtggagcggagctcccagattgctcttcttcttcttcttcagggttggttggtcgattaattacttagtttagctagttttttggtttccttttgcttcgtcctccgatctctcggtttgttggggatggatttcgattgggtttgtggacgggagaatcggaggacggattcgatgctgatgacgacgaaaaattgagatcgatctcaaaagtgtaaagacagagtaattcttcttagtagctttattctagttttattttttttatcttttttctttgcttgtacatccacttcttgaaacacatcaataatacagtatactttgatcgatatccttgttaatttaatttgtactttgtttttttttgctaattgtttagcctttgacaacgcaattgccacatcacaaacgcgtggattcaacgttatttataatgataaaatacgtcttttttcggcaagcatgttgctttcgcttgaagccttcgacggacggaattaatttcgaaggaaaacttcacacgaaatgagttataattagtagtattattaatctttgcgtgcgtttggtaagaaataatctttgtgtgcgtttgggaaagaaatagtcgctgtactggtttaaagacagaattagaaacgtaagtactttcgttaaagttgtactacaattacaaactcaaattggcgcttcatatattccgttccccacctttctcattactcattagcttattcctaagtaatattctatattccgtgtaatattctttttgaaggaaggcaaaagcttacttttatagtgatattgatagagaagtaaaaacctctctctgataatctctcttgagttttacggtccccgccttgatttaagtttgcaaatattcgggggctaggagtatttacatggtctgcattaaaacaacactgaccaaaaaaaaagttgtgggaactactctccgaaggggataatctgtgaaatttgagggaactactctccaaaggggataatctgtgagttttacggccactgcctttgtggttgttttaa

SEQ ID NO: 72323 - DNA, 566 bp, Oryza sativa
tatttccagtcacatgggccaatactcctggttaatcgtagccatatggcctgaaaaaagaaagttgttgcagtaatgtcatcgagactcgtgttctcaaaatctttcatatattgtgtttgatttgtagtcttgtgttcaatgacaaatatttctaaaattccatggtgtccctaaatacttcactatgtcactcctgatgctcctgaattttgttcgatcttctatatgcatcacccctccctttgttactttaccatcagttcacatccatcattaatttcttaaaacatttgcgttatcccttacctttatcaagataagatccaaattaagagtcaaataactgatcatgctgcattgatgcatggtgcggctgaaacaaacccactaactcgtatagaaaatcattcataccactttctcctgattgacttcaaaaataaaatatcctggtgctattgaggtacacttgttcaataaggattaaattaaagcatgcgcaaccgcataatcttgctatgccctaaacaaatcagtgttgggggaagctgaatacgggtgtc

SEQ ID NO: 72324 - DNA, 615 bp, Oryza sativa
tgcaaagagatatgcaacagttttcaaaagttaacagattcgaatgggatgaatacatagtagtaaaaaagaattgacaagagttgcataccataattgttgcaaatttctgcatctactaatgaatttgatgagctcaggacctcgcacagtagcataactcagattaagtgatgtgaggccttcacatacacaatagaatgctggcagataatctggaacagcatcccaagccccagaaagccttctcaagcttttacaacctccaaacgccgcctccagctttgcaaacagatcggaatggtaatcagcagagaatttgccagttccgagttcaactagctgaggagccttatgaaggaggctagcaagcttgtcaagggggatagcattgttgagcttaagagtcttcaggttgtgacatctggtcactaaccgttcaagtacagtgatattgacctccccctctaagcatgaaaagtttagagttactagagaagtgaacgattccgggaagaggctgagccaatgaatagaacaatcctcaatctcgttctcttgcaggtcaagttctcttaggtgtctgcaatattagacaaaatcagaagttgaaga

SEQ ID NO: 72325 - DNA, 503 bp, Oryza sativa
atatttaggcccaaaagtgtggtgttaaaagaggggtagacgggtatacggttagcttaaattccccaaattcaccagggctcctttgtagagtatttgttatcctacacactagcatgcccatgcttacagtgggcccatgcatctgcaggacgcacatcggtcttcccttgtgccagtcgcaggcacacccgcactagtgtatacagtgtgcaccaagtggtctcgacatataccactaaacatgtaaaacagtgggccgatatcattaaatgatggttattatggagacgagcagcctccaagtagtcagtgagtcattgatcaactatgggcgagtcactaggtgaacgttgcattaacgcccccccagagggggccaagcatgctgtaaaagtgactatagcctacagacataggactatggaaggcatctttttaggttcacgccagtgtgctgaatgtttccatgactttaaggtcaggagatatccttaaatgtc

SEQ ID NO: 72326 - DNA, 2653 bp, Oryza sativa
gaaggctgtagatggatatgggtgggggatggatttgcaaaaactgatgaagtagttttaactggacaccttcatgtggcaccttacattcgcgtgattccaattgatttagcagtattcaaggacctgttcttagagcttggcataaaggagcaacttgaccctgtagattatgctagtattttgaccagaatggccacaaggaaagcttcgacttcactacaagctgaggaacttagaacagctgtcttggttgtgcagcatctagctgagtttcggtttcaggaccaccaaacacaaatatatcttcctgattcttcagctaggctctgtctgtcttctgaacttgtatttaatgatgccccttggcttcttgattttgatgaggacatcactgggaatgcaccaagcattgctttcaattcgaagaagtatgttcacaattttgtccatggcaacatttctaatgatgtggcggaaaggctaggtgtccgctctctccgccgtctcttgcttgctgagagttcggactcaatgaatttgagtttgtcaggggttgctgaggcttttggacagcatgaagatttgactacacgacttaagcacatcgttgagatgtatgcagatggaccagggattctgtttgagttggtacagaatgcagaagatgctaaggcttctgaggttgtgtttttactggataagacccattatggtacttcatctattctatcacctgaaatggctgaatggcaggggcctgctctctactgcttcaatgactcaatttttagtccccaggatctttatgccatctcacgaattggtcaagacagcaaacttgagaaaccttttgcaataggcaggtttggtcttggcttcaattgtgtatatcacttcacagacattcctgggtttgtttctggtgagaatattgttatgtttgatccgcatgcctcttatctgccaggaatatctccatctcatccaggtctaaggataaaatttgtaggaaggaggatcttagaacagttccctgatcaattcaccccattcttacactttggttgcaacttgcaacagccatttccaggcacactcttccgcttccctcttaggaacgaggctgctgcttctagaagccaaataaagcgagaacaatatacaccccaagatgtggaaatgcttttctcttccttctctgaagttgtatctgaggctttactttttctccgcaacgtaaagaatataactctgtatgtcaaggagagtgacagccaggagatgaaacttgtacatcgtgtctcgaagcataatagttatgagatggccaaagaacctcatgcgcttaatacgatgcttgcatttataaatggaaatcaaccatcaggaatggataggaatcaatttttcaataagttgaataagactaaagatagtgatttaccttggagttctcaaaaggtctctatctttgagcaaagccctgctgcttgcttggtgcattcatggatcttaacagagagtataggtgggggccatgctagaaagttgtcaactgcctctggtagtaagtcccacttctttgttccctgggcatctgttgctgcttatctgcattctgtgactgtggacaatacaaaagaactgtctggtgaagctgaagtcaaccttgatgatttggttctcaagcaactgtctcttggatcctctaaggacaggaaattttttgagggtcgagccttctgctttcttcctttaccaatcaacactagcatgccagtgcatgtgaatgcttattttgaactatcttcaaatcgaagggatatctggataggaaatgacatggctgggggaggaagagtacgatcagaatggaatcttgcactgcttgaagatgttgctgctcctgcttatggtcacctgcttgcagccattgcacaagagcttggtccctccgatctgtttctctcattttggcctactgctgtaggtgtggagccatggtcttccatggtgaggaagctttatgtatctatcgcagaacttggacttcatgttctgtatacaaaagcacgagggggacattgggtgtcaacaaggcaagctatctttcctgatttcagtttttcaaaggccattgaactggcagaagttctttctgaagctggtttgcctgtggtatctgtatccaaacaaatagttgacagtttcttgaacgcatatccttcagttcatctcttgaatcctcatctgctgaggaatttgttgatccgacggaagcgtggcttcagaaatagagaagaagcaatacttgttctggagtactgcttgagtgacatgggagatccttcctttcctgataaattgcaagggttagctcttcttcctttggcaaatggatcattcacaacatttaccaaccggggggagggtgaaagagtattcttttcttcacaaatggaatttgagcttctgaaggactctataccacatcttgttgttgataactctttacccggatgccattttgaagaagttatatgacatagcttgttctgcacggtcaaacatttacttattcacatgcaattttctccttgagttgttgcctaggatcttgccacctgaatggcagcatgctaagcagtta

SEQ ID NO: 72327 - DNA, 939 bp, Oryza sativa
tgcagctctgtagttactctgtcacattggcaaatggcaaggactaatgctaaatttctagaactatatttacagtaccgctcaagaagatactacaaaaacaaaaacttaatcactttacaaaaaaaaacgtgcgaatcaactgtcaattaattctgacatgaacctaagtcgttttcgcctgcgtgacagaaacagagctaacagctaccaccctgaaactgaagagcaattctgggccgaacactttgcagcctcctccctgtctcctgaatccaagcgcgtccctcccttttccctcctccattacacctcctcaatagtcaatacccccatctccttggattgcattgccttctccgtccgtcgcgttgctccggtgctcgatcggtctccccgcccggccgccagacgacgcgccacatatgaagccccgctcctcgcgcgacggccataatgccgccgccgccgccgcgctcctcctcgcggcgctggtcctctccggcgacgtcctgccggcggtcgtggccggtggcgccccctcgttcaactacaaggacgcgctcaccaagtccatcatgttcctcgaggcgcagcgctccggcaagctgccgcccaccaaccgcatcaagtggcgcggcgactccggcatggaagacggcaagctcgccaacgtatacgtcgtctcgcctcgcgccctagctcgaacatctcgctagctgcatcttctaattttgtgaaatggatcactcgatcaggtggacctgactggcgggtactacgacgccggcgacaacgtgaagtacgggctgccgctggcgttcacggtgacgacgctggcgtggacggcgatggcgttcgagaaagagctgaaggcggcgagggagctggagaacgtgcacgcggccatcaggtggggcaccgactacttcctcaagg

SEQ ID NO: 72328 - DNA, 14249 bp, Oryza sativa
cgccctcgccatccgtggcccaaacctcatcgccacccagtaattaatcaccattattatacactgattaattactgctaaattaactaaagatattgagtatattactatattactcctcctcccctgtattaaatctcgacgatatatacaaattaatttgttgattaatcggaatcgaaattagagctgatgcatgcatggacacgtgagtgatcgatcgggcacacgatcgatcgatgacacgaacgaacaattaataacgcgagaaagggctcgcgcgagttgttggggtaggtctcggctggtcgttaggttggccagcttatttctcgttgcacgcacgcacgcacgtacgtacgcaggcgcgcgcaaccgtgtgtaagtgcgtgtgtgatggatcgatcaaccgagcggcgcgcacgggcgaatacgaacttttccaagtgatgaagtgatcacgtatacacgtagtacagcagccgagcttttcggtgagcgtgtacgacgtgtttttttcattggaccgaacataaaacatgtcaagtacgtacgtggtacgtttggttaatgcataaatgtatttgtggttcttcaaatcccgtgctcaggtatgaattaattaatctagctagctatatggtgtactatcttgtacgaagaagaacatctctgatgctgtatatctttgtgatgtatactacacgcacaataaattatctagtttggtgctatcattttattgtgtccttctcgttttttcaaaattttaatttattcgtaacattgtgtatgatgtgtgaaaactataataattggttgtagcttttattaaagtaaagacccgaattctcattatctaaaaaaaacattgttgatcaatatcttgatatcccctttattatacatcagctttggagagaaggaaaaaaaatacatgtatttatttgacaattggttttctgaattacaaaaggggtccttgtccagttgtcttgaactataaccttccattttttgagttcatttttatcatttctagcacaaataataaattgtactaaatcaaccccatctgcaaccattagatcagtaaccaacaccaccagataatgcctactttaccaacaccactaacaaaaccattaggggaataggtgtacttgtggtaaatgaggcagtgatgcagcgcaaaggcaggtaccaatttatccttacaaaagttaaaatcacaaaggtgggtgaccttgatgaacattagttagcaatgtaccgcaaagaaaacattaggtagcaatgaagacaatcactctcttaataatctatatgttgtttgcacttaagttgtaatgtaagtaactcttggatttaagcatacgttagattctgctgagatagacatatatttattcgaccgagcttagtcaaactatagatgttggaataaaaatgctcgatttattttagaactaactcattggtggatgattgggattggttgtcgatttgtcgtaacgaatttattggattggatgggattggttcaatttcgcttctatgtccaaaattgcatcgtcttctactttaacggtattagcttggcatgttgttatttggcacaactctctattaaagtcgtgtcctttcggctattgggtaccaatctagagtcatgtctcttttcacttgtttaatatataatctctcaaatggagtgcatatcattgtttttctttacgggttatctaaatgtatgagaaattatttaaagctaaaaaaagttcggggcaaatctttacttatatattactactccatctttctttgcacatttgcaaactcaggcagaaaagggaaataaaaaagggaatcaacctgccctccttttgcagcataaatacccaacccatcactccacaaagaaaaaaaaaagccactctctcgcgatttccctagtctttcggtgtgcgtgcgcgtgtgaaggcgagcaagcgagcgaaagcgaaagaagcagcaagcagcaagaggaggaggcggaggcggcctcctttgcatgtgaggagagagaggaggtgaggtgaggggggccatgtcgatcgcactggagagtgggcccgggctaggaggaggaggagggggcggcggcgggccccggttcggccgcgtcgcccgctgcgcctacgccgcctcgccgccgccggcgtcggtgggggcgcgcagctcgtcgtcggtggggagggacagcgacagccccgcggcggcggccaagtgggagtgggacggcgaggaggtggagggcggcgacggcgaggtgcagagctcgtacaaggggcccttcgacaccatggacgcgctccaggaggccctccccttcaggtatggctggcttcccctccccgcccaattcgtcgttacccccacggatcttgatcggtcccgaggtgttcttgcgtttcgtttgggtgatttgggggtaatgcggggtagaaaccgctgttcttgatcccccggtgcgcgtgttcctctagagagatttcgggggtttcttgattcgtttggaccaatgcagtggaaaatactggttcttgatcggttttagttggggaatgtaggcaagattcttggttcttcgtggacggttagtggtcatggagtaatttgtatggagcggtttggttatctatccttgagtcgatgcttatcttggaatttgggggatttattggtcggactgaagtcaaactgttaaaagaaagaaagaaagaaagaaagagctaatttagggttctaggtgattctttgtgccgccttacatccaacaaatttgtgaacatgggtttcgatcgattcgtgaagctgggatatttgaggtcggaagaatacagcgaatgcactggatgccgggatacttttgcgtatggtttcgtcatgcttgcttattgttggttcatgtttgggttatacccataacccattaggggtcgattatatttttgtaagtagtagtccttaatgttcttgccatgcccttaaaatctttatgctgaatgttctgagcacgaaaggttctgattagacaatttctaatgcgtttgtataggcttcagcaagaatgacttgtgattagtactactttgttggtgtttcacttcattcttactccgaggaatcaaaggatcctagcacttgaatatttcatttgaagtccatgccatcttataatttcagaagggcacattagttgtactaacactgaaagaccaatttccatgattcatagttcctttggtatgtgttgatacttgatattgactatataagcgcagtattatgggatgaaatcacacaaaacgggttttatcagaattacaaaaagttctatggtgtattaatggttgggtttctttgttaatgatcaatacaatagatggtgtaaattgcagatatgtgcatctttgacaaaagcaatgaataatctatcttctaggttggtcgtagtaatgactttgagtttgttcgtttgtgttcttgcaacctgactattgtgtacagggggggtaggcatagctctgagatcagttgatgcatattaccttcaggcagtaatatttttgtcatgaagatatcatgaattgttataatttttgcatagggacattttttttttcttttgagcatgcacaactactgtacaatttcgctactgctatttgaattctttcagtactagtgtaagtctagcacaactacttagtagctgagtgggtttgtagttcatactaccaagtacctattggcccttgtcacttgtagtcgcatagaattgtgcattctagccatatgatggaagcagagattgggtattgtgaacttgaagtcttgaacacaattcaatatggctaacatgattaacacaggaacaggatcagtcagacaccacaatctttttcacatgcttttgttagctatcttgtagcatgtgtaattatttgttgatctgcaacattaaaatattccgcagcctgtctctatcgttgatctggcaaacttgtttgtctgttccttgtgaggagcatgtgtactgctgatgttttccaagtctttgctccagcatcttacaatcttctgttttattgagtaattctgttcttatctattgcaggaaaggggtatgcaagttctacaatggcaagtctggatcttttgcaaagcttcaagattccgtgatcccatctccacctgagaaaagtcttccaaagccagaaaacccatcccctaggaagcggaaaggtcttcttccgttcagtttcaagtggggcaagccacagaacaaagaggtattccctgaagatgatgtgatcatcagccctacaaattgcaggagaatgacattgtcaccagctgcaacaagcagttcggggagcaacagcggcagtgatgatgaacactaccgctctccgaagctgcatacccgtcagccactccgaaggcccagcaatgccgccatgggtgtctttgcttctccacctgcacctcgtccaccgcaggtgttatcagctcatatgagatcacactcgatgcttgatctgcaggatgtgacagagtcgaccgccatggtttctcccagggacaagcgaaggaggaactaggaagggtggatcttgatgtgttgtcggtctggtccaaccgctggtgcccattttagactgcggaatccagtggcgaatgccgtcgtggtggtagggcgcgtgcaatgctttaggggggtggggggtgttttgcgaggtcaaatggactcgtattcatagagcttgctgttctccttatacttgatgtactgggatacatacagagaacctgagaaactgatgtcgttacctgagttggtgggctgcatgcgttgattacaggttgacttgtaaatgctgaactctgcttttgtcgattataattcaatcatgtggcctgctctattacattttgtatacctctctgatctgtggtatctcacccttggaactgtatcagtatgcatattatgtcctgagctgttggtgttcttctgttgctagtacaactgtacaagtagcagcaacctcttccgatgaacttatctgtgcagatccatcacttttttttttagaacatgcagatccatcacatagttttggataaatcattctgctcttatgggtactggtgtgcaaagcgcaaggattttgtttttttggcagaagataatctattgcagtacacacgcagattgtgtgaacgccttggcaaatcctgttggtcggtttcgtactttcatcttctgttttcgtgttcggaagagattgcagtggctgtgcagccgcagcagctccatcaaacgcaacaaaatttctacggctttgtactgtagatacagcccagctgcgccacagccgagcaagctgcaaagcagcacaagcgatttggtggcacatgattgctgctctcgttaatctgacgccttcggtaatcggaacctcccactcacagctgaaatttgttgttttctctatgcgtagatcaaaactgatctttcatatttgtgtaaggacatttaagacctacttcactttgtattatttaatttttataagattttagttaactatttggaccacatggactaaatcttaaagcccacaaatcttgataaggcaaaattgtataaagcaccccaattatcactcgttttaaaatctcctcccttaaaaaattcaattcgttgcaaaggcccacccaaccaaaccccttcacatgaatataaagtcagcccgaccccgctgatgtgtagtcgcaacaggggaacagagcttgaccttagctactctctctgtcccaaacagggacggagccagcattttgaatcactggggtcatggcttttacttgtatttatgtcgtgtttgaaactataattattctcgaagctagatatttttagctcacttttgagctagagctatgagtaagttgggattgttccattttgctaaaaataaatatttaaagtctattctataagaacttctgaggtttttaaggtccaaaattttaaaagttatgactacatataaccgggcataacaaccatgtgttttttcagacatacaagtatgttctgaaagttgtttattattccatctgtctcaaaatacaactacctacgtctttttaagagattaatgttagggtgtgaaattattgtgattggttgggaaaaaaaagtaggtgaaaaaaattatatcgaggaattttgtgattggagatgggatggttcatagaaaatagctatattttaaagcaaatttgaatattagaagtaacatattttgagatagagtgagtaacttaaaaaacacatctagtagttgattagcaaaacttcaggcctaatgcattgatatacatagcacatagctaaaataagtagttggttaatagatcaaatatgtctaattgcagcattagtagcggattgacagtagcataacacagctaacaaattatgcttccaaagaaataaacggtacaattgtttcagccttcctgagctccagcagtttatcaggctggccggggtcattaagcttttgttgctggggtcattagctacaaaataatgaacaattcacttgattgatcgaatgtcatcagggtctaatgaccccaatgatagtactgcagctccgcccctgatcccaaaatataagcatttttagctatgaatctggataactgtacatttagatttatagccaaaagttattatattttaggacggatgtagtaattgcctatactgattcgccgctaccctcagccctcgcgttgttcgagaccgtcttctctctttgatctacacctaggactaggttcaaatggatgcacctgaaaccaaacgtgacccattggtctggtcttttacgggtacaagtcacgggctgactcagctatttacacacgtggagggtttgggtgggtgggtttttgcaacaaattggttttactagaactttaggcgcgcttcgggccgccctaccgtttgttattggtaaaaagtatcacaagtcagaatatgtatgtacttatattggtaaatgttgagtacgaaaggacttcattctagcacaggctgtgacataacttgaattccgatgttacatgatgatttgaaatagaccctgaatactataagataaaaaatacctaataatttcagaaaccacaattatttatcatacccaaaagagcaagaaaaggtataataatgtacttaaaaaacggtttaatcattcatcctcttttaaaagaggttaattcagttccattacggggcatgaatcacaagttgtaatgtgaaggactgtgtttgcaatcacttaagaaaataaatattcttcaatcgcacatggggactctcagaatttgtatgcaccaggtttctggttttcgttgcttgcaaaattaagttgctagcaatcctggaagctgagtagacactttactggtgtgcacgcgcgcacgtttaatgtgacatggagattattacaggcagcacactgtggaaatggcagagttaggtataatggtaaatccctttttccagaattatcagctaaaatccactgctagatgctccctcaatcataccagcttacaaaaaacgtctttcggactaatctctgcttgaatatctggtatttggtacataggcctaagaaaaaaatcagagagaattgtccatgttctgatttgtgattctgacttctgcagttactaaacataatccaaacaaaaaagaaaatattttctatgttctgtaatttgagtcttaattcagattagattgacctgaaatctaaagaggtcatgaatattcagattttgcatttgattctctgagattatatcaaacagctagatgacaccttaaaaaacacaatgaagcagaaccatccaaaccctgtcctgaccacctccttaaaatatgtaatggagcagagcgacccacagtggtttcatgaagtgaacatctaagctttggttgttggaactatatacaaacacaaccaaataaaaagatatgcagtacaaatcagaaatactgtagcattcttgataaaaaaaaagggtagactatcatttgcaagggaataatggtatatgaaaaagcaaagctagcgagggaactggaggcaggaaagggaagatacatgccaagcatacataagtgagtgtagaaaggaactggttgtggcttaactcaccaaaattgaccatgggaaacaaactgcaaatggaccctgggcaaggcaacaacacatggttccaatatcaccagatatggaatcgctaaacagtggtggtgccgcacggccgacggagcttcaagctaaccaacacctacaatattggcaaacttgagcaccttctatggcagcaaccaatcctttttatacagataagacaaaatcaattatcatatttgatattcatatttataattagattgcattctttttctcttttttgaaaaaagattccacttatctagtgaccaacacttcaaagtatcacctagagtagaaggcaaactgaagagaaaaacattgattttaacaatctttcaccttcttgtacatagaaacacaactgtgatgtacattaatcaacgttttcattagccgatgaggacggtaattttaacagagctaggatgatgcaaaataaatggctcagcaaaaaagagtaagttgtgttttctaggcaagaagttttttggatttaaatcaacagcaactatgaaattgtaagtcccttaaatataattgcatgaaagcacataaaccatttcttgcatacttaattaaactcctactttgaaacattgatatggtgctctgcaatagttctttcaatcttgcaactaatgtcaagcaactttgttatggccttcttgttccatgattcaggtggccttgtaatgctagtatatgaccttcccatcgagaaaatacttagttaatgaggaagaatatccaaagtaagaccaatttcagaatatcaattagacatctaaatgaggccatatgataaagtgcgtgcagtaaaagaggatttctttttttatcatattaacaaatgatctgtacaggtgctacagcctctaatcctcccatgaatagtttagcttaattagtttattctactgtgcacccatggtaaatttttagaaaggctaaatatcacgtcaacagtgaacattagaacagtcactgacagttgcaataacatggagtatgtgcatgaggatagctaaggataatggatttaggacaaggttctatgaaccatcacatgatgttcatgtgaacaaatgcacgtaagttcctattatgctgcatcgaaaaaggcaagaagcaacagaagaacttggaaatctggaagaagcaaagaaaataaaggcaaaggcaacagaagaagatcacctgttcaaaaatatgaaatgtcatcccaattgccttgtggaggtagcaacaaatagacactcaacatttagtcatgaaatcaatggcatcttgcttcacagcgtcctatcatttattgagagcaatataaaccagaagtatatattgtactaatataaattgaagagtaccataacaaactttatatgcccacgatcatatctatgactgtacataacaatgctattcaaacctgaagaaaaatcagacattcatgataaggctcatagtatcctctagaatcagatcaagtccaaagatagtcattcagatcaatcgataatttttttgattaatttcaattgtaagtggtcagctcaaagtgtcacagcatttacatcattcaatattaagttctggaggtcttcattccaacacagattgtcacaacacctgaattctgacatttgtgtcacttttaggaatagtggttgaattcttcaagatagaaatcactaaagagttagttcagaaattatgaaaacttatcatgcttaacagagaaagacatatcaatgtatataatcaaagatgattttagtgagattcagtttctttaaaaaaagctaatttagttccatcatatgcaaaactaaatttatatgttgcatctcgtgtagctgaaagcatgaataccaagatagaagcatccgcttatgtgaatgaagataaaggaatttatagaacaaccttcgctaagaataattcccaagaaactaaatgatttctagatttggcaatagaacggtcagttgatcatccaaaatactcctcaaagaactaaatgtggcatccaaaactcttctttcactcaaaagaaaaagataatacatctattgaaatataatgtgagaagtaatcagttaaactaccgtagatgtgggtgtcctaaagagtatgtggccacaaaatctgacatcatgttcacaaatttctaaagattgggtataaaatgatacatcttaaactgcaatgcaactgcttagcatagtataagatgagaaagcatagccacaaggttgctagatagccaaatctacttcacatattaggaagaaacatgccccctatagttttgacatacctgagcaccatatatggtagcaaccaaccctttttacatgaataagacaaaaggagtcatcagatttgatatttataataggatgcacttattactctctaaaaaaaggttccacttatctacatgcataacaatacctttgtagagaataaattatatccgatgaagagctatagaaatacaatgcatatttaagctgaaaggagcatagaggacacatacacattaacaacgtacaacacccactaaacctctttgattacatcaagccactgaattatcagttataatctccctcaatcatacaagcttacaaagaatgtttttcagactaatatctgcttgaatatctggtattcggtgcacaatcccaagccaaaaataaaacacagagaaattttcttgttctgatttgtgattcggacttctgcagtcgatctacacatgcggctgttcttcgttcgcgtcattgtgaagcaatcaagcagtagcatcatattgtccacatcgtcgtcgccgatctggagggcatggccgacccgatctccaccagcaccccaacgtcgttggtaggccgcgccgcccgctggtcgtcggcctcacctggtgcgaggtcgccccgacgctgccggtgccatctccatcaagctccgccggcgtcgtcaaggtcgtcgcggcgtcatcggtgcggcacagggtacgagggaacccgtccctaccggctcctcctctgcggccgccgccgcctggggagctcgtgcccgccgcagccgcctacgcctgcaggccgccggttcaccgtcgatgcatcctccgccatccacgctgccgcccggatctggatgtcatcgtcgttgcggtcaatcccatctcgccgagctccggcctcgccgtcgtcaccatctccacccggccggatgacgccggcacctgcctcgccgtctcctgtgccgctgcggggggactcgcctccaccgccgacgtgtgcgggtcgccgctgcccggattcctcgctgcccctcctgggactccacgatgggcgcccgccggtctccgccgcgttgctcccggcggcgccccgacaccgccgccgcaggggggacggattccgccctcaccgagcacgagctccctccaccgcctcccgccgtccgccgcctcccgccatctgccttgctgcgccggcgccctccgtcggcccgatgcctctggctcctctcataatctcccaaatcaagcgtcggggccagaagatcgatccccacgccatcaatctccatcacagcatcctcggagctagcgcagcaccatccaatcccctgcttgacctcacagagagaggaagagaagggagcaaaggtggggggagcgccaggagcccaggagatggaggaaggcgggggagagcgcgagggatgtcatctgcgatgaggagaagcgggtgagggggagggaagacgatgcagcaccggcggcgccgcaaaggcaggggaagagcaatcgagagaagggtggggtacaatggcggctagggtttcggagaagcgaggggatggaggatggggatgttttcttttgcaagaaaaccctcttactttcttgttttagagcgcgccccctatattcggaatttcttctctttcacatataataataccagtatatagaggaccactacgtaagaatataaaatacagagaagtatgaccaggcagttaggaatgattatcaaagaaagtgagggtttttttgcaaaattgccagctctagcacagggtgacgtggatatcaccggaagcgaacacgccagccaaaaaagccccggagcgctgtggtggctctatttcgcggtcccctttaatctctccgatttaatctctccgatggtggaattttaaaacaagagtgataattgagatggtttataaatttttatctccggatagtgatactatgtgtcaatatataaatagttttcagacacgtgaatacaattacgatgacgatgatatccaatcacaggctctacctactaaaaatctgcttaccaaccagtacgaggcgtatatttcatactccctccgtctcataatataagagatttcgagtttttaattgcaacgtttgaccactcgtcttattcaaattttttttacaaatataaaaaatgaaaagttgtgtttaaagtactgtagataataaagtaagtcataaataaaataaataatatttttaaaaaattttgaataagatgagtggtcaaacgttacaagcaaaaaattaaaatctcttatattatgggacggagggagtatatttgcatggtatcagtgacacatagtactagaacaaaaataattgaatccctcgcacagataggcaaaccctgcagtaagttgtatatattcggctgccctggcctccccactacctccccacagatgacagaatagctcatcaaacctaagtttaattaattgccaacattctcatggtcatcaaaccaatgggcaaaccactcgtagtcatactcttgctatcctcctccctcctcgccgttgcagctgctgcagcatcgccgccgtcatcaacagcagcaggccatgcaggcgagccagacgacgacgttgtgtccacctacatcgtgcacgtcatgcccgcacacgcgccacgccgccttcccacgcaccgcgcgtctcgtcgtctcacccgcggctacgcatcgctcgtccgcgggctcctcccgcggcacatcgccgacccggctccgcgactcctctactcctacgcgcacgccgcgacggggttcgcggcgcgcctcacggcacggcaggccgcgcacctcgaggcgcagccttccatcgcggccgttgtccgcgatacggcctatcagctccacaccacatggtcctccgactttctcaacctctcgccgtcttttgggctacaggcggagtccaacggcgccgtagacgcggtgattggtgtcatagacacgggtatatatccgaaagaccgtgcgtcctttgcacctgacccatctctgcccccaacaccgcctcccaccttccgtggtagttgcgtgtcgtcgtttcgtgattccaatgccagcgcttactgcaacaacaagcttgtgggagcaaagacgttctaccggggatacgaggcacaaaatgggccaatagatgagagggtgcagaccaagtcaccgctagaccaggaatcctaattgacgcgtacgcgccggcccacacggcccaagacatggttagttcttttttccgaattttttcatatatgtataagcttttaacccatatttgaatactttcaactctgacttaaaaactttcaactcagattcgaaaactttcaactcgagattcgaaaactttcaaatcagatttaaaaattttcaaaagttataattaaaaaactttcaactcaaaacattttgaaaaaaaaatacgtgtgctaaagattttaaaaaagtaatcagaaaaaaagaaaaaaaagctaaaagaaaaaataaaaaaaaacgaaaaaaaaatcgcgaataaaaaaaaaggccgatgggccttgtgggctgggggaggggggggcag

SEQ ID NO: 72329 - DNA, 2001 bp, Oryza sativa
agaacagaagaaagtagataatgctgtaatgagcagatctcatggcatggaaggtcaccatctacaatcccaagattcaggttctcagttccctggatgcaccacagattactggaaaacttccaggcctactgaaagtggttggaggttggctatcatggtgtatcagcttttgaagggcgctgtaacacgaaccagcaaagatctgttagttctaaattgcaattaggtgagatgatcaaggctgcaaatgatgcctgcaaagtgcaaggtgcatcagatgttcatctgatttctggtcacccccttgctgattttgagacttttatatattctgcaagtccagtcattgctaagacatcttgcatgaggaatggcaactgtttgcaggacccgcaagctggcagctcaccatatcaatatcagatatcggatgtctccttgagaaatgtgtgggaatggtatgaggaacctggatcctatggattggaagtagaaatccatagaagtctcaactctacgagatcagcttgtggtgtctcagagttctgtgcttactttttaccttctctatctgctattcaattgtttgaacagtgcaagaataacttggaccataagtttgacagtgatgatgatttcttattatcccaaccaaatggtgtgtatttaccaaaaccatctttatctgtacaagaccatggggaacccctgtttgaatattttgaatcagagcatccttcttcacgtcctccactttttgagaagtaagccttctattgttgatgttatgtatctacagactgtagtaatcatctacacttgacttaaaaaaaaaagaccgaaacaaacaaagttgtgaagagatgaaataaaataaatcagaaatcattcataaagagcttagccaggaattgttgttgttcttcttgacttttaaaatcataaagagcttagccaggaagcattgttcttcttcttgactttttagatgcttaccagtcattaatgggctgtcacatgttttttcttgatgatacttgatacattttatttttatctccttatgcatataactgctgaaataaaatgaggacgttgcaattttgttttaaaacgtttccttttcctatgcattacaatattttataggatcaaacagcttaccagtggtgaaaatctctctacttgccaaatatttggggatcccaagatgttggaaaatcttaaattgcgcgatcttcatcctgcttcctggtatgttctaatattggatatttctatccactgaattttgaatttatataccatttgttcccttattagtgctgattattttttaactcttgctaatgatattaccggactccatttccaggttttgtgttgcgtggtatcctatttgccgaattcctcaaggaaactgccgtgctgcattcctgacttaccactccctgggcaaagtagttccccaaattcactctccagacaaggctgatgaacctactcatttggtttgtccagttgttggtttctggagttacaatgacaaggtaatatttcatctctacaataatcattttttgtatcggtacggatagtataggtttgtagccacaatttattattattactaatcacattcagcacggtactaaaagttcaatgtaaaacctcatcttcatctaacaaaagctttatgagtaaactttaattcttgtttttttttcttatttgactaatcaagttgtgacctcccataggtggcttgcttatatctctagtgcacttccccttttaagcttaatttaagacagtaagatatggtgttggacaaacgtcatcttcatcccatctgtctgtgaccaagttgattgtgcataggtggacaatccactatggaaaatcattgtattagtaaaggaatataaagttttctgttattataccagatggcggaaacctttgtgtactagaaaaaacttttagttttcttgctgg

SEQ ID NO: 72330 - DNA, 8185 bp, Oryza sativa
gtttttgcaaatataaaaaataaaaaattatgcttaaagtattgtggataataaagtaagtcacaaataaaataaataataatttcaaaaaattttgaataagacgagtggtcaaacgttgcaagcaaaaactcaaaataccttatattatgggacggagggagtattaaattttagatgcccgcgcatttgcgcttcctttatagttatataaaaggagagaaggccatgcaagtgaagtgatgatctcttatgcaccaatcctacaccttaaaaccctaacatcaccatacatcccaatcacaaggaaatcactgggagggacccgaatagctaattctcatttctcacaaccgactgttgtcaacaacactacaatcaccattgtgagagaagttggacgttgcaagtcaatcaccagcgatgacgccttcagctaaagcgggagatctcactggtgcgggacttctacatccacatcgacaaactacaacagtagcaacatatgtgatactaatgacttcttctacatccggttagtaccaccaaattctgtattagattagatttggtgatacttggaactcctaaatttagattagatttcgttttaaatttatgttgaaaatcgctcagttttccaacagaaaaagatacttgaaactcctacagtcaaaatatgaacgtccatactataaactatctgaggcagaacagtgctcccgggcttaggcaattcagaggcagaacagaaaccgggggctttgcagagcacagcagttgtttcaaagggtttagcgacatgacgcagatgcatgcgactgcttcacaccgaaggcttcgcacgcgcccttccacccaacccaaaacatccagaggctccagccacccacagggggcagggccaacgtcggggcagcttcgtaatctcgcagcgcggccagaatttttgggtattttagtttaggtggaggccgcaaagatcagaccaacacgataatagttaaacaagcctgtctagatacaccggcagcgaatgagaaacggcccatgagccgtcgtaagggtggatctgcttgtaacgcatgtcgttcttctcaccaaatttctctcgtgtcggatcgtgctcgccaaagtgcagaggcgtgcccttgcttctcactgtgtgtcttaagactctgaacctgaaggagaaaatgaaaaattaacatgctttgatgatgttctacgtggagcatcgacattggcaatgttgataatgatatactcccttcgtcctataatgtagcaatctaaaatgaaatgagacacatcctaagactacgaatctagacgagaaatatcgatgctccacgtagttctagattgctacattagagcaggtacaatagcagactataaaccagctataaacatatttaaagagataaaggaagagagagaatagtagcgggatacatatctatagccagctgatgcacagactccaagacgtaatatatgtataacaggtgagaccagatattaatagtataggaagcaactattgtatgaattgtctattacattacactggttatagataatttagaactagcagtgagctacaatattaaacctgctcttatgggacggagggagtactgattataacacctaaagtcctgatgcgacgacacatggttcttctttttcctttttctttttctttttcttaggcagcaacttatgtttttctgaagcctgcagatgttacttacacacctgatatactgatactattcagcaatggtggcgatgaaatcatcgtgccatggggacagcaaggcaggcagctagtggccaaacgttcgaaaccacacgccgcggcccttgtcctttgatgcgtgtgcaagggcgactttgccttgcctatcctgctgatgcaccagacagacagcgtctgcctcttggacgacgccaacctcctgtccttccttggccagtctctcgcttgggcctccagcccgcagacaacagatagagaccacgcaatttaacacacacagtcgttttcaccaaaattgtcaacttccgtactctccaatttaagctttggaatagaaacatcagctgagattttgattttagacggatatggctgagaagaatatggaattgcaacattcagccaagaactagcacatatataacttctcaagaatgagcgtgctgcaaagtcaggcgaagttcaactggaagactaccctatatgtacacacaggagaaggaaattgtatcgagcccaacgagatacttagaacgggaaccttccacgtgtgcttgaacgtatgcaagatcacagggcattaagggcaaatgggccaaatcaaaatcagagaaatgttacaagaaataattttacgagtcactaattcggtaatcttgcctcctgcgaaaatgtctgagaatgaaactatctgcatacatggggtacttttgtcgtatgagacctttgatgcacttccagaatgaaaaatcaacttgctcaccatccttcctaactatgaaaagacatcttgagttctcaaattctggatgtaaccctacctgcaaagtagcgctaaaggttagtgtccagttggagtaaacaaataaagaaatcaccatttgtagctcataaccatattcaattcaattttattcaagaaaaaaaacgcaagttatttaatacacgatacaaaagtcaaacaagccaactaaaaaaaactacaacaaaatagtgacatttctattcagaatttttgttaaaaataaacatgctgaagtttgttggtaatcgtgattcatgggactatcaccttgacacatcaattacaaaataaagttaaactacaagctgtatgtctagaagtatattgagagctgtaaatcaaaactttctgtgctcaacactcaacagcaagaagagataaagatgataaaacattatttctttgttcttcagtttcgaaaaaaaaaagaaaaaaaacttgagtgtttcgcctctatgtcttaggagacttccttatatctgagagattacataccgtaaggtagtcaataccgcatccaattttcttctcatattgtgggtgataaggaagcaatcgttccaaaattgccttttcatgttcagggctcagtcgatcaccattttcatacctgcagcagtttcaatatcataccctctcttttactgaattctacaagtgcaatatatatttaacttgcaagaactagtttatgaaagggaatactttcagatgttcaatagacaataaaatataaacaagctgttgcaccttaagtatttcagttctgttgccttacaattatatcttgctgattgtaggcaaagcatggaaccacagtccacatggcatacctaatactataagaaggttgatacggtgaagcaatttctgacttgttatacttcaatagtaagaagccatgataacaaacaacacatgctttttgggaacaatgcaacaacatcgtttcttacattaacacaacatatcaacataattaaacaattcttccacacttaggatgctaaaagtgcatgaatcacggtgaactcattccatccaaaaaatggaaaattatatgacaggcacaaatattgctggcatcattcatgtgttctgtgatgtgtgtgcaactgatcaaagtttcataacacctcgttttatgaatcataaactgttaggaaaaattgcataaggcacgtgacactgatggtaagagaagaaaaatcatattttggctgtctgatatccatagctaattggttgcttgcatgagcatgatacactttaagattattaataaaacaaataagatctgtaaagaaaaggtgccgtactgcttccttgaaggaacatgtgtaatataattgtggcagctacaggcaggtgctaggactgatttatatcagatgatggtctggtgtgatgaaagtagatgaatatgaggaatagccaaatagagatatattgtcatttgagtaaaatacacggctggtccttaaagttgagcgcgggtgtcacttaggtccataatcttgtaaattgcacatctaggtccactatcttgtttaagtgactcattgagatccaaaggacctatgaccgggttgactggcttacgtggctgtcccgcatggcaacatatttgcattccccccctttgcttcctcgtgtctgatccaatcccttcttcgcatgacgcacgccggaacgtgccgacggcgacgtgcgccagcacgcgcacctgcggcacccacccgtctcaacctcgctgcgcctggtgacgcgcctcgtaccccttcggcagccgctcgccggcgttgcgccgcgcccagaggaaccgcacaccgtcgtcgacgggaaggagaagaaggaggggaaggggaaggcccccactcctgccagccgcaggtgcacgcggcaagcggctgcggcaactgctcaagtcgagctcgccctgccgccctgccggcgccgtcgagctcgcaccccgcccgctcgcgccgagcttggcgacacctccccgcacgcacgggcgcggtaggcgaccactcccccgggacgcgggcggcgacaccttccccgtgcgtgccgagctcttcaatgcctctggcgccaatgaccagcgggaagggagaccggtggatctggccgtcagtgaggcgcgagcgccaccggcacgctagctacgaagatggtgacggtgctccgagctcgcccaccatggtcatggcgacggtgctctgcaagctctcctctagttcccttcgccgcccgcaaactgctgccgcattcgcccatcgccgctccgctcgcagcccgccgccgcgcttgcccaccgccgttccgcccgccgcccgttcttcaagaaggatttgagggtggggcggcagggcgcccgctgttgagaaggtgatgctcatctcctgcaccggcaccacggccgacgtgttgtggcaggacggcacattgcggcgcggcgtgccgtccttggagttggtgtcgttcgacatcctcaacaaccacgagttcttcccgggtcagcacgtcgacgttgacaccatggcggtggcaacaacaacgacggcgaggcgcgtcggctttgtcgaggtccacgacggcgcgacgtcctgatcttcgagctcatccaccggtcgcttcgtcccctctaatattgtgtcgttggcaatcatgcgccgcttcgtcgaggtccacgacaacggcgatggaggacgctgatgttggcgaggcgaggccggagaacgtgacaagcgaggcggtgcagccgtggtgcgcgacgaggcgccgcagcagctcggccatcggtatgacgtggccagcgaaggggctggcgatgaggatgacgtgcgatggcgatgggcgaggtgacgacggaggcagccgagggatttggggatttttttggtgcccagggctctactgtagcgcgaaggggatatttgcaaatgagctgtctacgtggaatgcaacgtagacggtcagcttcgatcaaaccgggtttggacctcaatgagtcacttaaacaagatggtggacctagatgtgcaatttacaagattatggacctaagtgacacccgcgctcaactttaaggaccggccgtgtattttactcgtcatttggtacaccaaaatatcaaataatgattttgaactaactcatgcaaaccacaatagagtaaggcagtaaccagtaacatgtggaatgaattacattagaacgaattggcacaaacgaaaaccctaaatataatcagtttactgattagtcatatgaaccctgatacaaggcatatgctttgctgttatgccataattataaaaaattgcacttggtactggtggaaattggtctaattgtgcttggccacttaataattccataatgggatccgcataataagtttagcttgcacaccatatgttcgatgaattgtgtttcgaaggaataatggtctttataatccttgtgccatgtgacaacataataacacatctaaatatgtgaaagcaacaagctttctcaaatgatattaagccacgtcatatgatttatatgagccgttggatgcaacaaaaattcagcccctgccgttggatgcattgtgtaaaagagtctcagtaaaagagagcaaacggtcaagaatattctggataggttaggaagaagggaacgagagggaaagaaatccgctcctgtgccaccagccgtcgcctgcggccgtgccttgccccgccgccacctgcacccagcccgccgtgcgccgcccccgtcagtcccatgcatcgccaccgcctgcaccagcccgccgtgcaccgccgccggcagccctgtgcccctccgccacctgcgcccgtgctgtgcgcttccgccacctgcgcccggcccgccgtgcgccgccgctggccgtgccgtgcgcccgatgttcctgacggcgtgtgctactgcctgctccaaccgtggtactacgccactgctcctctaggtcccatgccggtacagtggcaaggcactggcgaggctgcatactgaatttaggtcttttttctgctgccgtttgagcaatctaacactgcaaggcagtctacatacaacatgcagactttgatttactctttaccagccaataagcaaataaataagtcttagtccatagcaggttagaatttagctgatgacttaagaattcccttccatatgctcaattcctgcatacaatttccaaaaggtgaacaaagaggctgatgatatcctctctaccagatattgtttattcattcaaatagatttgttcactcattttaactttgagttctgggttataaatttcagctggaagtcctcatatgaagtttgggttggagggggagtagtacagtatcatggtcattgatctttttggttcaattctagatgacttaatcaaccactgcaacagaaagttctctcttaaaacagtagttatgcttactgatcaaatggtggctttttctaactgaatattttattctagctgttaatttcaatttgtaacattttcgacttgcttgaaggaacataaagcactggtgattccctccactgtgccctttttgaatcctactgctacgaaggcaacatcttttcttcaattctgttattgccctagaatgagcattttgtttttattgaaaccaacggcaagaggtcaatcttgaatataatattttaacctttagttggaaatacaggtttgtctagacttaactattcttgttctcaggttatacaaatttgcatagattaaaattttaaagcatacaatttcatgatcattataattacgacgcatatctaaatatatacacatggattttataccggaatacaaagtcgtgcaacgcacgactaaatgggtagtgctagtgtgaattacaaatttcatctagaattaaagcgagaagaaaagatagttgcttacttgccggagtgcagaatcatccggacgaagccgacgagcggcacggtgtcctcgaggatgaggtcctcccaatccacccactccctctccgtccccttcctcctcccctcctccggcgtctcatcctcccccgaaccaccacccggcgaggactccgcctcgctcttcctctccgttgaaatgtgttctcttatccccccgttcttatactgcttatcgtgcccttacgccgtttatctgttaacgccctttatcccgtatttggctcctttcttctcccaccctataccccgccatctcttaccgcccctaccgctcccactcccttcttcttcttctgatgtccccggcgcttaatccacttttaaggaaaatagtattacgccgccacgccccctcctacgtttactagctcataggggcttcgcagtttatccggcttcactgcccctaacggctcactttcgctcccggcccctatcctgggcacagcgccgatcttcgtcctttgtgcggatcacaggctgcattcgccctatactcggggttttgctctcgtcccctgcttcaccccgttatcgcctcctcctccgtcttatacccgatcagcttgtaggctcccctccttacaccgggacatttcgccgcg

SEQ ID NO: 72331 - DNA, 588 bp, Oryza sativa
ccaaattaaaaattaaaggagagggcaactctgaattcacaagcagaaacagagatagagtttcagacacagatagagagaggaacacaattctggcccctacgaattccagccattttcttacactttcctggagagaaaaaaaaatccaggaaacatcaataacactctcagaacaatttgttctttggcaagatgcagcaagctttttcattttcttctctttttcctcagggaatacggtgccatcgatcattggactctttggtgtgtgaatcttcagagagtagcaccgactatctcagatgccaattttcaggaaaatttaccgtgttgatagaaatttgtcatagtctcacatattttccacgagagaattccaagaattgaggagtgcttgttggtacagataccgccatacgcgaatattttttagtaaaaaataataggagttgacgacagactctatttctaagagtttacatccgtaccttccaccaaacaagataccaaacaagataggctatgttcaatggtttatttttcgccgggccggcagaacgtattaagtggggtatgacaatccta

SEQ ID NO: 72332 - DNA, 964 bp, Oryza sativa
acagaaatttgttcacccaaaagcacataaagtcataaactcaacattattgtgcagaaatattcataaaaatgaagctctaataaaaaaaatctttcaatttaaattgttccatcaaatttgaacatatggattttggtgcagaaacctacctttctttgttgtagcgctgcatcctttctgggagtcaagatgggaacatagtttaagataagaagcaatgcatgtataacaagaagatgcgtgttttgttaaattatacacctgctaatcagattggcctctggctctatagcatcagcaataacagcagcctgaaatgtggacatcagagatgttgacacaatacatcaaacaatgcattgaagatgcatagctgaggggtatctgtgtatggacataccatgtgcatggacttagcatctccttcctcactcctttcttctgcaaggttaaactggaagatgcatgtttgagtgtttctaacaaattaaagcagaaattaaatccaaaatcgtgatttcatctcactttttcgtacatgccctcggtttccacttggagtgagttaatctgcaaaggaggcatcaaagaatcacactagtgttgcatataagaaaggttaatcttaaagtggagaaagatagctgttttggacttttggcagatggatccaaaagtccatacaaacagtcataccacatttcgctggaacaagaatcaaggactaaacatagatgagagcaaactcatattttaggacaaactcaagtagtatataggatattctgcatttcctatcattaattttcttatcctcctgtgttttcgaagaaaaaaattcttagaaaatgctgtttatgacaggaatcacctcatcatgaagagaagaagatgtgcgccgcgctcttagagagcttccaagatcaactgatctcctaaggatgatttagcctatattact

SEQ ID NO: 72333 - DNA, 9810 bp, Oryza sativa
ttcccaaaggatgagcgtttgaggatcagagctaaatgttcttggaatggctgcccttggatgatttatggagctcaaagaaccaagtgtgattggtttcaagtgtgtacctacattgatgtgcataaatgtccacaaaataaaaaaaataggcttgtgacatctagaaggattgctgacaagtatgagcacttgatcaaggccaatccagcatagaaaattgatagcataaaagaaacagtatttttggatatgtttgccgatgttagccattcaaaaattaaaagagctaaatctatagttatgaagagagtgtatgaagctgcaaaggaagaatatcctaggcttttttataaccaactagagatacttaggagtaatcccggtagcactgttgcagtatgcttgaatccagagtacaacacacctgtttttgaaagaatttatatgctttgatgcttgcaagaagggatttatagctgggtgtagaaaggtgatagatgaataatgtgaataagaagtgtgtactaattgtataacgcactattgtagctggtcatgccatgcacgtcgttaattgtaaattgtcgataaataacaattcttttgctttaggaatagtatgattaggtcgtgtccttttagttgtattttctccaacttcatgaaaaaacatcaatatttaccaacatacctcagcattaggagaatactcatcttcaccagaccaacaatctaagcttgactttgagcaaataatatcagaggttgtcattacaattcccttcttccttgtttcatcccaatcaaccagaaaccccgagcagtgtgctaatggttttcctcctacaaatatacatacatacatatatatataatatcagcaaacaaataaaattttctattatatcaaataagagatgtgaaaactatgtaccaatggatgaagaaagtcctaaaatgaattttgcagcaccaaggactgctttctttgcaggttcatagatgtccaacaactttgggtccgaaagacacaaagatttacttgagttaagtgtgggcaggctcagctgacgagctacaagaccatcaatgcataagtacatgtcaatttagagttagaggaataatttttttaatcttgcaaaacattttttattaaagagaaaacgcattaagaaagtaacactaaaaaaatcctccttttttctattagatggagggtggtactgttctcaacttttgacttacaccatcattaacaatgagttatgccaaatctgcattatatgtcaacagcataaagaagaaaatgaaagaaaggaacattggcatatacaatatacatagtgtacaggtcagtcaactaatttatagagattgctaggagctaaataaggtcactagctgtcgatacaggatatgcacgatctgtataatcaatcaaccataaaggtatatcccaacagaaaagaaggaaaactggactgaaaattacctctcttttcttcgaattcctcacgtctcttctggtaagcatcaacaatgtccatgtcaggtggctcaaggatctcttgaccatcagagtcatacccactgaatttgaaaggtaataagggcatgtggagtggagagctcggtgcagaagatacctcctcctcctcctccccttcattcatcttctctggcaccttttcctctccatcctcacaactatgatcggcctcgatcatttttctcctcctcttcatcctttgatctcgctcagatgatggtgaagcaggtgcagatcgggagcaatgcgatcgccccttgctgtcttgctcattaccacggccacgcacagtcctcaggagctcctgcaaccctggctgccgccttgttgcccttgaccgagtgttcctcaaccttggcacatcgtcctcttccgcagcaacaggtgccatactctggggttgctcaattttcctgcagctgcatatgtagaatttgcaaatttagaggaaaggcatatatgtcgtgcttttctgaaagcatgattgtactccctccaagttgaaaataattgttgttttgaacaagggtatggtctctaaaaaataactttgaccactatttagtttcatattataagactttctagccatgtccacattcatatatacgttaatgaaggaaaaaaattgaaaatatacatttttttaaatattttgcgtttatatatctgcatgaaaaatatttgcacaaatataccttcaccgcacggcggggacgcgggaccgagtggtgccgctcttccattctgcgggaccggcggtcgcgtagaacggccgtgcggcaccgtctcgctcccgcggcgcggaagtgcggcaccgcctccctctcgcgcccacgcgtcctgagacggtcccgcgtctccgttgtgcgggaccgtgccggtcgcgcgtcgccaatgcgcgggaccgcgccgatcgcgcttcacggttgcgcgggacggctcgttcccgtcctctgccacgcgcttattatatgacagcgaatttatactgcgtggcactatttaggactgtttttttgtactgtttgtcactgttttggcactgttcatgggcgatcccgcggttccaatgtgcggaagcgccccatgcacagtacgaaacagtgttgcacagtgcgaaaacagtgtccaaacacttcaacagtgttcaacagtacgcagagtataaaaatcgctagcacacacggtgccgcgtattggaaccgcgggaccgctacagtcccgcgttttggatgtgtgcatccgtataggacgtgcagagttcatagtgagggctgcggaactgtgggtgggccaatgagtctatgcgcgtatgtacctgcattcgtgatcatgcttatgaacgtgggtaatggtaaaacttcttataatatgacacgtacgaagtattacactattttccactgtatccatacctggtttgcttccccttagggatttaacctccaagaaccgaacaagccctgacggggctgagccgaagaggctattctatgaaatctatagaaggaggaggaggaggagggagaaaggtgatgtcagcggaggaggaggatgagcagcagcgtcggcgtcagcggcgagactactcatcaatcttgcccgccaccgccaccgccgccgcagcagcacagcgtccgccagaaatcctagccctagacatggaagaggaggggagaggggaaggggagaaactcaccggagagaaggtggccaccgtcttggtcgccgtcgcctccgacttgcgcggcaccgcgccggccgccgcagcgtcgccctcgcccacgagagggcttaaccgaacgcaaatctcgcataggccgggattctttccacaccgggttgttgggccgttacccgggccattcccagcccaaccgaacatggcccgaaaccaaagccaggccgcctcgacggaggctattctaggatagcgacccaatctggcctaagagatagatgggcctgaaatgcgccgatggtcaggcctgccacatcaccacttcacttggccctaatactccttttttagggcccatctcaggataccgagttgctaccccccgacccggcggccagatcgcgagctgggaagaggcggcggcggcgatgagcgcgggggtgggcgggctgcggcagctgctggcggcggcggtgacgacgggggtggcggaggcgcgggcggcgatcttcgggcacgcgctgaacccgacggggaagcgcgcggcgaccaagctgctgcggaagaagatggtcggcgagcagctcgcgcagtggtacccctacgacatcaagcgcgacgacccgctcgtcatggcgcgcgaggagaaggcgtaagtgctccccatccctccacttgagctgtactagcttgcacgctgcctggttgtgcccaccatgtgttcgttcatttgcttcacggggagggaggaggtctgggttacgcccaggacgtgtttgctgatatgcctaggtgacgaactataagagaagtatccaggatttctgctctgttggggggcagtttctgtgtcatgtgctcgccaactgtttgttgatatgcgtgagaggtggtgacttctgttggatcatgcctgataggtgcttgacgatatgcgtcaccaacgcgacttttgttgctcgattcgtcctgtgttactcatccgtgcagccatggtagatttaccggttgtctgttgtgttgagtaccatggaattttaccgatttccacttgctaggtgcataatcctttggtagggaattgctgattgtggtatgattaggtgaggttgtggatccgttgggtttgaaatgagtagtattatcactgcactcaccactgttcttggcgcactgcgaatattattggttggttttgataatttgatggctttgtagctttgttcgtcttgagggaacaagttcaagccttggtttctgtttacagtggattcattagtcaccaattgtagtgaattgaacttccacatccatgatatatataaccaccgaaggttgagttcatcttgcccaactttgaccccaaattctcttgaatattgtgttgttataatctgatagaaatgattgatataatctttaccactcgagttatgctgtacagtatgtatgtggattacatttagttgattatcattgtatttactgtttttaaatgtacggctaaagtacagaaggtgttcctgctattcttgtcaatttgattttatcgccatttccccctttatgccttctgctttttaactcgtatacaatgataacatggaattttgtaattaacatcacatctctcttttgtaggcgtttgtcaaagctggaaatgcttaagcgtcgcgggaagggtcctccaaagaagggccagggaaggcgtgcggtcaagagaagcaaatagttgccttaattctgcatacatcagttcctggcgttcatcctgtttgggcgctgaaatatttcgttgttgtcagcaatgtactctttctagtaggtcaaacaagatccattggcaatgaaatttgctttccttcatcataaaaccgatgtatttgtgctgccggcatgaatgcaagacaattttctattgattgttctgttgccataaatttagctttggctcaaaagattgcatttgagtgtacacttgttaaccttagctctgtcctctctttcttctcatatacagaattcgtattttggtattgaaatgctacaatatgtgcaatccttttcttgcatgcaaagctcaattttggcagtacaatgaaggctcaattttgccagtacaaaagaaagtatgaacatggctggttctctattcagctaaaaagaaaggaaaaaattatcataaatctgcaatctgatctgatctcatctgatcaacaaattgcatttcttacatttggactcactcacatcctaaaaactgatcctatcatcactacagtcattcacacgaggacacgcaacgccaaagctcctcaatcgccggcgaccttgtccggttcaggcgacacgtccgccgtcaccggcggcggcgccggcctgaccctcctccgcgtggcgagcacggtcatgccgccggcgaggcggaccgtgtaggtgcggtcgttgcggatggtgaccgtgccgccgcccacccacgcgccgttccggagcacctccaccgccgtccccggcggcagcagcggcggcagcggcgtctccttcttcttcttcttcgccttcttgctccccgccgccgccgccgcttctccgccgccgcgcggttgctgcgatcccttcgtcttccacggcggcgggctcttcttcctcgccaccatagctcgcgatcgatcgatcgcgagctctgatcagtgaaaaatcaatggaggagacgagggggctcgtggatttcgtggagtatttgtaggcggcttttgctcgctctcgcggggtgaatcggagtccgactcggattgtgttggacgacacgttacgtagcgctacgctacgtaggaacgaacgaacgacgcggacgcgcgctcggtagatcgatgctaccgactcttgacacgatgtacgtgacgggcaaagccaatgccattaagccagccgtgcactgcaactggttggtacatgtatgccacggacgccatggcgacgaactccgacatttctgcaagtccgagttgtcgctgctgtcgtgtacaaggcacgtaggtttttgcttcatattttactctttatatagctgtgttagttctatagctgttaggaagaagcacatcgagataaaaaatctgtcatttttcatgagcacgtttacctaactgcaaaaatagtatacaaattaatatatattttctaagtatgaaattattattactcaattaattgtatgctaatgatttatctcgttttacacatcattttaatcctctccaatccttttctctcaaacacacttaatcgcaatcaaaatatatattttagaagttgattttcatgtttttattatagtttactttttagcatagtcactaggaacaataagcgttacgaacttataattaggtttaggcaaaacggcttagaatcagaacgaagcatgaaaaaaaaaagaaggaaaaagtgagaagaggtctcaaacaaaagtaggcgcttctcctctccggctaaatctcgccgtgcacggcgtcgacgcaccggccgccgtcgaacaccgcggcgccgctcccgttgcgcgccagcgcggcggccgggaagctgagcacgcacgcgaagtcgctctcggcgccgttctgcacggtggcgacgtccaccttgatgacgtaccacccggccgccctgtcccgcgcgagcgccgccgccacggcgcgcgcgcggcggccgggcggcacgcgctgcgtccccgcccacgccgccgcacgggcgtcgccggcgccggcgccgcgcgccgtgatcccggggagcgccgcggcgtcgccgagccgctgcccggcgtacgacggcgccgcccggagcgccgtgcaccgccacgtgtagagcccgcccgggttgtcgaaccggagcgtcgccgagaggttgtacgccacggcgggcgccgcggcgtcgaaggcgaggaggcggagctcggcggaggcgacgacggggacgacgtggtgcggccggaggagcagccgcggcagcagcgacggcgcgaggacgagtaccgccaggagcacggccagcggcgcgaggcacgccgcggtggcggccgcggccgccgccacgcactgccgtcgccgtgcgctcgccggcggcgcgggtggctgatcggtggacatggcgtacacccaaggggagtggattgcaaatttgcaatttgcaatttgcaaagctgcaaatgtgctaatgagcaagcaatgcagaatagtggggctttgctttgctgtgctctcctcttctccttgaaagagtcgaactttttttttttcttctccttgaaagaatagaagcaccattgcaaaagcaaaaggagaggaaccaaccagtgcactgcacacatcttgttgcagcagaccatgtaatttgacaacgcagcatactgatgattccatgattaatccagcacttttgctttaacagaataataaattaacataccagaaaattaaaaaggagagattccaggagagagaatttagttttggttccgatcaaaacttttacatgaatgaatatatatgacaagtgcgcaaaaacaatgagactctaggaccagcgaacaaaaacaaaattggcactaggcctcgttccattattatgtttctgctaaatttctgatccggttgggctcccgtgattgctaaagtcatcgtcgagagatctcctcgtcgattcccacagctgagactcgattcccagcttcctcagctcagtaagtcctctctcaacttgtttacataattttgcaaacaagaaaagcatcagataaagtaagcaatttagccggtaaattttgtacaagacagtcaaaacgagaagtatatgatttcaaactttgaacgaatagtgcaaaggatggcagactttgagacaagagtttcatcattgttcagagaggagattaccttctatgatatcgatcgtagaaactggatgattgccttgttctatccaaaactgtagccgctcatcagctatatcttcttctatgtcatgacttttggcccgtctccagaagtaggttaaccatgactgccatatgtattcatgagttcttgtacataccagttctgaccgaaaacgaatttttgtgcaacatcacatcgattccaggagaaaacaaaatgccagagtggtttttcacctgcttgaagcgtacgtcgtcttgctcttcctcgcttaattctaggaccaatgacagcatatgtaattagaaagtgaaattgttattcccgagctatggatgtaaaaaggaatattagtaaagtagaactaacctaatgactctggagggttctggccttcagaagatggacctgcagtaattggaaacttaagtcatagtagtaaaactacacgtcacgcattgctgcaggccattgatgtgcgtaataaagttgcaatattcagactggaagttgtattcatctaatagaatcaggtcaacatagcgacatagtaatttttttgaagtctcagtgaattgtgcagggatgattctagaaagcagttctaatcacaataaactgcaattcttcagcacattaaatattatctaatattttgttgtgaagttatttcatatgcaacatctgaataaatgagctatcttgtaaatacggttttgttcatggtatcacaatcagtcagtgtatcacttctcatcaggaacgagggaattggtataaccagctctcaaaatcccaagctatgctatgtgttaaacatcaaattgtcggtaccctcacagtgaggctcgcatacattccccatgtactgaatattaagaaaaaaaaatattttatgagtttatcttgatagagagaaatatttcgagataagagacctgggaatctcataaaacaaaaatattataagaaaagaataagaaatgagtacattttggagaagccacctgagagaggtctgacgcgtcgatgttctgataaagcaagcatgactgcgtcctctaccttcaaaggggatattaaattattgagaccgaaacccaaataaaaataatagttctctaccattccgtgggaatatgtaaatgaaaattcgttgacacatatattgcatctaatatatacaacacaatgataaagctagtcaatctaatacttcctctgtttcataatgtaagactttctaacattgcccacattcatatagatattaatgaatctagacatatatgtgtgtctagattcactaacatttatatgaacatgggcaatactagaaagtcttacattatgaaacggagggagtagtagtaatagtctagtagcactcttaagtttcatacatcactttgcatttcactaattacacaaaaaagtgatgcatgaatagtgaattagcagtctttgtatcaactgatgagactgaaaccaaatcaaaatattttgaactaacttcatcaacactaaaactgactttaaaaaaaatgagagaattgacagagataactttcacattctaggaaaaattcattgcaaatttatgaacagaaagaaaatgaaagatgaacaaaatattcaag

SEQ ID NO: 72334 - DNA, 8887 bp, Oryza sativa
  unsure (1)..(8887): unsure at all n locations
tcggcagcggcgaaggcaagccggtcggtgaagacgtagacgcccaacaacggcggcataaaggccagccgtgcaggcggaaacaccagtgggcagcggacgaggcggccggtcggtgaagacgtagacgcccaacaacggcagcataaaggccagccgtgcaggcggaaacaccagtcggcagcggacgaggcggccggtcggtgaagacgtagacgcccaacaacggcagcataaaggccagccgtgcaggcggaaacaccagtcggcggcggtcgaggcggccggtcggtgaagacgtagacgcccaacaacggcggcataaaggccagccgtgcaggcggaaacaccagtcggcagtggacgaggcggccggtcggtgaagacgtagacgcccaacaacggcagcataataggccagccgtgcaggcggaaacaccagtcggcggcggtcgaggcgagccggtggtgacgttctgactgatccattcctggagcgtaagagataagcttaaagccatgaatcccttttatgcatatctggatctggatcctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacgtccaacaacggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccaatcggcggcgacggaggcaggccggcggtgaagtcgtagacgcccaacagcggcggcataataggcatgccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccactcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgacggcataataggccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggctggccggcggtgaagatgacgatgcccatcaacggtggtgtgaccaaccgaccgtataggcggggacaccagtcggcggcgacggaggcaggccggnnnnnnnnnnnnnnnnnnnnnnngcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccagcacaaagttccatcgcacttctcgacggaaaactcgacgcagcccctacctggcgcgccaactgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatgatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacacgtggcgagacaccatttccgggcgcccgagcgaggcgtcaacgatggccaactgccggcgagcgcgaggcggcggtcggacgaatctcgtgttcctttcgctccgtggtggcgcgtcctaccgcggtactcgctacctcccaaaatataatgattttaaactataataaggtctctaaaatataaaatattagtttgactaccaatatctgtaaaactagtattgtaaaactagtattttaaggtaaaaaaattacatattataatagtttgtttaatgataaatctaataccatcaattttacatgattgatcttttttaaatttttttactattaataattaaagtttaaattttttgactttttttgcggtggttaaattttttgacttgctactctgctacaaaataattagtatattttaagacggaggtgtacttgatacgtaccacgacaccggggcagttggtcccccaatcacggccgtttgcttacccgataaggaaaaagagttgggaggagacacaactcgcccatgcactgcacagagagcggctggttggtcaccacggtagcgtacacgaacacggtcgatcgggagacgacagacgagacgccatgcatgttcgcggccgctcgccggccggtgttagcggtggccggtgaccgggtgtctgaaatcctatccgatctccttgggaaccggagccccatgcgcgaacatgagcatcacaacgtctgaacatgacgggaacgtggctggggtccgtcccttcccttcgcagcccgaaatgcgcaacgtgctgcagatcagtggttgattactccatgcttgtttatgtgcaccaccggggaccagtgagtagatcacgtgttaatcggccgcacacactgacgggatagtgccgtactagaatcatcggcactggtgtacgaagcgctactgtagtagttgccgcttttcaccgatggataccagggaaatccaacgtgcaatctgccgcgaggtttaccgggcggcgggcggcgaggtcggcaaattttgcccgagacgcgggcagtcggcagtgtggccaactccgcgtgaatttcttttgcccactcgggggaggtttgcttccgcgatttcgcctccgatcctgcagttgcttggcttgagcggccacttctccgctccgcttgctgctgtggcctgtggcatgtccgcgctgtatgtgcagcgtcagcgcggctcgcgcaacacgcgtctgttgcgtactatctccccaccttgttggttgatggccacatctcacgccttccagtctcgccggtgtcctggtgtgccctgctgacccaatgaacgcacagtagcatcgttttgctcatcgaagagccgaagatatgtccaggcagctacagattgtctatttgtctactttttcttttgaaagagaattactaaatgtcaattaaaaaaaatctatctttgcctgtgagcattgctagtggccggtgtctactagctagccaagagccaaaaatgggtgatccaatagctgtaggacactgcgccgaccggagcccatctcccacagattccagtcgattcctcttatcgtctcctattatttttttcccacgagaattcagatggtatcgacaatatcctagagtaggctccgtcctcgtgcaccaattattcatgcacgcaataataatttgaatagtgcaactatgattaattggaaggattagcttgttgccctacgcaacgcacaaccccaaacccaactgacggggttaatatctatcaccagcacgactaatgacatgtcaattaaactttgattatccgagtcatcatcgaatggctttcttatctcgcaactcgcacattgctttttcagtgacccaaagggagctctcacaaagtcccaaaaggaaagcatttgactctgagttagtgcgagccacgttttgccatttttctgattgcaagatgctttcccttcctgactgacccaggagagcttcaccgattgctaagcaacaaccctgtagcttcgtcttatggattttctttttctgtaatcacatgggggtatggacttgtagctggtgaagtagataagctgcttaccagataagatacttcacgagaaaacagtattatattaaaacagatactttcacgagaacatgaaggcaattgtgactgactggctatatatactccaggatgaacccattatactatccctccatctcaaacaatagagcgtatttttgttttgttaggacagggaatactctattatgatataattctcacaaaattaatatgctttgcacgactgatcattgttttacatggcattgatccacaggtaaagtatgtatgaagaaaagaagctatgtatcaacagctcattcatgtttctgtgcccactgagatcaccacctcaccgtcagtcccatgatcccatcctgaaacttggacaggcttaacaacagtcagtcagcagaaggcagtgacgtgaagccgtcaactgggcaagagaaaaatcaccatctagatcatggcgtccaagcaaggtagaccgcagacatctctcttcaaaactgatgccccgcacattcctggcggctacacactgaggagaacatcaccctcgtcgaccatgttcatatgcaaagagctcctagatctggtgcaactttagaatcgtgatcccggatggctggtgtttcatcttgttctttcttcttttgcttcttccccttctggcctttcccttggccacctttggtcctgatagtaaagcacattaagcagatagtattagtacataacacttccagcattgtgttaaacatgcaatgcaactaacctccctagtgaaaaaggaaatagtaatcaggtcggtgactttaaggcatatgggataagtgcatattttgcagcaatactgttaaggtttcataggccagatacaacagcagcaatgcactatgcaaatacgctggaaatattgatttcaccccccaaaaattccatttgaaagaatgcttacaatgcgaacagcaggacataagttcagttgtagaatagaatatggtaaaagacaaacaaaaggacagaaacattataaaggggattagctatatttaagacaccacattttccaccaaaaaacaaaaaaaaattaaaaccaaatctcaatacttacaccatattttttgcagcacacactatataagagaattaggatgaaaacaattaattacctacttgaaagaggagatagtagagcgaaacatacttacataggagtataaaagaatggtagcaatccgaatgggaaaaaaatgactgaaatcaagtcaaaaatgtggcgccatatttttagcaaaaccattataaagccatactttggaggttctctcgatggtgcagttgtttttggaggttctctcgatgctacagttgtggctaaattacaagaaggcttgtgcttcctagcagatccacaagagcattccttggtttttgactttccctgtgcaaaagaataaagggataattcctatttattccttccaacatagtattttaacaaggcaattcaatgtttggaaactattaagagtcgtccacatgatagttacctttttagaatgtgaactgttgtgtttctgagctgtttcgcctttgctagaacagtccttttcttctttcttgtgttcatccagttgactctcatcctgcttcatgctaagctcatcctctatggtctgtacatactctgctgatccaggtaatatacacaataaaggaaatgagttcagtgcatggccaatgtaaaacaaatattacttgaacaggtatgagaaattggatattaattgaaacagttaatgccctcagtttacaaaatgaactacttgtgcttctaaaatagtggtctccaacaataaccagccaaacaaaaatgttacctcctacagggtggttagatagcacactaactcttagtacagatatacctcctacagggtatgatattgacctttggcaattgcagaggaactgaacatggaaaacacccagcacagcaactggtatgggctgtttggtgggagcttaaaattctgagaaacagctagttggtaaccggcatctagttcattttctggattctatagctaagaatctggattgtttgagagagctgaaaattctgggagaagctgcagtagctagaagctctccaacaaggccgtagtcttacttgagctttctataacaccgttcatgcttcttggtactgttatcatattttgatgatcttaaaaataaccagtaaatggtaaatatcatattagtgaggcataaacccaaaatgccatgagcacaacacccagtataggttttacctactagatttatgctactgaattgaggggtgtgcatgaaacgcttgctcaggtgaggcagctcatgtttggcaagaatatgaataggattaaacaatgaaaactcaatctatggaatcccagaagtactccaaatttcaccataaatttcattaattgtcataagctgaagtcctcaagaaagataaggatgagattcattcatagggacagccactttagacttcagaataatcaaatgtttaccatcacatgcatagtccagataaggatctccatccgcatcatcagaacccagtattagttgctcagctaacatgtactctatagcagcatcaatgtcaccatccatgtctttcaaaacctatgtgatgtggcattgaccattaatatataatgactgattggctgctacggtcagcctaggctcgcagttgcaatacaagaaagtcgatttgttgtataattcatacctgttcaactgcagcgatattagaacatccagttccagccatcaccaatttaaccgatatatgatcatactttgatctgtctgaagatttcttcaggtcctttgcttttgtttgagcattattgcttgtgctagctacattggcatctgcctgtaatttcataacggataaaattaagattagtaacagagcaagttgagctacaacaggatctcactgtccttccagggacacaaaacaaccaacagtttacaatttggacagtgagaaaccttgataataactggcattgcaggaccttgacatggatcttccctcagtctgacactattgtagtgctcaccctgatgatacgatctatattggaatcaaaacaaaggaacatgagaatgtatgtccttttactgccagtattagcatattagtttaaaacagcagaacacacattaacttacaaatgaatcatactggtagcttcacgatcagaaaagtttcttatgtaccatcgtggtgagttaagctgcaaatcattcagtaatggtacaggcatcaatcaaatgttacagtacgttctcttctatagaagaaaggctataatatgaaaatgagtacgaaaaataacagagaaccatcaggggatatataagcagcacattgatctatatcacccatgtgtttcaaaatacagact

SEQ ID NO: 72335 - DNA, 13765 bp, Oryza sativa
ctcacctaaccacatttattgcggttgggctgagcgtgtcacgccgtatgtaacgcagtgcagtgcactcgtttatccggtctatgaccagtcacagaccggtcagatcgcgggttaggtggcgacaggcgatctgacgcacacctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtaggttgctaagctgacacgtggtggacaagaatgaccgacgtgactggtctgataccggtcatgtcgtcagcagacaaccacgattccacgtcgcgcctgcttccggcggaagtggaggtaggtatgggccgtcccatcaaaaggtcattcggacggcaaccatacaagtctccgtctgtttatgaaaaggtggggtaagtccccacaaaaaagagagaaatggtgcatgtggtatccccttaagatataaaaggaggaccttgcccactgagatgagggagtagactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaccaggtgtcgggtttttccaagtcttttgtaaaacccaagttttaccgatcgttggatattttaaatttgaggggaggacttcgacatgcgtgtccaaaggcccgtacatcgaagtacagcagtcgacaaatgaggtttaagtgttcaattattcaaggagggtaattgcagcaattaggattagggccggtaggctatctcgcaagccgcggccaaatttcttgtgttaatcctatccatgcattatttgcggaaaagaaatacttagatttaaattataggtgcaagatgatcaaaggtgacttgccttgctcgagatcttgagcttgatcctcgaaatccgcgcactccgggtcttcgggcttcgaagctacacgcgaacgagacgactcaacaaacggcggaattaaagccctattattgacctctaagcgtgccattagatagatctcgagatttgaggatttttggaagttgaacggagtcaaacggatgtacggttgagaagatattgaatttctaagattattggatttttggtctaaagaaaaaaggatttaattaaacccctttttggaaaagaaaagagggagggagggagattgaactttcctcgggcggctagggcgcggcttgagagaaatgggcaactcggccgcgctaaatgggccggccggcccgagagagcatggcccattagggcgcgcgggaggaaaggggagagagagccggtggtccgggctcacctcgcgtggtcccgagtgggacccgcttgtcggcggctcggctcaccaagagcgaggtgcatgcggcgcgacactagggttggggggtgggtgcggtgcacgcgtgtggctcgcggtggacgcggcgcgcgggtggcccacgcgcagcctcttggctctccgtgggccgcgcgcacgcgagcagggacggaaggattggctgaccggggtcagcttgacccggtccggccgagctagctctgacgtggcgccttcgtggctgccacgcgggctggcgggaggaagacaaaggcgctggctgctaatggacggcgggcggcggcggtttctccgggacaccgtgcgacgacgagggcgacggggtgtacaccggaatgacaaggggaaaagagagggagcgagccaacggctcggattcacctgagggggttcgacggcggcggattgtggcggcggcaaccggtggcgagaaagggggatatcggcgacggcgtgacgggagatcgattcggattggacggaacatcgccgaggaagtccggcgacgggcggctactaccgagcgcggcggtgacggcggcgagcctactgcgagcggcggcaacggtcagggcggcgcaggctagctacggggagactacacaagctactgctcgagtctgaggggaggaggaagagcgaggagggagaacgggaaggtgttctaccgagacgagacgggcgctgtgacgagaggccgacggcacgagagtgatctctccggcctcgggccggggaagaggaagaagacgagcgcccggagtccccttcacgcgtccttcgcacacaccggctctcccggtgctttggcgacaaacggcggaggtgcaagcagggcggagcgacgatggcgcggcaggcgcgggctcaggcgcggtaggtgctgatggcggcggcgactagccggtcggccaccacggcgcgcgcgcgggaagcaacgggtggcacggcgatttgagcggcgtcggcgggagcggcatcgagagggagcgagagcagagagaggggggaaagaaagagagagagcgagctctctcttgctcagggctcgagcggcgcacgtgcctcgcacgtgcgggcaaggatggaggggagaggagagatgggctgagaggaaatggccggggagaagagatcggcccacgaactcgagggaggcaaaatagactttttcgagaagatttgattcgggacagattgaggttagggtttggattcgacgatggattggggatttgagatctggaatggcacggacactggacaacaaacaaagaaacaattttcgcatttaggatttttaagagatagttttcccactaggcgccacgacgggacggacgctacaggtgcaaagttgtaaactcagattctctgctgagaagaatcttgacacttcaatagtactaccatacctagttaagctttgttgcctgatgggtgttactttattcgttgctgcttagtatccccctattgtttgacatttctacggttcttgcttttctgtagagtctgtactaataccactccatttgttgggcttgttctgttcttttgtgagacaaacctgtactagcactactattatatctgctgagctactgaatcactgatgtactttgcaaacatctcttagatcaagggagcttaggtagacataattaagctgtatcatgagacctaacagtctaacaaagcaacgaaaacctttagtagaaatagcaactagtgctggggagaataattctactttggggaagcccagcacgcatggaaccctggaagtggatagtatgatactccagcatgcagtttcccttttcttgccttccgtgttggtccaggaatcgcccaatttggcgttttatattgaaccatttggtctctcttttccattacgaggagagggatcaagttgtgcccaatgggcagcgaagaatgatcatgtaaagactcttctctggtttctaacttcctatggcttcttggttaactctcctcttgctgtaagcatgcagtgagcctgacgcttcaaaagatgcttaaatcttgggcacactagtagtaggctattggtgatttggaatgtacaagattcttgttatggggtgatctacaactataatggtgtgagtacttgtgcctacgtttgacccttcctagtttgtggtcgcaggaatgcaagttgaagaacctgaaaaatgcatgcagtacggaacaatcgaaatgctggctgctttatttccaggaattgagacttgtggagtcggaaagcaggtgttcatgattttacgtacaatttttaagtagtttctgttctcttatgctggtaacttggttggggtccgattgtattttgcagtggcagtcgtacatgtactcaattgttatgttcaacccatcatgcataatactagtagtatatgcaactattcaaacccccatttaaatacagggaacattttctgatttttgtaggaaccgaaccttttcaaaatagtttttaaaattctttctaggagaattaacatttcctgtgttttgataatggcagcagcctacctaaactttagtcctgttttcatcacagtcagccaccatgcaatgatagacataaaactataccttaaatcagtcaactataccttaaacttaggaagagaagttgccaagcctgtgggagcctcagtgcgtgtccagagaataatttctttcactttctttaactaattttgctactactcctgccatagatagcaaccccggacgtgcacccaaccaacctacacttaccagccgcattggatgccgttgctccccacacacaccgaaccaacggtgagcatgtgacctcagggtgggccataccctgacgctgccaactggaagattttggccaaaaaccgtgtttcctccattgttaattaccctgaggtgacatggcaaccataagtttttgctatgggtacatggaccaatctgcgtcttattgttttggttttattctgggaaaggtcaggctggttttttaagggctggaatgacaacgataatgatatccataggagtatgataagtaggcgtgagataagatatgacgttttaagtttccatcaactatatattatcttgtagatttgtcgagatgatagtgaacggaaggtttttctttttttctagtgctgttatcatttgttgtcataaccatgttcacatgttatgtcagtaaagtgtattataaatactatagtttaggagaaaagtaaacttaactataaaaagatattttttatagtcactcctacagtcatgcatatcaagttgcgccattattcgtttgtctgatactttcttcggaacaaaacaatcatttgttacagcacaacaccaaaccaccctcggtcatgataatgctagctctttatcgacagcacctctagaacagcaatatgtatttgatcgatagatcgagattctatgtacgaattggtccccctccttaattaaaaccaaccaaaaaaatcagctcatacaagattaacctatgggaaatttgctattggtaaaaccaaattatatttctcctttttctcagttttctctcctatatggtccccaccttgcagttatataatcggtgctccagatgtaggcatacaaaattgcaataaagaatggttttgtaggcgtcgcttggaacaaggaggaggattaaagaacatcccccagttggaatgatgcagtcgaggggggcagcagcggaagcgacggcggggaggagccgaggaggctgcaggcgcagcgagcagcagcagcttcttcgctcggcggaggcaccgagggaggaggcgcgtggtagccatgcttctcccctcatcgtcttcttattcctacgcctccaaaggtcataatccaaacctttctcttctcccttcctagacgatgtagcagtagctatacccctgatcttgtgcaagtgctgagaccactgggtaatcttggtttcttggagcatatgtttgtttgctgatcttgtgcaagtgctgagaccactgggtaatcttggtttcttggagcatatgtttgtttgagtgcgtgttcttgatctccaatctcctgggtagtttgtcatgcttgacttttcgtagtcaaagaacgattcttttataggattgtaatggagcatattcttgatgccgaggcttattacgcttagtgtttgtggatttgactggatgcatgtcgttttggcacaaagattgattgagtatggagattgttgactagtcgtgtgtggcttgtaaggctactattggatgtctttggggctctagggaggatctctcaagtctcagtgtcagactcgatggcagcagttgttgtcatgcatgttcttgggaatttagatcatatatcatcatcatataagcttgtgtttatcacttgatgtgggaacatttctagtgctgcctttctctcgaccatatttgaggacgagtgatgtgttgatgactgatgaagtgatgatatactcggactatagaaattcagtccacctattctgtgtgttcctatagataatttcctgctggttaatactctttatatttgttgtatctttaggttgtgttgtatggatttatttggtatattttgcttcggttgtattttcccagtgctattcatatacagtacatgacagtcttgcttttttttttctgaaggaagtttttggtttgttgatctttgtctacaaaacatagctaaatatgggacaaaggaactgtatttttccgacttttaagaattaaaatgacagatcaatgaaatcttgtgtgttttagctctgccaattagctaaacttgggtcatatctgaggcttactcgaggaaaacaccaagatagacattatgaacttggcagttggcacattgaacaaacagttcattttgtggcacgtgcatttattatctagcatattagatgagtttattagtttcaattaagacatcaattagaaagattggaggaatattatttctttggcaagcatcttcttcaatgttagcataagtacaacctctagttacaaagaaacaatgctgccctcaaacatttttgtgttagaccattcattttaactattctttttttgaaaccgatcattttaactattctctccgtcccaaaatttagcgactagtcctaggttgctatattttgggatggagggagtagaattttcttgacctttttgagagtccaaagcactcactaaactcagaatgtaccacattcaagccctggtgaagcacatgtgcaaatttccacactgaaacatgcacaaatatgtatccatgtgtgcttcttaaattggacaacatcaacacttgtagtacctagcagtcgggccatttcagaaagtagaaaattttattttgttttgtttgcctaaacgtagtaaataagaagcttgttgataaacgcaagattcatgtcctgtcctggctgattcactaaacagatagtagtatcttcaagaagcaactaaatatgtattcctgaaaaactaggtagaagggacaagatattgacataaatttgtggaggtaaatttaaaacattgcttgctacgcatgagtgatacctgcttataagcataagcaataatttgaattgaaaacttaattttcgagttgattttggtatattttcatcatactagtttattttacagcatttgcctttatatcactaagaacacatatataaaagttttacccataaattattttttaatcactaataaaccgtttcacttataataagtataagcgaaacgacgaggctgctaaattctacacaagtactgaatctaaactttctgaggatgttattctcttttgttgtttatctggtttggataatgccaggatacttcctgtgtttcctcatgattccttttgtaatttatcaacctacactacattttcctgctgtcaccaggtgactccttcaggagaactgttgatggtcctatgaggtcaacgttgacttttgataataatcattctgtagtgccaagtcaaaacattgattacggccagccaatggtaagatatgctaatggagccaacattagatctggcaaagtcagctcatcctattctttataagtaaccgtgcatctgattattttctgtatatttcacaggcttgcatttcatacccatacaacgattctggttcaggagtttgggcatcctacagttcacgctcggtggtatgttcttctaacaagttctctctcaattctctcaaggtcttcaaacttttgcagaggaagctaacaaactagtagtaacattttttttatcaacatatgtaattataagggtataattcatgcatccaggtcctgcttaggagatcccattatttatctatgatcagtccagcctgatttgatttagtctagaggcttaaaatatgtcacttttcccatttgtcgtaaagaaactgcctggttttgcataaaaatggattgagtcatcaacgtaacctcaacagggtagtatgtctgaagctctttatatagcacaaaaagattacctttgagcattattttaggttttgccaacctcacctgtaaatggtgtaggttgatgcattaaattaaactagtgagaagacataactaatgtctatttgagtaatgcagtcacatgcagttcataattcttaagaactagtactagatatacgtgagtttattcactagatcaatattattcagggagaacatgtagtagttatgcaaaccatgtgcacacacatctcttggggcatccagcttatttttatctatattttcatgggtcttgcctaatcagttgtacttaaaacagttccatcctcaaattgtgggaggaggcacatcgccaagagttcccttgccctccctggagatagcagatgatgggcccatatatgtcaatcccaaacaatatcatggaattcttcgcagaagacaactgcgtgctaagttagaggcccagaataagctcgtcaaaacccgaaaggttcttgccactgccaactgatccattgatgtttttaccttccattgccatctccttgtgcatcttgcattaaccttttaatattgttaaccactctgcttggcttaatattgtaaacaatctccatgtgcagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctgcttccaccttcactgtaacttctgcggcacagaaagacgacgccttcttcgaccgccatggccaccatctcagtagcttctccggccattttggccaggcaagcgcacaaggtggcgtcggcagcatgcataacgggtcacagcagagggttcctgctatgagatgagatgaagagcagcttgcaaatcatcatcatatatggtgtggtctggtccctccttaggcaattcatccttggcttaagtttcatggcttgtttaggacttcagagacgcttcatagtgctgtgcttttgcagcccataagtctgggcttaattgtgatgtgtaatatccatgtattggtgtgatgaagttgtccctgtttgaataaactctttgtctgttggttatacaatgtgttgcaaaactttacagtagtgttgtgcaatgtgcattaggacaaggtctgaaatgcccctcatttttgtgaatcacaaagggtaggatggaaaccggaaaattgtgtcaaaattaacatattggaaatctaggacatgtatatgttgtactaggtggtgttccaactaatttcagcttactatactgtatgatggagggagtagttatttgggacaaatttaaattctaagggcttactcggatcacaggattgtaaaaatataggaatagggaaatcatagtaatatgataggaatgtatgtgtaaaatagatgattgaaaaacacgggaattttatagatatgattggtaaacatgtgttatgtgttcggatagacattggaaaaacataggaaaataaaaaaataaggtaggagtgaatgcaaattttcttttgtttctctattgattccacaggaaaggaattttttcctccgatttttctttgggtcaattcgtgtgaaccgaacaacaggaaacaaaatatttcctacctacagtatttctttgaaaatcctataaaaatccctcgatccgaagaggctccaaaaaaagagctataatttgagacaggaaagtacgtttggtgtattccacaagaccacaactggcttgctgcctgcatgcgcatgaagaaaatatcgctgtctaattgcaagttattcggtgtcaatcctagaaataaaggcgattaaattccatgaatgaaaaatcacacgagttaaacccattccaaaaatcaataagcacagcacacacgctataaaagaaaaccaacattatgtaaaatcgtcaaaaaaaaattccggtaaaaaaaaacattatgtaaaatgaaacattcctctttttcttgattcatcattctcggtaaaatcagagatgaagaacagccacgtattagcgctgctcctcgcctctgtccttctggtgtcaatgtcatcctcaggtaacaatgtaacataggaacactcctctctatctcgctgcagtttgcattttgcaatgaatgttaggaaacgataggcgaacaaacgataaaaaacaatagatcaatcacaaaagacacgagatttaacgtggaaaaccctcccaaaacaggagagaaaaaaccacgggcaatccacgtgataacccacgtgagatcgtgggcattggctccgttcagatcaagactcatgatggcatgacacgcacgctaaaagatgtgagacacataccagggatagcgagaaatctcatctctctcagcacacttgatgcagaaggatacaaatactctggttcaggtggagttgtaaaggtatcgaaaggttctcttgtttacatgattggtgatatgaattctgcaaacttatatgtccttagaggaagtacattacatggttctgttaccgctgctgctgttactaaagatgaacctagtaagactaacctgtggcacatgcgtcttggacatatgagtgaacttggtatggcagaattgatgaagaggaacttgctggatggctgcactcagggtaacatgaagttctgtgagcactgtgtttttggtaagcataagagggtaaaattcaatacctcagttcatcgcaccaaaggtatacttgattatgtacatgctgatttgtgggggccttctcgtaagccctctcttggtggtgctcgttatatgcttaccattattgatgattactctagaaaagtgtggccttatttcctgaaacataaagatgatacatttgctgcttttaaggagtggaaagttatgatagaaaggcaaactgaaagggaggtaaaagtacttcgcactgacaatggtggtgaattttgttcggatgcttttgatgattactgcaggaaggaaggcatcgttaggcatcacatcatcccgtacactccacagcagaatggtgtagctgagcgcatgaacagaaccatcatctccaagtctcgttgcatgctgtccaacgctcgcatgaacaagcgtttttgggcagaggctgctaacactgcctgctacttgatcaacaggtcgccttctatcccacttaataagaaaactcccattgaggtatggtctggtatgcctgcgtttttggatgcactgcttatgctcatgttgataatggaaaattagagcctagagctattaagtgtctatttcttggttatggttcaggagtaaaaggatataagttatggaatcctgaaactaacaagaccttcatgagcaggagtgttgttttcaatgaatctgttatgtttaatgatagcttgcccacagatgtcataccaggtggttcagatgaggagcagcaatatgttagcgtgcaggtggagcacgtggatgatcatgaaactgaaattgttggtaatgatgttaataatactgttcagcactcacctcctgttttgcagcacaagatgaacctattgcccatcgcagaacaaagaggagttgtggagctccagtccgttttattgaggaatgtgatatggtttattatgcttttacttgtgctgaacaagtggagaatactcttgagccagccacatacactgaagctgttgtttctggagaccgtgagaagtggatctcagctatgcaggaggagatgcagtctcttgagaagaatggcacatgggagcttgtgcacttgccaaaacagaagaagcctgttcgttgtaaatggatcttcaagagaaaggagggtttatctcctagcgagcctccgaggtttaaggcaaggttagtagcaaaatgtttcagtcaaattgctggtgttgattataatgatgtgttctctccagttgtaaagcatagttcaattcgcacattcttcagtattgttgctatgtatgatcttgagcttgagcagttagatgtgaagacaacatttttacatggagagcttgaggaggagatatacatggaccagccagaagggttcatagtacctggtaaggaggattatgtttgcaagttgaaaagatctttgtatggtttgaaacagtctcctcgtcaatggtataaaaggtttgattcatttatgttgtcacatggctttaagaggtctgaatttgacagctgtgtgtatattaaatttgttaatggatcacctatatacttgctgttatatattgatgatatgctgattgctgccaagagcaaggaacaaatcactacattgaagaaacagttgagtagtgagtttgatatgaaggatcttggtgctgctaagaaaattctaggtatggaaatcactagagacagaaattctggtttgttatttcttagtcagcaaagctacattaagaaggttcttcagcgttttaacatgcatgatgcaaagcctgttagcactcctattacacctcattttaaattatcagctttacaatgtgctagtactgatgaggatgtagaatacatgtctagagttccatattctagtgctgttggttctttgatgtatgccatggtttgctcccggccagatttatctcatgctatgagtttggttagtagatacatggctaatcctggtaaagaacactggaaagctgttcagtggattttcaggtacctcagaggcacagctgatgcttgcttgaagtttggcaggactgataaggggcttgttggatatgtggattctgattttgctgtagatttggataagagaaggtcactcacaggttatgtgtttaccattggtagttgtgctgtgagttggaaggcaacattgcagcctgttgttgcccagtctaccactgaagcagaatacatggctattgctgaagcatgtaaagaatcagttggctgaagggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtcgtgcaaggtaagctaaaggtatgcaagataagtactcatgataatcctgctgatataatgacaaagcctgttcctgttgctaagtttgagttttgctcaagcttagttggtatagtggtttagcccgagaggctatttggcgccgaaagtgttttttttgtctttgttgtgttcagggtgaaggattgattcatgctacaagaaggaatttgtctcaaggtggagtttgttga

SEQ ID NO: 72336 - DNA, 4423 bp, Oryza sativa
tcattaatttacaaagctttttagatatgattttcgcgagtttcaaacacttagctcgttttcacatgatatttcccctatacaatgacaaataatgatttggctaatttactacataaacattttgaacctgaaaaactttgagagactctcatctgacgcatttgaaaaatcttcaagagcggcctgaaatgcagggtaaaaattaaagataaatagtacatgaaaaggaatgtgttgatttagcagtgaattacgtacaaaccttcgagtcatttttctgagtaatgattttaagccagcaaagtactggcaatcgagataggttccaacagaattctgatgaaagtatgcagcccaatgattcaaagagagagatccactggagtataaaggtaattgagccgtggaatcaatcgttgcaagtaagaatatacatgcaagtagcctgcaaacctgaaccaagagagttggatttcaacacaagaaccatcaacagtaaaacatatacttgaagacggaaggaaactatagcctgaactcagcaggcactcagagatgataaaattaagaatatgcaatgagcatttaaaacattatactgcatggaaacatgactaaaggaaatcacagacctcctgaaaaagtgagggattctctctggacagcacaaaagctttcagcaaccaaggaacaacatcagacatttgtacactgcagaagcggcagcatatgtccctgaagacagatgaaatgaaaacaacttacacaagtttcacgaagcgctacaattgcaatgtggatatgtgactgatactatagcaagacaatgaaataaccttgactgttctgaaaggaagcccttgagcaaaaacaaactcatactatataatatttctgccctctctgaaataagaaaatcaccagtgctctgatccatgattagtccaaataaattatgctcataagttctataacaatcctgaggaagggatctaaagtacaacaatgatatgcactgccaatagatattatgaattttatgagctccatgcaatcctccatgagcacccaaggcttttgctgtaaaatacaacactcagaagtgagaaaaaaaaactatatgaatatattatataggaatttagtaatgaataaaattcaatcagacttcttaaacaaaaggactatatctgtcaccatcacatgattcaatgcatttcacagtagcaaaagatcatttgatgttcacccgtaacaatctcttcgaatgtataaataaacttaactttatatgaatatcatttggagctaaaagaggatttcccatctcatatgtgtaaaccaacagcatttcacagaaataactgcactcctgctgttcaacagagaactgctcaaaagccaggtatacaaaattgaaaaactggactggtccatgggtcttccataataaaggtatcctcttgaatgttatagcatgttactaaaaaataatagtaaataaatgattaaacatgaaatatatcgaaaataaactagcaaaaacctgaaaacatacacgtaatttatgcgcaaattgtgaagcccttagttgcgcacatgttattacgtcaagtgtgcaatttatttgtttaacacacataataaggagcataaatagagaaaagtacctatttttaacaggatagacacatggttgtgatgccaaacacaatcccatctgaattgcaaaatattctggatggacccagagttgagtgtattcacaaaaaggcaattccaacatccaaatatactgcatgtgtaatctatgctctggtcaacgccatcaaggatacagtttgcttttccacggaccaaagtatctgtggacagattatcgctgcaagataggccattcttacagtgtagctcagttgaagccttttcacctttcatatgagcagttcgcttactagagcgcgtcctagtttttacatgagcttccacattctgttctttagctaaacgtgatgaatttctggttgtccttttaactttaacatccaatggtggacaacattcagaatccttatgtttcagaaattttaatgccgtaaactcattcgagtgatcaccggaagcctgactaaaatttgcacatacagtacatgaaggtaacactccatcatttgcagctaatggttctttcccatatttgctgcagataatgcaagtagttttaagcttatcatatgagtcaacaggagattccaatttggtgccgttcagtttatccagggcagactgatacatgcctagagcattagacaaattgcctgctgactgtttctgaaagtctttctcatatagactccaaaatagatctccagcttgcacatcaagtgatatatccagagttaacttgcagagcttgcacgaaatgaatgtagcattttgtgcaagaagatccctggcatatttaagctcgccctctgcggtgtcccattgctgtctcttgcggtatatttgacctaaaaaatcaggcaacatgaggcagaaggacaaatgacgcaaaaaccaccaaaagcaatatgtacaactgttgtatacttcctccgtttcatattataagactttctagcattgcccacattcatatataatgaatctagacatatatatgtgtcaagattcattattcattaacatttatatgaatgtgggcaatgttagaaagtcttataacctgaaacggaggtagtactatctttggagaagtcccaagaggtccttttcataacttatgaagtgccaaaactaaattacaagtaatagtgcctctttgatcttcgtaacactgatgtaaaagtatatatatacgcacagacctaaaattgataaggaagtatataaacacacatacctaaagctgatgcgaaaaggacaccaaaaaccggcaatccttgaaattgtgatatatcctttcctgttcgtaacaaaacttctgcttcggcaccattaccaatcaattcatgcagcaaagcaacctgaatagttaatgcattacagtgtgagcatcatgcacaaagtttctttttattttaggaagcatcattcccgaagttaagaatgctggccaaatgccaacaatttgtgtgttgcactgtaaaaattatgtctacagccatttgcataccacagtaggcacccatcagcaggttggatgtcacattgacatgacagataggcccacatttatttgactacagtggtgtaccagttccattttttcaatcattaaagagtattgcaatggcctttacgccatgtcattattgtacctgcaaaatgctatcaagatagcactggagtacagtccaaggagtaaggaaagaatctcttgttccagttgatctggtagaatctggccaaatttcagttattgttgatccccatgcttcaagtgaaacagagttttgccctccagaacattgagcttccccacttgtaaacttgccaaaattgaatttgaatttctttcttaggagcttcttgcgtaaatgcaaggcctcttttccgtatgaaaaggcctacaaaaacagaactactaaatgtttatatcacaagaaatctaaaatatcaaccaagacaacaatttagcaatgattcctacaaataaagatcttgcaccaagacatgatatttcaaactggagcaccggtgcaactacctggaaaagttctcctcttgatagaagtctttctgataaatcaaagtacagatagccagctagaaaggttgattgatcatttacagtagcctgtagattcacagtacacaatggttaatagaaaactaaaacagccataattacaatgcaattgtgctgcaaataacaaaacttacatcagaaaccaaagatgatgcgacactatcaacctcatgaacactaccaccgaaaccaaattcccttcgaaaggaaggttcacatgtcgtagaaataaaggaatcaataggccacaatctctggagaaacatacaaagagaaggatggtctcctttaaaacagtttctccaaaattctgtactatggcaatcaacatcaagatgatgctctgcaattgaaataaattgttggtccattgggagatgacaacacgcatgatggaggcgcccattggtaaatagcatggaaaataacttttcagggggtaagttttcttgcttccatataattatcataagcttgcacagatcaaattgaagctcaaagcagccctgatatgtcacagtaaaagaacataactatgttgctaaaaggatagcaattgcatctcatccaaactaggtcgaaaaatctataatgaccttgcttaccttcattgccaacaaatcaaccaaagaacaaagaagtggtacaagattttctgatggctgc

SEQ ID NO: 72337 - DNA, 7101 bp, Oryza sativa
gccccctccagcaccacagaggcgccccctccttcgccaccgccaccggcggctacaacccgacggccgcgcccaccacgccgccgtgcagctacggcgacatgtcgtcgtgctcggccgtcagctcgccggagaccgccaactactacggcgccgaccacgacatggtggcgcgcgaggacgacgtggactacgccgcgctcgccgacatcgacgccttcttccagtcgcccaagtgcatggactactccatgatggacccatgcagcacgttcttctcgccggcgccggagtccctcgccgccgagtgggaggacgaaggtgagatcagcctctggagcttctcctccctcaactgatcgatcgaaccggagatcgatggagaccaaatccatggaggtgatcgatcgatcgaagcctccacactctccagtgatcaccattaagcgcaaattcaattactgactgatatatcagtacgtgaccaagaattggccacggtacaataataatcatataatcattcaattcataactattatctacatatatatatgtagtatatacttaatcaatgtactagtgctactgcttcttgattattttaggctaattctgaattgcgtgggagctctgatgaagctacatgttttaaggcagctttccatggagcaaaactcccctcaattccatgtcataccatgtgtaaaagtggtgttcctgcaattgcaagtaatgaagtataatcaattactatgatgttaattatactcctctcaacttatgtccaaagcataatggtcctttttactagtgcagttatggcatgattggtatctagtcgacgcagaatttccgggatccttacgactgaaattaaattaacttctgtgcgtgtgtctgtggggcccttgtcagtcgtatgcgtctgtcgtatttcagtacccagctttgatccatcgccgtcctctgctgaaaatgctacacttgtcccgcttctctaattgtcaaatccaaaacgttttatttactaatcgagctgatgcggtcaatatttatttttatactgtcacgtatcaactgcagtatgcatctgtatatgtttgcaagaaaagggtatgggcgttgtgagctgtggtcaaaagcaacagagaatttcctttccctatcatgtaaaacagctggatttcgtagcggatcatggcgcgccgcttagattaatcgcagtgtccgtcggagaagaaagcgaccggccaaatctcaaaaaaaaaaagagagggtaaaaacgagaggaggcacgtatcggtctcgtcacgctcgagcccgaatccgcatttcgcggggtaatgcgagttcggatctgaggaaacgagcccgacccgttaaaggcgcgtcgtccagccgcccgaatgcccgatccacctcgtccatagcagcctcgcatccgaacccgagaggccgagacagcctcgcctttgccctactcgtctccttccttccttccgccgccgccgccgccgccgcgagggccatggggtacaccaaggagcagctcctcgcgcgactccaggttggtgccgccgccgccgcccactgggcgccactgctctctacctcccaactcctcgactgttcgctttgcgtcgtttcctggtagtggggatcggctggattggtggtcgtggatgcgccggtgctacggattgtagcgtcggcgagatgcttcccgttccgttctagcttgatttggttttggttagcatagttataaatggaagcgcgatagggcgtttttgctgccgaatttagttgggttgtgctgcggatagtttttttttttttttttaaccccggatgtgcgcatgaatcgaaggccggaattgcccagttatattgtgcgattatcgagaattgtcacatcctatgtgtggcaaactagaattgcttgccttctggcatcacagtggaccgcgactcaatttagtggtattgtcttgtgcaggagctcaacattgaattctcgtgctacgatcacccggttgtgttgacggtggaggaacaggtttgcaaaccgtgaagttcacacttcgttctacaatacttttgatggatttactgtaagtgctaattgaacttccgcaatgttaggccaaacatgttgggcatttaggaggtgctttgagtaaaaatttgctactgaaggtatgtgtcttaccaagtgatggacagttaatttcttggaacctattttcatgtattgatatttttaaattctgagtttcaggacaaaaagcataggctgtacgttgtttctgcccttgctggcaccaaagttgacatgaaaagtaggtgcatttcttgaaaactatatcctctttgttacttatttgaatgtatgccaactaattttctgttttccttaaacccattagttttatcacagcgtcttggtttgggaaaaggtggtctgcggatggctcctgaggaaaatttgcttgaagtgcttcaggtcagccattattcatgtttatctaaaactgcatactgtttgaaagcaacgaagagcgaaatatagtgcatctttcagtttcatatattacgtgaaaatttcacaaaagttaaaaaaaaaattctgcctgtgatgaatattgttggttgtgaaaaaacaaatatcccttcatgtattgtcttgccctttttctgtttcatctttaatgagtacttgaattttggtgcttcctggctctaccagcattttagctggatagcttattgttatagtttcaccctatataattttcttcacatgttaatgtattttgtccttgattatgtccaggtacccttaggctgtgttactccatttgcactacttaatgagtctgcaaggtatgggtgcttgctttcacatgttaattaaatatgattggaatgggaattcggtccattgttgtggaatttgtatttctaatagcttgaagcctttaaacttgaaaaaaaaaaactttgtgagctctgttcactttaccttaaacggtgaagagctatttactagtgtgatgtgctcattttatatccgagcgtcgttgttttcattccacttgatggtttccacttttaggatagaaattagaaatgcaaatgctatggttgtgactgatggaaccacatgcctcttgttttataatgcttagcttttaatgtgtcctattatattatacttatatatcagtttttttcatggttatgctattgcctttttaactgattcatataactgtgtatttgcaagcagtgctgtctcactactactggaccaaggtttcaagtcaaaacagagctgctacttccatccactgacaaatgatgtgacaatcggtatggttgatactatcatcacttccgtaaccaacactgtttcatcacaccatgtgtaatgtcattagttagtcattactgtgatactagaatgcacaccattccgttagttagttatcatggcacagtttcatgtaggttgcacaaggccttggtctggctactgttatattatttttataaggagggagacctccgttcaactttctttacctttttcaaaagaagaatagattagtaaaatggctttcttttcctgatttactccatttcagctctcagctcaagcaatctggacaagtttctcatgtccattgggaggcaaccagcttatgtagacttagaggtaatctttggatcaccggaatatgtgcatatgatttcattcggtccttccgtcccaaattataaggccctcaatatcatactttgatcattaatttcttccataatgttattaacaactacaaaattagtatcatatgaaagtactttcatacacaagtctaaatgttatgaatgcgtaacactaaacatagatattattagcttaattattagttaaaagttaccaatattgatttttcctagaaataagggtgccttatatttttgggatggagggagtatgtgctgggaagggattgtgaaattattggttttgtgcaggcttcaccagttgtaggcaaggataatcctcctgatctagcagattttgtaccatcaggtgtcccaaattctgcagaaccaattgagaaggtcacacctacaaatgttcctcgtcaaaatgatgtgcccaaagagaaaacatgtcttcctggtaagctgttatctactgatatatatattgtcccttgttatttcttctgtatatgcaatctatagtccttacatttgggcagtacatgagcgtagtagtagtgctactataaggaggtactactgtattataacaactattgttaattaaacaagcaggaatagatgacagtgtgaggatgaaacatgtgaacttgttcatgttgtcttttactcattaacctccatttcttttacatttttcttgtgtttttttttattacactttcaagttacaataaccagacatggcatactttgttcttgtatcagaagtgaaggctaagcctaaagttcagaacaagggtgcagaaaagacgcagagcaagatacctacaaacggagctaatgttgagaaatttgtaaatgatgtatttgacatcatgtccccgttgttcctttctgaggtaataagattgtgcatgatgaccctcatgaataatgtccactctttttgttgataaatttcttttgcaggtatcaaagaaactgaatgttaagcaggaagaactttcttctatatttgatggctttaaagaacaagccactattgatttggagagtgtaacggttagttctcttctgctatatgttagcactgattgctcatttgtgttcatgataggcaaccgtggtaaataccctagcttccactaatatgtgtcgaacaagcatctgtggtaaaaattaaccaaacaaaaaaaaaaagccatgggcctaagtaaatgttgcaagtcacaatttctttgtgaaggccttcataagaaactttcgttgtggtaaaatcaggcatcaaactgcccacgtttggagtttggtgtggtgatgtacttcagtttgaacttcaataaatttctacctcgttaagttgtgaagcatgtaacggacgcggctgtgtttcactgcagacgagtctgaagaatgcagcatacaccgctggatttgaggctggcttcgagactatgctcaattcaggtttaaaaggacaggcttctcggaagtaaattgtttcttttaatacaatggacataagtcgattcagtgaattttgtatgacatttagtgtaaaatcgatcaaattataaattatgctttcctttgacctgttgtctacttcatgtttgctcaatttttcaagaaggttgagagatcaaccttgtcagttgaggtaaaattagatctcttataagctctctaaatgaaaaacaccgttgaacggacaagcgttggaaaacaccggttaaatttattctccgtgtttgataaactttaaaacgttgcattgagcattacataatttcattgtctgctcaaataggaacattctgcactgccatgtctatcatttacatggtcaacttttacagcagatgttcttcagccatccatcattgtcaccaactttcggaaatttccatggtcgttacacattctacctgccattgccaacaaaacattagttaatcagagcaactttactaatcaggtagtaacaaaaagagaagaatggtagctatcaggttacttaactgatcaaacaggtatttctctttgattgctatttggcgatgatcttcaaatttagaaaagaaacagagagcgccaccaagcgtagaatgctgaaatgagaattgaagaacagcaaaaacttcaaaacaatagcataaaatcaatcaaatcagcaagtgaagccaattcccggaagcccttttcccccttttgttcttccatagtagattcattgtacataatcatgtatgatctcatgggaagagtggcagatgagatcaagagtggctgttgccttttgagtgtttggtcggaggttcaagacttcaagtaaggaaggagaagaagaaaacgcaagtagcgacgagaacaaaagactggagggccgtcatgtcattaccgccggcgtcgcccgcctctggccttcctcgccgtccgtactcccacccgtcgtcggggtcttcgagcccccgcggcggccacatccacgagaagggcccccacctcacgatcgtctgctccctgtcccggccatcgccgccgccgccgccgccaccgttgttggcgctgccgcggcgagctcggctgttggcgttggacccggcggcggcggaggacagcagctggtaccggcagacggggcaggagttgtggaggcggagccacggcacgatgcagtcggagtggtacacgtgcttgcacggcatctgccgcgcggcctccccgagctcgaagtcctccttgcagacggggcactgcgagccgtcggacaggtgcgctccggtgatctgcaccgtcgggagcgagtcgatggccgacgacggcgcgggcgccggccccggccggtcgttctgggttagctcctcgatgaggttgttcaggttgggcccattgaaatagttcccagggtcgatggccggtggagtagacggccgccgcgccaccggcggtggggacggcatgcgtcggcgaggcggcgccggcgctggagagggcgcgggcgcgggcccgggctggcggaacgcgcgtcctggcaccgcgggcgcaggctggcggaacgcgcggcccggcgccgccacggggggcgcctcgccaccgtatatgagccagcggcgcgggtggccgtcgtagtgcgggtggtaaggctgcgggaagaagtgtggcgggggcggcgcggggcgcggcggcgggtcgatctcgtggaggaacctgccgaagcagcgcggcagaagacgtcggtggacgggtaggagatgatgcggatggcgcggccgcactggagcaccagtacatgcggcacgtccggtggtgccgcacgccgccctgcgccggcatcgtcgacgacatggcgtggat

SEQ ID NO: 72338 - DNA, 5842 bp, Oryza sativa
atgacttacattgtgaaacggagggagtatgaaggttacaataggtaaatcccacatatgtgggtccatctgtatggactactttggctatatacattgttgttgcccagcccacatataaccggccaattctgctttataataggcacagataatcgctgatggtaaacagatgaaaacttttgtctcctcaatcagaaaggttgtgtagatggttagccttatcagtcccgatcaaacgattgtacatgcacaatcacttgctcgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcgtgaggatcatgcacaaggcatcggaacacagataaaaaatttgaaaatggcgtttaaatgtgattttaagttctttacacttagcttctcacaacataatatcctgaattgcctcaattcaaccatttatgacggttttcagtcatactttatgcttgtcaaaggtggtcttctggaacatctcttttaggacaccacatactgacatacatttatgaaaaagaagtgctgcatcaaaattgacatcggaaacctctacttttggcctaaattagcgtgcctttgagttccttacagttaaaaagggcaggtctagtatatcttcatagtctagacgtaaataagattcaacaaattaacttagtagtatagactatataattgtactgtttaatattagagtatatggtagttagagtcatattaggatatgattgatttatgtggattttttccatatctgtaatccttccttatctcatgtatctatatactggcccctgaggctctaataccatgttaaatataatacttccttatctctaccctatttatttcctatatatgcgggctcctaaggctcaatagaatgtgtccaatattcgcagtaatctcctcttcctatactattcaacatttatttacctgatcatttttgctgaaccaaatccaagactgtcatgaaataggcttgtcatgtacttcttctgtgcaaggcacaaaagctctgagctgttgtatatagggggcaggtatgcttccccattcccatctttgtgtttattccataattcgacaaacttcttgtggaacaaattccatgaatcttcaattgtcttcaagatccatttcttgtaagcctgaaaaatatgtacagtcatataacttattttatgccccgtgatacatcatgaaaataccttctaaaatctagatgctgccattgcactttgccatataacttgtcatttctgcagttcccattactcagggacattcaagtgatgagtaaggcaagttattcaacttattgtctgccgagcaccctcctccctctgttacatacggcatatctcaacaatatcaattgctaattattctataggatacaagtacacaggaagacatgtggttgccattatcttagcaaacgcaaaacaacttaaccacccaaaaagaaaaactatctttttgtcacataaaaaaaaaagaggacatttgtggaccaggtaaaagtacacactttcatttactattattagccaataaatccatacataccttacgatcatttgcttgatcagcgtgtccatcttgtgaaaaatatgccaaaatcaagttccccaggaaggccccaatgtcgtaacccattgggccatagaaagcaaattctggatcaatcacttgagtagaatctggtgtcaccatgatggaaccagtgtggagatctccatgaagaagagcctgtgctctctcaataaacctgcatatgcaaatcatgtccatcatctccaatatgaaaagaaaagaaaagcgctggtttaatctggaaagatagttacattgatttcaattcagcaatctccaatttaagctcagcatcctctcgaaccgctgcagcatcattatctaggaagggtgatgtgcaacgattgtatttggcgagcatgtatgggtctgagaacacgacttgctctgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagttgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtacatgtgtggcggcggcggcgcgtggaggagatagggacctgcttgatgacgacggagccggcgtcggagaggacgatgtagacgaagttgaggttgccgtcgccgacctccttgatggtgagggcgtcgaggctgccgccgaggcgcgcggcgagggcgggcgtggccttgatgtaggccaccagggacgcctcgtcgagcgggcggaagccctgctgctgctgctgctgctgctgctccgccgccgcggccatggccggtgcgtgtgtggccgtggcgtcgagttgaccgatgcgagcgccggcggcgaagtggccgcgacccgcgagaggagtggggaatcgagtgcgcgtgtgtgggaggctgcgctgcgcggaggtgtgtgggttttgtaacagctgctgctttcgcggaagggggcggttctctgaacctggacttgttattggtacaaggcggattcttcagttgagtcgtgtcatcagtgtgagctaatcttgaggagttcatgctatctttgagttttcaatccaggccgtgtttagattcaaaattttttaaattttttttaactttttcatcacatcaaatatttagacacatatatagaggattaaatatgatgaaaaaaaacaattgcacagtttgtatgtaaatcgcgagacgaatcttttgagcctaattacaccatgatttgacaatgggatgctacagtaaatatttgctaataacggattaattaggcttaataaatttgtctcgcagtttacaggcggaatctgtaatttgttttgttattagtctacgtttaatacttcaaatatgtgtctgtatccttaaaaaaattggcacacaaactaaacacatcctagtatactgctaattttgaactgaatgtggcttctggtcattggatttggtgaattttcctctctgttccaaaatataccatcatttatgttatctctatattaccactccatctgtttcatattgtaaaaattttctacaattgaccattgttaatgaatctagacataacatccatataaatatgggtaatgctagaaaattttataatatgaaacggagaaagtattaaagttgagtcatcctccgttcatctccttctcccaccgctcgtgcagtctatttgtccgctccttctcaaatcatgtacacaacctccgtatgatacggtactttatcctcaattaccttcctagccctttcttactcgtctcaattgtatgttcgatctgttataatgcatgaatatatgttgctaataaatctgaataagtgtttgttcacttatagcagtattttaggacggatgaaataaataaaattgttttctcgaaaaaataaaaaaaaactaatgaatctttcactcatgcttcaggctaccaatggtggtgtgccttcggttgaagttggaattttctagcaaatcaaccataatcgaaatgttctcatatagatatatagaaacatgccatgcctacataatttttctgaaaaaaacagctctaagataaggaccatatattcatttgatagaatgaaacggttactatgttcgtttgtgtgtttattagaaaaagaaatttattgtgatattttagaggattacaattcacaattattgtgtcccttcaatgaactctgcgagttgataaggtagcatccgaacgattaatcagttggtacgcatgttccacgctgttcttttcaacaaacagggagaatatatcgactgtgtttggccccatacttcggcttgatgtcgccgtcaatgctagcatcatgtatcttcaaaatgacatcatatccaaataaaagcagcatgaaagtgccagtcctccatattaaacggcatgaaactagctcacaagacaaaaatcattatagtattctcatgaccaagcgaaccatagtgagaaagttgacaaactctattatattcaccggatgaactagaatgttcaaagtatagataggtcttttggagaacttctagcatgtacagtttcttccaaaatctccaattccctaaataatcatattatgagattttatagctatagaatccagaaaaaaatgtgtaaagtacacgggcggtccttaaacttatagcggtgtgtcatctaggtcattaaactctcaaaatgcatatccaagtcacagaacttgtcatagtgtgtcatctaggtcccagatcaccacaaatccttcaggatcctacgtggtgcggatgtggcatgtcacacgaacatgatgtggcataattttgactgacaaataggacccatttaaaaattttatttctttcttttttttcttctcttgcattttcctttcttctcctttgtctgtgacccgagcaaaagagaggggaaaaaaacaagaataagaagaaaacagaaaagaaaaagaaaagaagaaaaaaaaggacatgtcacgtccatgtggcaggtcacatcagcgccacgtaggatccaagaggggatgtgtcgatttgggacctagatgatacactttgataagttctagggcctggatatgcattttgagagtttgggggatctagatgacataccgctacaagtttaagtaccgctcgtacactttactcgaaaaaaaaatctacgaggaagctaaggaaaacctactttgtagattaaattctgagaaatggaaatctagttgtgagagcataaaaaagcagggaaaaccagttttttagcttttattaagattcttttgaatctagataaaaagttaaattgtttggggaagcttttgccattcaaccgactgattcttacaaacttagccaagtggtgaaaaaaaaacatcaatcttgcagagcgtccacacttgagcatgcataatgtatagtagaactagtccataaagaatacaatatttcattcagccacctaacaacattgtagaactagtccatatcaagcaaatagcaaaagtcacccataaacatatgagttgcctatatagaataaaatatattatttatctctgctttctctctccttctaatactactaactacctatatatattacatccttcgtttcacaatgtaagtcattctagcatttcccacattcatattgatgtccatgaatctagatagat

SEQ ID NO: 72339 - DNA, 929 bp, Oryza sativa
aacattcaacatttgtgaatgtcttcatgcagcgtggttcacagcagactacttccacgtagtccaatttcactgccagaacagcacaaattaatttaattctggggataccattagcatgattaattatataatgcatggattgagctgcagttttttagttctgaaatttacaaggcagcgcctgatctactataagtaactgaggagataccatgtgattcttcatgtttcttcatctttgaagcatacttgaaaaccttgttacagccctcctccttgcaaacaaactgccggttgcttttagtagcagtttcatcctcatggatttcctttacatgcctttgcatatttgcctttatactgaacttcctaccacaaccatccatagagcaggtaaacaacttcccttgatgcttaagcatatgacggttcaagtgatctttcctaatgtagctgaaagggcagtcttcaagtgggcaaatgaacgatctctacagtcaagaagggaacgagtcaaaactgaagctgctgtaagcttacacatttctttcatacttataaattatctaaaataaattatctagtaaactggttaacggaatatgcaacgaatacctaaatgttcagtgttttccattaagatgatagagataaaagggagtataatcaccatagcgagctgagaaccaatgatgaatagtcctagctttctgaggtgacattttgatgttggatcctctcacctcttctcaaagctcccaaaaggagatccaaagaaatagtaggatgaatgaaggatatttgctaaccttattctccaaaggatccataacctattctattcaatgcctactccctccgtttcaggttataagaagttttgactttagtcaaagtcagactacttcaagtttgaataattttat

SEQ ID NO: 72340 - DNA, 1522 bp, Oryza sativa
ccgagactaaagatcaagaatctttactctcggttggtagtactaaccgggactaaaattaaacacgtagtatataatccctatccattattctctcctccacagttacaacttagacagatcgaatctcacccctctcctcagatctatcctctctaactctcctctccaactcctccccttctctccccttcctccttccttcccagccggcttccccttcccatccggcgggccggccggcggcggggccgcgcccggcggggtcgcgcctggcggagggcggcagcgccgcgcgcggcggcgggcggtggggcttcgggcggcagcggctgtggcgggtggcagggccgcggccgcggcagctggcggggccgcgcccgtcgttcgtagcgaccggcggcggcggcggcttctttgtttttttttaatttgtgatgattcattgttatgtatttgactaagaagttacaaatttgtgattcgcggttaggggagctctcttaatgacgtggtggaatgtgtggttagagagaaataataggattttcgccgatagtgctagaactgagcgtgaggtggcctatgtcataaagcaggagctagatctctgcaagtcggctttcaggccgccctgatggtttttcctctatttggcttgtaagcactatatttcctatctctaattaaattccggcagaactcctgccgtcggtttcctaaaataaaaaacaaatttgtgattcattgtttggatctgtgatgtatttgagtaatttcttaggatattgtgatgcatttgatttatgtgtataagtaactttatgattgtgatgtgaatttgggatgttagttagatttggggattgatttggggatttgcctacttgattcgggagaatataaaaatgaaaaaagaaaaagaaaaaggaaccatctgtactgccgctattgtctcttttagtccaggttggtaacatcaaccgggactaaagatcccctctctttagtcgcggttggtagtaccaaccgggactaaagatgaatatctttagtcccggatccgtactcccggttggaaaaccgggattaaagggggttcccaaccgggagtaaagatggtttctccaccagtgacatgtgcatgcagtgcagtgtgataccgaaaccttttttcaggaaaatgtgtagttttcatgaataaatctcagatgtatatttttttatttaatggtagatatctgcaggacatatatagcatacttttctatcttttttttatttcgtgttgaatggaagtcaagtactactctctccgtttcacaatgtaagtcattctatcattttccacattcatattgatattaatgaatatagatagatatatgtgaaacggaggaagtagtttacaattgttaaaaaaacgcgtctaacaatcgtgcaccctaaagaaaaggttcttgaaaaaaaccctaaagaaaaggaagtcgcgtgggggtcacatcaaagggctgcaggaatt

SEQ ID NO: 72341 - DNA, 2326 bp, Oryza sativa
cagcttgtcccatccgctcctgttcccatcttcccacgtatcgtccaatatgagcagaaaccttttgcctctaatttcctcccaaagggtgttttgcagcacatcaaaactgattatatttttgtaaccttgtctatctttacacacgagctctaacatttcatgtgttaggttcttttcattgaaattatcggatacacaaacccacattctcaaatcaaaatggtctttaattcttgatcatggtatacaaatctggcaagtgtagttttcccaacaccaccaacaccaactaatggtagaacacctagatcacatgatttcacctttgttaacaactctattatgttgtccctctctgtgtcccgcccataaaccttgtgttcaattgcaagagaagtcgtctgacgaggctttctgggctcactctgactgtgctttggcattgcaatttggcgtaaaatctccagctgaagaactccttgcacaggcttgcacctagtgcgtaaacaattcactatttcattgatcctcttagaaatatcatgtttaatctcaagaggcagcatggtgctatgagtttgctcctcttcttcctctcttttccttttctttccatgcataggccaactaatatttgatttatgctgttgcttactcgttggaagtaagatggagtggatgaagacacataacttccctcagggttagtacaagaagcagcagtagaacctttccctggataagaaaaaaacttggtgttaagggacaagcaaaagaaagccacttgtgcaatccactgctaataattaaggtttcttaaaaatggtaaataatggaagttgaaatgatggtaacgtaatcacaattaactgataaaaactgatgtgcggtgactggtgcctatggattatggtatttagctgctcttagtagcacagtaagctcacaaatacacaaatgcaaaagaagcatgaagcaagaaacaaggaatggaaggttgatgagtgtgttaccaccttcgatgtgttgctggagccggtagtaatcaagctcgtccatcacgtcctcagcatcataaagcagctcttttagctcatcaagtgactcggacagtggcctgttgtcaatcttgctactctcggcagctgcaagcaccatctgcatgctcctcatctcagtctcaagctcctccacttcttcagaaaggccaacttcacgagtccacacttgcatctgtccagtgaagaaatttccgaggatgctctcaaccacccatcctattgcagcctcaattgcagtggcaaccaaccccattatccacactgcaactaaggcgacggaggctagaacaagccctgcacaagaagatggatttagaagaatggagcgcaacgatgcattatggaagcaacagggatggcataacacaaggcatgcagcatataaagagtcaaataaaaaagatgtgaggtttacactgcaggttcttcagtacacagctgcaataaagcattggtaaacagtttattagtgaactgtctacggctccatgcacctatgcagcacagttatctttgctaatgaataatagtgtatccatcgaccttgacaaaactagtagctcatgatgctacagaccagttatttagcttaaaaaaactgtcgagataagttcatgcgtggaacagcattactataatacaagtggtacaagcggcagcgaaaaacattacgaaggaacaaaacatttctaaatagtagtaacctgtaaggatagtacaaagcaatttcctggaagcacctacaaaccacgacaaaagtaaggtgttgattcagtaaccatctcatctagctaagaatgcaacttgtaaaatataaaataggattaccatacggtgttacctaatctaatgtatcgacgagcttggagctgagggtataacagtacaggaatggattaccgtccatacatgatatgagtcgcaaaggcagctgcgtgagggtattacaatataccgattatgccgttgaactccactcgaactggacagatcaacaaccaacatagagaaatttcaggtttcaacttggaattgcaaaaaatttaacactgcagagcagagctggacctgacgtatcatcaaccggccaagttgagagggggatttcgcctctcacgccgatggtgacggatgaatacttcaatagtgtgaatggaaggataggacgcggatgcaactggaacttgggcgggaggcggatgcagctccgtcctccgtggagggcccgcaccgtggggggagcggagaatgctccccccaca

SEQ ID NO: 72342 - DNA, 3166 bp, Oryza sativa
taatttgtaaccactagaaatagaaggaataattcttgaaatggcttgctcaaaatagcttccccgctgtgttcaattttgtgggtcttgcaaccggagcttgactgcataagtgtgaacattagactgcatcatagtgagtaaaccttgctacttggtagaaattttggccagttgtgtgtgataagaaatcatttcttgagcaaatttgccgatttttgaaaagtgacaagcagcccttgtaacaaaaccaaggcagtagtatcttcagaattcagcaattatgtttttccggagggctaaatatggcagcccatatactctctgattgatgtgagttgtgatcctgctcttttttctaatgacaagttccaaatttccaacagctagaagtatgaatatgcaatgaattactttgcacaaaatgaatacagagagggaattattgtggccataaaatactgggaaatgtcaaaagcactaaaataccaaaattccattccatggaatggaatatatgcatacgtgttgacctgtcagtgttatgacaggctgttcatcctgacttgtgtgtggccgccgcccattttgacgtcaaaagcaacctccatttctctcatgtctccggccaaccgaccaaacatccatccttccttccgtccagctccagccattgttgattgctggacacagcccttgcttatctttgatgagaaatttaacgatatcccttaaagtttttttggtccaaagaaactacacaagaacagggcagaatctttgtacggcctccaagaaatgcactaacagagaaagaatcatcacgatgcagtgtctcagttcagggctctctgaatcatctgcattcagaagtcgctcaaatataaaagtgtagagtccttcattttctttaaaaaaaataatcagtttccacgtagagttaagaaactggaactgtctagacatctctcgtatgattttttggtatgcaaatatgagaagaagaaaatgcagccttgaagaagctggcccaatccaaagctccagcccgatatagaatgaaaccatgagcgcagcataggacgaaaccactatccaaaacagtgacttgatttgctccggtcttgaagatggggatgcgttataccggttttgcggttgagggatatgattcaatcaatagaagagttgaaggaggtaaaatagacttatttcataaataaataaggctagagacggcccaatacactaacttcactaaatgaatttttttcgtttttagattttatttttaatatttacagaaataatctatcgaccaaaaaaattgcagaaatagcccctgccgccctaatggtgggcggcaagctgacgtggcagacggtgggtcaaccgcgccgtctgccgccgtcggccaaaattgcgattaggcccttgccgcccgtacagagggcggcaaggggctaattgcaattttggcgcccataaagagcttgcggccgtactttttcatctgggtcccttgccgggccaaaagatttttctatgttatgttaataataaataaagaagtatttattggtaaaacttgttaatattgttataaaaatgtattgaagttggttgttgcgtaatttcatatgttaagtgaggtattattttgtaccttattcgacgtattagtactcggataatttatataggcctatcacagtctgggtcgtagaaacattatatggacttaaacaaggagaattatataacatgaagaaatagtagtacaatttgaacatgatacaagtatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctcttctttctcaaaccgcgcccctacgtgaggatccctcttctttctcaaaccgcgctttagtaacactgtattgctctggtagttcaagctgcataacacggctaggtggagttagaacccttctggtgtctatccattctctgtattgacatctccttggtggttcctgggagaaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaatgaagaacctgacaacgatcaccacacctgcatcttggacgggcttcccatggagggagtgccgtagttagcacccgccagtcgctctgtagttcacgacattgtcgttcataagccgcttttctctgtaagtattgctcagtactttcggatgcgaaataccagcgactttcttgtaaacaagtggttaggtcgagaatgggattttctgtatcgacccactcgatgtatgcgcaagccgtagtgcaggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgcaacgccagtttggatcctcaacacctcggcgtctagccattgacgaaagccggtcgaatttgtaatgaagcaagtggggaagagagtactgaatgtgactgagttctgaaggagtcgtgaaccgtgagtagctccccgcacgtccatgcccggaacgtcccaagctgagccccctgcaccgcagtaaggtgagaccggtgtcggtgatctattgccgggtccaacaactgaggtgtatcctgacgtgccatctctgaaaaatatagtgtttcgtattagaacaattcaaaaaatagtactgtaaaacaaaagataacttgcaaaattatgaaatagtaataaaatcatgagattaattatgtacaacaagagtacaggctatttaaatatagcaaacgttactaatgg

SEQ ID NO: 72343 - DNA, 2719 bp, Oryza sativa
tgtgcgtgccgaggacttggggatcgacagtgaaccggtaggcgccctcgccgtcgccggggcgggggcagtggacgcagaggtaggacaggcgcggcgggcgggcgaggcagaaggagacatggatgtttacgccggtggtggtggtgcagaaggcggtggtgagagttggagactgcatcgggggagtacgtaagctctgtcttcgaggtacacccagcttgggctcacgccgccggtggcgtcgtcgtcggccggcagcggcggcggaaacagcaagggtagtagcacaccctcatccatgacataggggacgggctcatcaccatcatccatggcgaatcaagcggcgatccgatcggagatcggcgacgagggggcttgtttggattggattgcgtcgttcgatcgatccgaattttttggaatccccgcctatgtcgctcgctaattgcgatgatgatgtcgcgcgaagccatgacgatgctatttccgcggatcgcgcgggcgcctcgccgacgccggcggatggcacctcccctccagcagcccgagctccgccgccgttactcgccggccggccgatggtccttctccagccgccggagctccaacacgagtactgcgtatgatgatgtgttccttccatggattgctctccctctctagctttttcggttttcaatatgaaagtctattgaatgggtcaattttccttacaatcatcacattgcaggttttgaaatatgaaaacactgcaaaattagtttgtttctggcgtacagctacaacttactgctaactccgtcctaaaataagtaccgttttacattgtttatatccaacgtttgaccgttagtcttatttaaattttatttatttattattattacatgataaaatataaataatactttatgtatgactaattttttatttataaattatttaaataagacggatgatcaaacattaaacacgaatacccatgactttttagaacgaaggtagtagaacacaaatcaacccatcaattttatgattggcctgtcaaaatggtgcacagaaactacatgcccgtcacaacagtcgaaatcaagccccgagggacagagagatagactagagtgtaattacgctggcggatttgctataaaatttctgtaagtactcttttcatgtatttttgataggcatatttttaaatctgaaaaatttacttgatagttatatttcaatccaaccatctattctcttaatgactttctcggatttaatgcgtgactctctatttttcaacataagattggctacatgggcatcgagaaatgtaaatattaatgaatcgcttgtttacgaggaataactagtagaattataccaagatgaaatatgactatcaaaagtaaatagattgagtattttttttaccccttttatatttgtgatcatcggatcgcctcaagatttgtttataaagagaaataatattataaagaaaatttcacacatgtcacgcgtaagatcctggtgctaacaaaccaaaccatagttgaatacaagttttatataagttatatcatagttacagtgcagttacaaagtgtaacatcccgattttcgcctccatttaaaacctattttaaatacaaaatttattttcaaaatttggtacttatttgaattttggtttgtaccgttagagatttctactccatcatccaaagttcacaaatataatcctaggattattagagtccaatgtcccatttatagtacagtccatttacaattttcgaaattcaaatttcaatccaattcaaatccccttcaaattccaaatcccaaattcccaggaaaatacaacgtgatcctattcgtttggggtgaaaattttctcctttcccctctctccgtcagcccagcaaccaggccggcccatctccctcccccaatccccgatggcccaaccagcccagctgccatcttctcctctaggcagccacttgtgcgcgccacctgctcgacgaaatgtcgagccaccccgcaccgctcgcacaacgccgtgcgccgccccgagtcgtgcacgcgccgctccgcgacgaatcccggacgcgctgcctcctttttcgccggcaaaacccgccggccatgtgggcccccgccgacgactttctccgcctccctgtacccgtacccggcacagcgccgtgctgtggcctcccgcggtcccacgccgacgccgtccagcccgtctctccgctcgacacatcagtacatcacccctgccttgccctctttttgctgacgtccgcgactcgccaacacccgctaccctcggtgcaccgcctcgcctactcgtgcttcatcgcctgcggtcgagagtccacgccgaaagccacactgccaccgtcctcgctcccctgtgccaccatcaccatgccccttacctttgcctctgcgccatcgcttcccgggtgctctcgccgccagcacctcccctgccgccaacccggggcgccgccgcgtgagcgccgcatccacgaccgcctgctgccggtctcccgccagtccgccgtttacgccatcccttccccctgccgtctccacctccgcctggccggaataaaatcaaatatttattgatattttataatggttaaagttgttttctaaagaatgtgtcattgtccaaaacgacacatattatcgacctaga

SEQ ID NO: 72344 - DNA, 26615 bp, Oryza sativa
  unsure (1)..(26615): unsure at all n locations
gggcaaaaaaaccatgaagatgttagagcatgctgcatacatattagctagattgtgtgtaaactgagattagaccattacctgaaagctcttgcaaaactaccccattgtgaacaaatattcgcagaatatgccgattgagcattggcggtcaactgaaaggtgtacaagtttcataaatatcgagaaggtaaaatgtaaaatgctaaacatagcttaagattgaatctgcaatccttcgtatagtctatgtgtacagatctagagtaatcttgaaacaagaaggggaattattaatctaggtgacactgggagtgtaaaacaaaatagtactcttcaaacagcaagagaaaataaaactacttatatgcatgagcaagacaaaagaggcagacctatatgtttcagtttcagggttaacttaacccaggtcccagagtggttctggtttatcactgaaagatattacaggccatccttttttggggccatccctttttggggagaagacccaccaaacacaatgtgtaaacacaatatgttgacagagataagaaaccgcatgttgaacaaactaaattgacaggatagaagatgatatagaaatactaacacagagctccacgtaggttcggatagaagatgaaatagaaatactaacacagagctccacgtaggttcggttcaattcatactacggaaacaaacagaacgctatctggccaagtggccataagctttagacaaacaaagctccagttcttccattagtgtattggcatgattgcatgaagctccaactgaatcgtagtacttacaaaagtgtcttatgtaagtatgcaagaagtgcagcaatcacacccggacactcaggacgttacaatcttgtgcctcctagcttaaggaacatgaagagaggcgatccccttcttgacgaatgaccaagaaaatcaactaccttaccccaccctcccatcgtcctctactcaccatgctaaattatacacgatctaacatttcaaaaagagaatggcacacggatccaatccataccaccggcagtaaggaaaaaaaatcataatttgaatttgcacctagataacatatccctcatctaatctaaaacaacatagcgaaaaggtcnaaccagtatgacatatcagataggtagctgcaagccagcaagaagatagcaagacgtcaacagctagtagaggaatccaccgtgaaaaaaagtaaccacagccacatgagaacccaaccaaggacactaatcagccacccatggctcgatccggcagatccaagcaaaagaaaccgcaggcgaggaccaaatcgcgctatcacagatcgccgcatcaaatcaaacgcgcgagggaggcagattagggaacgggaggcggagagggggcgtaccgttccgaggggcgaggcgaggtctcgccggcgggcggctcggagaagcagcgacgccgccatggccggacggggaggggaggggaggggagggaggcgaggaggggtttagggttttggttttggcgtgtggaggcgtgaacttattggggattgggggaactttggggagaggcgtggcttgcggaggagggtggggattggttgttgggctgctgcctgctgggatggatgtatggctgggcggtggggcgccacgtcgtcgcggcttgcgggtggtgcggatgcgggtggccgtgtgtgtgtgtggaaccttctcgaatcgcatgggatagcgtggcctgcgcacgaatgggccggcctggtagggggtggatcggttgggataagtccatctattgttccttgtctgtacgtcgagtctttacttgtaatccttaaaccacaatatcgaaaatctttacccttcattttaacaaaacttttcaaatcatgttttatggcagtatatggatggtttggctgttgtgacatcctagtcaacaaagcagcagcacaagctcaacggttgagactaggaggaggcaaacgctgatgggggaatcggacaccagcctgccgatctagcgcggagagcacctctatctcctcggaggggggtgctactgcgcgcgttcgtgccagcaatttagctgccccccccccccccccgccgcccgccccgtttattttttcctgttcgcattttttttcccgattttgacgttctcttttttttcgccgtttctttccgatttttttttcaatcacctctttacaaatgtagaattgaaagtttttaattttaagttgaaagattttaaatcttgacctgaaagttttcaaatctgggttgaaagttttaattatcggttgaaaattttcaaatctaggttgaaagtttttcaaatttgagatgaaaagttaaaagttttcgaattaaagttgaaagtcttaatttagaatatagtcttaaattatatttggaaagtcaaataaaacaaccgaacgctaatacagaggggaaaaaatctaaactaatcacgatactaatcacgtttcctaatacaacctaattacctaaactagcgctaatcatgacgttaattattttttaattctgattttaaccctatgcgtaacgacgcgtggtctccccaggcgaaaaaaagcaaaaaaaaaaaaaaaggaaacgatggactgtcgtgtgagggtttgggccgcgtgcaagggatgggcaagaaacacgcgcaacataagcttacgcgtgtgtacgcgcgaattaggaaaaccgctcctcggatctcttctctaggcagggatcctatcgagctcgcaatggcggcggccagcctcgctagtctccatgtctgccttgtacctctgcgcccagagcatggctaacgatgagagcaacaaaacgaggcatacgatccaggagcgcagcacggatttttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccaccgcctccttagacatgaatgcggagaggaagaggacaaggggtgaaggcttggaaggccaagaaggtgcagtagagggacgcatctccttgcaagtgccatcgaggcaggcctcccacagcacaacgtggcaggcgagtaggtcctccttgagccacttcaagatatgctaagcggcgtcgaaaacgccaaggtacacggcgcccttggtcgcgcggtccctccctgcattgcccccccccccccctccattttcactgaacccaaacaccaggagcgttcctatggtggagttgttcaggccggagcgacaccgcttgcatgataataacgattgaaacttgaggtctagcccagagagggcctagagggcatgttctccccatcgttggcatgctctgttgacctcgcgtgcgtggttgaggaaaaagagcgtggttgaggaaaaagagtagagaaagaagtaggagctgatacgtgggctcaacatatttttttcttctcacttacatgtgagctccgtatgttatttcttaaaaaaattctttttatcaactagaatgccacatcagcggaatcagttgtctgtactgccctggacctgtcttggacggttctggcaatacaaggggtgaagatttataatatcgatttttgggatgccaattaaactcaacgtgaagatgagggacagctggacttattccgctttggttttttgctggccttatgctttggcccagctcagcccgagaaggcacctagaacgctagacgtctggttgttcccctataagccgctggatcaagatggacgatccagattgaggcttgaaagcaggcaattctcgatatgcacactaggctctctaatgtttcattactatacttgcacaatggactgctgattttgccttttctttttggccggacaatgtggcctactaaagcaaaagtcatgtacacaggtggatttgacttcatagttgcatctctatccgacactgccgtgtcgatgaaactaagagtttctgaacatcaaacatggcgcactataatgtggacaagcagcagctacccttcacctctagcaaaagacaaaaacatcaaacatccatttactttggtactaagctccagcctccaaggcctccagcagtccagcctccaagccctcaccttggtctgagagtgttcttgggggcactaatccatggcgtccctgcgacggcgaacctccatggtgcagcaacatgctccggcgatgcgtattcgatgcctacacgggggccaaccaaaatgttctccggttctggcccgtctagtacctccaacccacctaagacatgtaatgtcaggcgaaaacatgttgatacgatctggcagttttgaacgatgttggagatcactgaatcataccaggtgtgtacagaggatggttggaccagtcagtggaaagccccagagcttgaccaacctgaataacacattcagagacagttataattcagttgtgtgggaacagtgatgatgcagaatacaaaacttggtattgaaaggcataaacctttcctggtccagtgagtagaagtggcttatcagtctgctggcctcgacgctgctgaatagttgccagccctacagtattttgcaagacaatgagaaaagatgccatcaagctcaaactagatgttacacaatagaatttacaggaggaacagacatttggcagtaactagtaacctgactgggtttttcttacatgaccaaatgcagatgatttatataagctctatggtctaagcatatagttgcttttgtaaaattggaactccagtagtccaaacaaagaaacagattttactttctgaagttaggagggacagacggaagaaaaacaattgccgaaacatgtgaggaaagattatcgcatatcctcttcctcttgctcacacagcaacgtcctcgtaaacttcccttgtgttctttaagtaaaacatattctctaatgcatacttcatatcacattaagtctgaagtgaaacatacatttcagaagtgaaaattattgcgattacagtatatatcttccgatctaaactaaacaagcaccaaacgaaactgcagccgaggtttataaactgtaagtcacccaaataacttggtcatgttcacttgttgttacttcaggaaaaaagctgatcagatcatacatgatgctccataatgctcaaaatacttgagagaaatcagaaatgcatactgctcaaaatacttgagagaaatcggaaatgcataccactaacgggagcacatgaccgaatcagaacagcagctccaactccctccttgtcagcgacgacattgagcatcatgtgcagtccatagcacaggtaaacatacgcatgccctcctgatccaaactacaccggatgaaggaaaacttcagcccacattgaagttcaagagactccccccaaatttgctaagcttatcgaagaatttaaggcaagagaagcatcggccttaccacaggagcagtcctcgccgtgatgccgaaccggccgtggcacgcggagtcatttggcctgtaagcctccacctggaggaacacgcaggaacaaatccacagtaatcgcacttggccgcagtgattactgattagtaggagtggtaaggtgaaagaacaagcacctcggtgatgcggaggacgacttcgtcgcggcgcagcagcttgccgaggaggcgtggggcgaggtcaagcgcgtccacctcgaagaaatcgcgcggcaatgcgggcccaaacggcgactgcaacgacaccgccgtacacgccgggtgcggtggtttccccgcggcgatggtctctccggcggcgacgcggcgggtacggggctgccgcttcttcctgtggggggatcgcttgaagcgtgggggcgtgggcgccccggaggtggtggtggtggtcatcggagatggccggctccctccggcgaccggcggcggcggtggcgtgggggtgtgtgcgtggggatggacggtgcagatggaaggaagggatttcatcgatggattggcaatacactacgagtactactgaactcaccggcccacgcgattagtatttacaaaaaaaaaaaaaagtcaacgattagactatggctgtgttcggattcatattacgcacggaaaacggaacgattcattagcacgtgattaattaaatattatcaaaaatagattaatttgattttttaaacaactttcgtatagaaacttttttaaaaaaacgtattgtttagcagtttgaaaagcgtgcgcgcggaaaacgccgaacacacccatatgtgtttttttaaaaaaacaaatggttgacagtttggaaataaatattacacttcaccattttattgtactctatctgtcctaaaatataagaatctataattggataggatatttcctaatactaggaatttagacaggccttatctggtcctatgtttttatattttgggactgatcaggtattgtatttgagttcatatttattagaggcatccatatcggttgcatatgtaaggtttacatttttaaagggtacgtcaagagaaaagcattcgagattagtctctaacaaaagttagaatggtcacccttttttttccattgctgatctctaccgattaggcatgaataatgtatcacggtgacaagtgaccatggtaatctatgtgggagaatctacatcataaaatatggtgaaaccttggaatctcagagagatacgtagggatgtcactagggttattgcactgtcatgcacacctctataagcatctatctttcttcctcattcgtttaggttagaaaaaaaatatgttagtagaaaaacgtattgacttatgttagccatttatgtctgatacccatgagttgtcacgtgtgatgtggctatttcgcagttagcaagaaaaacattgaagaatatagatgttggataatgtttgactatcaaaggggataccattgcctttacaataaactagcaataccagtgctaaatgagacatctatatgttgttgacccaataaaatttctactagagttagattacttgatgaaatttgaaactactttaccactcgtaacaaataattaaatatttctttgaactttgatggtctaacaaataatcccttgctaatactacctccgtaaaaaaaaaagtgcagttatggtttcccgtgtccaacgtttggccgtccgtattacttgaaaaaaatatggtcaatatttttattgttattagatgttaaaacatgaataatattttatatgtgactattttttaaaaaaaaactaaataaaatagacggtcacaactgtaattatattgggtcggagttagtatttgccaccatcttcattggctccgagatcgccatccaataatttggtggagacaattgaacaactcgtacggatgctccatcgatttctgtgtaccctgtatagcgagtgatagtgcctccatccatccacaggtgaccgtccgttcctagcctcggcccgtagagtgtcgacttggtggacagcacaaactcggtgtcaataatggtcttgggtgatggcccttgacctccatctccatggcgagtggtcgtcgtcgtaggaggactcagcaggttcaggttctcgttggacacaatcacatgcctcggccgcatccacaacggcattgatattgtgcagagcccgatgtttagctccaccattgctcttgccgcgctagcttctgcgtcatatgttggccctatggttccttcgcttgatgggggtgatggatatagagcgacctaattgattcgagcgatagttagcatagttagtgtctgttcataagcaattcattatttagataaaaaatatcattctcataatttacttgtttaatgtggtaggtgttaacactcttctctacaaaacatagcgaaactaatcttttatattttagaacggagtttttcttcttaaaaatatatatgggagtttaattcttttttatttacagaacttttggagagattcatatatatatatatatatatatatatatatatatatatatatatatatatatatatatacacataaataaattaatacatacctcgataatttcgggtttgatgaaacatattggaagagcgaggtggagaggcggaaccgcaaagtagagcccgtgttttgcctcttcctgcctatggaccgcgatcgcgacgctgtcttcgtccctgaagacaatcaccgtgttgtctagtatcacgcacaaggtgatcgcctcgatggcgccgaacgccaccatgtccgcctgcaggtcatcgagtttctggaaaataaaatcgagaccttgggccagaacgcatcgacgatggaggctgtgcatatccccaccctcggagatcagctggctcgtgatgggtaccaagagatctcgcgccagtgttgccctctcgacgatgtcaccgtgcagatcgcgtaggtttcccaaagagaccatgattgttactatttggcttggaattttcgaggctggagctgaattatacgtatgaattttgggcgaatacgaatatctctcgctagcctagacgcaataatacggcggctgaagtacgattgagatttgagagaggctctgatgaatatataagattttgtggccgaatacgaatacctctcggcctgtcgctggcctagtcgatggtagcagtcgggctgggcccgctcaggaagaggaaaacgagtcagaatcagacacggggttgggggctccatttagcccacgtgaaattgtttggcccatgctggcgaacataattgggcctcgggctcgggctgctcgcacgtgcagcgcgcgtgcgctgcggagtgcttcgtcgtgccatctcgcatcgcaccccagaccagaccatggcggcggcggcgctctgctccgcctccccggccatctccacggcggcagctctcggcgacggcgtggccacgctccgcctcgcggtcctactgcgccttcgcctctccaccgcgggctgtgggctgtggctgcggtggggaccccatcctggcaggcgcgtcggcggcttccacgactacggaggaagagggatcaggtgttagagatgatgatcccgacggcttcctccgctccgagaaggtcaggcttaaaaatcggctttaggtgaaaggagcccgtgaatttgcacagtagagatgtttgtacactctcccacactgatgtatgtacattttttgctggactagtgctgtgtgtttgcctatttactctgatacggtgcataagtgcatccgtctacaataagataatactatccttttagatgattacgtgccctataagtgtccagttacccccctcgatggcaggaagggaagataaaaacacaacagagtttgaatgtgctgagcatttcaaatataatgaaatgacaggttgctagaagcttagaagtgaaaatatatatcactgtatgtctgtatcaggcatatggtttctgctagtaatcttctagcattgaaaaatcaaatctgtttagtgctcaatggtagctcttggacgagatgatcttagctgttcaagcacaatgaaatctacaatgttaattgctaaatgaactagtagtagacaccgtatattatgaatgacggcattgagagattaaaactatttactgctactgttgtccttagacaaaacactttatgaactgcaatataacctcaagtactatggttgaatatgataaagttggtcttaaattgtgctagtaataaattacacatacattcgagtctctattgtttttcaagtttagctctggttacctgtttcaggtaaacgttgagcataaaagattcgattttgtttctgttccaggatcgaaagtgcggtatctgaagagtcacatgatgaccgcacagagaatgaacatattatacatgaccatgaacaccgtcatcaccatcatcatcatgagttcatgaccatgaacacaaacatggtaagtataaatgttgagacatgatcataatcactgtcatgatcctcaccaattatcattttgagaactcctgctaaactgaaaagtagtcgacgacaactactgaagacaggctaaccttagtagcaatatatccatgcctgaactgtgtaggcattcttatctgtttatatgaatcattagttcattactgcttgaagcttgatgctacttttctattaccatgtgaatagtccaaaaataatgattgttcattttctgatacacatcatatggtaacacccttttccttatggtaatattatactaccttagtagcaatataactggctttctgttccacaatcacataatgtactacattaacacctaaaatctcacatcaaggagcatgatggcatgtacgaggtttgcgcacactgcacactcacacacaatcttagatccatatggtcccttcgtccagtacctattcttttaggagttagctcatggaaacatttcataattaccgggaggctgggagttgagccatctgcattgtattatttcactcaatttcagaaagcataatatgatgactatcttaagtcatggcaatgctttccatatcttaagtgaaaatatattaatatcattcggaagtttttgaactgtttataccattgtctgcttttgtaaaattttaaatatgctagccccccatgatatgaagaacaggtaaactcattgtttttcttttccttatagatcatcatgcacacgagcatacccatgatcctggtgtttcttctgtaagcattgtttgcaaaggggagatggatcttgaaaaggttgattctaaatttatctgtcatgctctatttagtcattattgctacatgaaattttacatctaaatactatcacccatttaattgccccacacatgatggggttgtggatattgaaataagtggataacaattttacatgctctcacataagctggcatgtggttgggaaacctactgctagaatgtctttcaggtttatgttaaacttagcctgtagttttacatagttcactattgattcttccatcgtagtctcttactgggacatttacacaatgaaccaattactctatatgtgttcttatgtaagaaatgtctgtgttccttgggcagggatactctatatgtgttcttatgtaagaaatgtctgtgttccttgggcagggagtgcacatcattttccggggaagaataatgtgggaaccaaatgagccatgcatcaacaagattgtattcatagtcaataatctcaaatggggaagaactggagaaacggcttcaaagattgcctactctactgaaggaataagcgagaaacgggactccaacaggtggtgtatacttcaatccaaccaatcaaccacatgaaagtgcagcagcctaaagcaactaatataaggaggaggtgatcagtctaatgttttcatgtacacagcctgaaagcaagaagaatgcatgaatgggctggctatccgctgaggtcaaggagatggtccgtagaggctccggagccgggccaacttatctacaatgacagctgcaatgaagtcatgagtgtaggcggcgtatggcacccgtctgcagtcggtgaaccccaagctgtaccagtcctcagccggcctccgtcccagccttgctgccccatgccaagacttgaacacggccactgcgaccccccttcagacgggcgtggactagatcatccatcgcaccaaaggtggtggacagccgagcctccagatctgcgcggtccgtgtacattgggatacctgagaggatcaaggacctgtccgggaagctgctgctccagacggtagcagggttcgcgagagcacacagcgcgatgagcttgtgcacgatccgtctggcctcgaccaccctgttcacatggtatcctggtcctggagacatcaactcgtcggatagccagttcttggcttggcagtaggccacgggacccgcccagtccctcgtgctgaagctgagctgctgcggcggctgctgcggcggcggcgtcaggaaccgggaaacgtgcagccatgtcatcatcagacagtgaggagaaagcccccatctcatctcatcatcatcatcatcatcaccccatctcatcccaggagcgtgcagccatgtctcgggaggctcctgcagcagaagctcgacatcctccggactcccgagcacgaccaccacgacacccatggccctgtggatcacgacggcctccacctggtgcctcagctccacccggtgctccagccagtcggcgatctgggccgcgtcacactgccaccgctctgtgcccagccctctcagcagaatcacccggctcctgtactcttcctgctgcgccgccgccgcctgcgtgatcacgtacggcggaagcaggagacggagcaaggacgacgtgccaccctcgtccgggagcagcagcgaggaggagtccagcatccggaggcccgtcctgacgagcaaccgcggcgccctcctggcaaccaactccgtggcgtccgcgtcgtcgtacacgagcacgccggcgtccccgcccctccacgccaccacggcgcacgcgtactcggccccggcgaggtggtctctcgccgcgcggcaaagaccgtaggctcctccaccaccaccatcggacgtgccagcgacgcggacgacgaagacgcacctcaggtggagatccgcgtcctcgtcgtccagcaggtaccgaggcggcacgagcgaccggaggagcccaggctcgggctcagcagtggtcctccgcctctccgcctcatcgtccagtgcgtccaagatgtatccgcgcgggtcgccgcgtccgctcgcctgaacaaatccacattcacattgtcacggagtactagctagtagtagtagtagtagtaattagttcacaaaatgtaactagcctggcaacatcatctcggctaattgagttgtttactgattcatttcttgtgtaataaaaagcgcagaatcatgccttgaatcctattaaaaagaaagattcaaacaacgcaaagcattgtcctatcgagttttggtgattttgctcttagcggacaggatgcattgggtaaccgatttcgtccaaaccttcaataaaaggctacaattctaggagagagctcatctgctcatgtatcattctccaaatacacgtgaaccagaagcactgagcagaaaacattatcgcacagacagcaggaaacaaactcgcatagacagagcgggatgcagagattcagagaaaacaaactcgcacagacacagcagaaaacaaacacaaactcaccgccggaatgcaggcgacgtagaagcccgggcgaggcgtcaggttcatcgcgctcgcgctgtctgcggcatccgcgaacaccaccagcccgacgcggtagcccgtcgagctgtctcgaactaagaccgcggcttccacagccaggacggagaagctctctcgcaggtcccgggggcttgtgctgggcgccacgccgtccacgagaaccgatctctccaggaagtctgggtcatcaagaaccccgggagcaacatagtaaagatcagagataaggcgattcatctgcctaaatgctgtgttgctcgcctgcaccaaacaagggacagcatccgatccatgtcaaatcaagcacaagactgaatggaagaagaagaagaacacgacaggtgtaggggggggggacgggaagccatgaattcggggcaaaatcaagaatccagcggcaagagaagcaaaatggcgccgaattcagagaagactcggcgttcacgcgaaagaaacgagaaaatgcgaatcatcaagaaatctgagaccatgaattcaagaaacgggaaaagaaaaatcaggaagcggaggcgagggacagaatcgaacagcaaaagaagcgacgaattcaagaaacgggaaaataaaaatcaagaagcggaggcgaggagaccgaatcgagcagcaacagaatggaccatgattcccttctagaaacgggaaatgaaaaatcaagaagtggaggcaaggaaacagaatcgagcagcaacagaagggaccatgattcccttcaagaaacgggtaaagaaaaaaaaatcaagaagcggaggcgaggcgacagaatcgagcagcaagatcaactacaagacaagtagcaaatggtggttgccgaattcagagaagacgccgccgaacacgcgaaacaagaaaggggaacgaacagaacaaatcagagaccacgaaatcgtcgaagaacacgagcaaacagcaaacaacccttccttacctctcttgccagccatagcctggcgaggctggggtggcgaaccgggatgataccagcgggaggaagaggagcggccatttccgccgatcggtgcgggtcagaggagaggatgaccgggggatggagggagctctgctctgctcgtttggtttcttggagggagaaaacgcaggcaggtgcagggagaagaccgcgctcaacgctggtttgggaggagacgtgattttgtttcagctcacctccgcgaaggcggtggatggaattggaattgggctttggaagatttggcccatttttgtgtggcccgttattctaaggggacgatcagttattaggccgaaagaacgaggaattttaagcagaataagttcaccagccgtctctcaactttacatcgaagttgtttcacatcccttagagcaagtataattgtgagttatcgtaggaccgagatatcgactagaggggagtgaatagacgatttaaaaactaaatgacacctaatcaaaactaacctaagttgctagactcggtgagggttaagtctaactaagcaactaagttatgtttgcaaacctagggtgatagtggctcaattaattctctaggaaagtaaatcacactcctatatcaatgttttgcaatcctagggtgatatgatatcaagaatgtctctaggaatgtaaattgcacaaatataaatgcgacaatcaaatgagacaaggagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccatggagaggactacccaagcctcgatcactcggggtagttcttccttcactctgaaggtggtgaactccaaaccactcacaaccggcgccgggcctcctccacaatcttctcggagaggtcaccgggcaacttctccacaagccgtctaggaggcggcaacctccaagagtaacaagcaatgacccggcatggaaatgatcaatcaagtgccgcactagctctacaaatggaagtaatgcacttgactcttggctagaacaatctcaatcactacaatggatgaacactaagctcaaaggtgtgtgagagaggtgcaatgggtgtatgcaattgaattgggtgccaagagagcccccttactgctggaggagagtatttatactcccaccaaccaaaactagccgttgggggcgaaatcccccaactctgtgtactgccgttctgaccggaggtatgtggccggtcagaccgtgctactctgcaacggctagaaaactagccgttgtagccctgtcagagggccccatcggcctggccggtcagagcgacatggggtggccggtcagaccggcctcggctcggtcagacagccctcagctcggtctgaccgaatacggctccgtcggctctgtatcggccaccccgagcaccaccataccggcctccagggggccggtctgaccgcacaagtgccgtcggttagaccgaccttgtgcgctggtcagaccgcccgcttggggccggtcagactgccacaaggtggccggtctgaccgcccctggtcaggacgaaaaccagtgaatgcaaggtgttgtgtgtgttgtgtgaaatgtgagcacaagtctaaatgcataatgacctaatgtggcaattaaaatcttctctttgctaggtcattactcctcttaatagtacgacgaaactaaaaataaactagcaaatttgatcgccctacacctcgatcaattcaaaactaaagcacttgttttaccgtcttctttccctttgctttgcgccctcaattttaatccatcgataatcatctatgcgcacatctgacgtggatctaacttaaaatatatagctcaaaaacaacggttagtccacaattagtgcttgttattaattaccaaaattaacaacgggggcctagatacttcagctataaaccttctataagcttatgtagaggagagatataacaaaaaattaagggtgttggctgtcatgcaagagctagcttaacataagctccaaggtaaatacaattaatgtataagtgagagatagagagaggagaagaaaattatagccaaccttatagctaatctattatatgtgttggctttaagattggctaatagtaagaagtgagctctattattatccttgctcttatctctaataaaaaatcttcacctctaaactataaaaaaccgtgcaatttgggtccgttagcagtatggatatccggtttcgctgaggtggcatcctagtcaggaaaaaaaaagacccacatgtaagtgagaaggaaaagaaaatgtgaggtttgcataagaaagttacttaaaaaaaatcacattactccatctattatattattaagacagctcgaaaagaagccaccacgttcgctgtggaagctagaaattcccacattaatcgaagaaaaagaaaataagagtccaagtagaaatacaaactaaaaaataactgaaattcggaattaaaaataagcaatactgaaataggagtccatataagaacccaatacgagattaattaaaacctttggcaattctagattttaactgtttatagtagaaaagataagtctatagatctgtactgtgtacgttacatactaggagtctttgtccttttctatttctttggcggtgtacacagtacacgtataatctaattcaattacaaacctatacggagaagagttgtgctgccaaataaacaaagcttgcactgctgcacctatatattctgtagatttcaagcagcaacgattgggctagagcggcagaacccaatgatagcgggagccgaccatagtaaaaagacatgatatttacatagacattacaacaaacagatcaatacttgcaaccggcaatgcatcaaacaccaaaagtttctttgatgtttatgaaagtacaaatgatatcgacatattgtaattagtgtatatttttcacaggagatgagttagtgcaagccgctataaactgacagtcagattaaacgtttagattatagtggattcacaatttaacgttcataatttaacggttgagatataacacctatatataaatataggaattagagttgtagtgctaatacaggagtacaaagcgcgctgctcgatggaataatcgagatccaattccaaaactgttatctaaacctatttgattcctgtggaaaaaaaaagcaaaacaggaactaggtaggcagaaagccgtgtatatacgtgtgcacatgtaagtattattttttcagtataatcacttcaaaactatttagaacatactttgatatatttgttgccagtaaaaatgaagcgactgcctctttatctattcgatcctttttaatcaccaaatatacaaccagcaattcagatgatttataagtaactaaatttgaaataataataataataataataaagactatgaaaagaaaaaaaccatctacaacacaacatgtgattaattaaaattttaaaaaaaattatgaaattagaaaaataaaaacaaaagtttaagaaagaatacgatttatgaataacaaaagttcaaaataaaaaaaagaaatattaaaagaacaacccgtaacacaacaatggtaaataacaataaagagggagggataacgggtgagccgtaaataaataaatagggtgtagcggttgatgggacattttaaaacaataaaaatataaatgacgattagattcaattttaaaaatctcaatgacgattaagagaaacaacagcgggcaagccgtcaaggagcacagtcgtgacgtttgactggacttctaaaaagaaaaaaaaacaacgataatcataatatcatatttgactttttaaattccaatgacaattaagaggagacatcgggtggattgtagaacagtacaatgacgacatttgatgtaacttctaaaaatataaatatgtcaatcgacaagacaatgaactaaaaaactataagatctaaatatgaaagtttcaaagaggatgaataaaagttgtgacaggtcgggcgatcaaataaatgagtggtaaaaaagtaaggggtgacgacttattgacttttaaaaactaacccgatgataataagattcaatcttttaagatcggctagatggctatttaacaaatttaaataaaaccatgcttaaaaatatataattctggatgggtgctagccgtgcaacaaataaaggggtgacaaaggagtaagggtagcaacatgtgtgacttttaaaaattataaaattataaacccggggatgataatgttcgatctttgaaagtcctaaaacaacgagatagatatttaataaattttaagtagaatcatgtgaaaaattagataattttgttggtgctagccacgcaattgcgcggaccacccagctagtttgttttaaaaaagctaatttttaattaatcatacgctaatgagttgctccgttttttatgcgcgaggatgagttcccaacaccaaacaactcgaactctacgttagtgaccatcatattgatttgtggaagtgctagaagaacaggggtcatgactaaatacactgctcaaaatactacacaggcacaatagtttgagaatcaaccatcctaaccaggaaaattggagtatttaacaacaagaagtttcagaaaagattagcaaactgttagcagaatataactgatgacctgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttctgcctctgcgcgcgccgcgcgttccgcagctcggcgaacgtctcgcgctctgcggcgtcgcacatacgtgcgcccccacatgacatctccccctccgtcgagaggcagctcgtcctcgagctgtagagcagggtagcgggcgaagaatggctccctgtcctcccaggtagcagacgccgctgaagtgcccttccactggaccagaacttggcgcaccccacgggccaagcgggctttgatgactcgctcgggctcacaggccaccgcgccgtggtgcacgttcggcagcggcgggggagcgtctggaggcgcgccgtgccacttcttgagcagcccgatgtggaacacgtcgtgaaggcgggcgccggccggcaatgccaagcgagcagccacctcgttgatcatctccgcgatgcggtagggcccgaaataccgcagcttcagcttgccggagactgccagcgacagggacgctggggcgcgctggcggagacgcagaaggacccagtccccaacctgaaacgacactgcacgatgggacttgtcgtagtacttcttctggatggcctgagcttgttccaggcggtagcgaatgtcctccaggaactctgagcgctcctccatgcttttggccacagctgccacgcgggtgtcccccggttcatacgaccggatggagggagggtcgcggccatagaccacccggaacggggtatgccgcagcgaggtctggtaggcggtgttgaagacaaattccgcccacgggagccagcgcagccactgccgggggcgatcaccagtaaggcaccgcaggtacatgatgatgacacggttggatgcctccgactggccgtcggactgagggtggaaggccgtcgtcatgtggagcttcgtacccaccagacgcatcagctcgctccagaacgcggacgtgaagaccgggtcgcgatccgacaccatggattgtggaacgccatggagacggacgatctcggcgaagaagacttgagcgacggattccgccgagtatgggtgcgccaaagggatgaagtggcagtacttgctgaatctgtccaccacagtcagtatgacggacttgccgcgaacacggggcagcgcttcgacaaagtccagtgcgacgtcagtccacactccttgtggcaccggcagtggaaggagaagaccggcaggctggaggtgctcggccttgtagcgctgacagacctcgcaggtccgcacaaaatcctgcacaacgctcttcatgttaggaaagtggaaatcccggcggagtcggtggagagtgcgctggacgccttcatgtccctcctcatggacagcgcgcaggacctcctggagcaggggcgacgctgggggcaggtacaggcggccagcgaacaggaccatgccgtcggccatggaccacggccctgcgcgtgtgccggagcggatctccgcctgtagcgccaccagcgccgggtcgacgtcctgtgcttggcgaagccgctcgatgaagtcgaaccgtggcgcagacagcaccaagacagaagcgtcctcggtggtgtcgcgacgagacagcgcgtccgccacagtatttgctgcgcccggcttgtactccaccgtgaagtcgaagcccagcagtttgcccacccaatggtgctggggaatggtggacagccgctgatccagaagatatttcaggctgtagtggtcggtcttgacggtgaagtgccggccccaaagatacggcctccaatgccggacggccagcaccaagccgatgagctcgcgctcgtacgcagcgagggcgcggtgacgtggcgccacaggacggctgaagaaggcgagcggatggccgtcttgaatgaggaccgcgccaaagccgtgggaggaggcgtcgcactccacggtgaaggccttggtgaagtccggcatggcgaggatcggcgccgaggagaccgcggctttgagggcgtcgaacgccgccgtggctgcctcggtccaggcgaatccttccttcttgagcagggcggtgaggggcgcagcgatggtgccgtagttgtggacgaatttgcggtagtaccccgccaagccgaggaagccgcgcaccgcacgcgccgagcgtggctgaggccactcccgaatggcctggaccttcgccgggtccatggcaacaccagcagccgagataacgtggccaaggtatgccacggagtcgacgccaaaggcacacttgctgcgcttgatgaagagtttgtgctccctgagcaccgtcagcacagcccggaggtgacggagatgatcagcccatgtgtcactgtagatcaaaatatcatcaaaaaacacaaggacaaagcggcgcaagaaggagcggagcacatcgttcatgagggcttggaatgtcgccggggcgttgcaaagcccgaacggcatgaccaagaactcatacagcccgtcgtgggtgcggaacgccgtcttgtggatatcttcgggccgcatgcgcacttggtgatagccggaccgcaggtcgagcttggagaagaagcgcgcgccatggagctcgtccagaagctcgtcgacgacggggatcggaaaagcgtccttgacggtaagcgcatttagcgctctgtagtcgacgcagaagcgccacgaaccgtccgccttcttgacgaggaggaccggcgacgagaacgccgagtcgctgcggcggacgatgccttgggagatcatggcggcgcattgccgctcgagctcatctttatgagccgccgggtaacggtagggccggacagccaccggcgacgtgccctgcttgaggacgatggcgtggtcacggccgcgctgtggaggcaggcctgtgggctcggtgaagacgtcggcgaaggagtcgaggagcccccccaatagggagtcgtctgcgctggccgcgcggactgccggcccgtcctggtttggcgcgccctgccagcagatggtacggccctccaggtcgaacgtcagggcgcgtgtggtgacatcccaggacatccggcccagcttggccatccactgggtgccgaggacgatgtcatatccggcgagaggcatgacgtacaagtcgacgtggaacggcatgccctcgatggtgatgggcgcgtggcggaggacgcctgggcaggccaccttttcgccgttggcgaccgtggccgtcatccgtggccgcggctggacggacagcccggtgcgagcggccgccgactcgccgatgaagttgtgggtcgaccctgtatcaaccaaggcgacgagcgtggtcgcgcccagctgaacccggagcaggatcgggtgtcccacggcgacgccggccacggcatggagagaaaacaccggtgcctccgcgtcgacctcgtcctccggcgcttcctcgtcctcgtcctccacgctgtccacaaagaacagacgtttgcaaaccttgttgtggccgcgactgtacttttcgtcgcagttgaagcacaagccgaggcggcgacgttcctcctgttcggcctggttcaggcgcctgaccggccggttatcagcagcggtggcggcgggcggcgcgggcttggcagccccagctggagccggcaaggcgagttgcggccgaggcgcaggtgccggcaggacaccccgaccaggagctttggcgggaacggcggtgtactgctcgatcagctcgaactggcgggcgaggctcatggcagccgccagcgactggggattctgcatctggacttggaggctgagcggaggaagaaggcctccggtgaacagctgcactcgctgttcttcgtcgaggcgaccggcgcgggggagcagggcctggaaccggtcctggtagtcctccactgtgcccgtgcggcgacaggaggacagctcgaacaggggagcggaccgcagaggtggcccgtagcggagattgaggagctccttgaagcgagtccacgtcggcgtgccgcgctcgtcttcttggacctgcatgtaccaaagttgggcgccctcgaggaggttgtgggaggccatccaaaccttctcctcttgcatgattcgctgttgcaggaagaaggattcgcagcggttgatgaagattagcgggtcgctcttgccgtcgtagtgcgggaagtcgggtcgccagtgcttgggcggccggtctggcggctgatcgccaaagccggggcgggcgccggacgtagatgaactggtggtggtggcgagcgcagcgatcgccttggcgttggccgcgatggaggcggcgttggccttgatcgactcgtgcatcagcgccatgtccttggagagggcctcgatggaggccttgaggtcgtcacccatgtggtgggccgagcaggacgcgactgagggtgaggacgcaggggaggcggcggcagcaggtgggaaattgggcggagcgacagcagggccggcggctggagtggtggtggagtcgtagatgggatcggtggtggctggggcagaggtggagtcggcaacggaagacgaagatcgacgtgaccgcgataccaggttgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttccgcagctcggcgaacgtctcgcgctctgcggcgtcgcacatacgtgcgcccccacatgacatgaccaccagcataacattactgctaatatattatgcacatatgcttccttcaaaaatattatgcacaacacaaaagtagttgcagacttgcagtaaatgcaaagttcactagctcaattgaagcatatttctccccgggaaaacaaccaaactgcaagggccatctaacaaacacagggaggatacaccatcatcgaattcaaatgtacatatctcgtggcagaataagcccacttaagagcctcattggtcagcctaataagccaaagcaaaagctaaaatttaaaatttcgaacttaattttagagttaattttaagatatttttaatgtaactttgattttaagttgctacgaacaaatacataaaaactttacctataaattaatttgtattccctagtaaactgttttggtttattagaaaatatgggtaaccgatgaggctctaagtttcgaaatttcacccgaaatttccgttgacccttaacaattacaagaagacagacatgtaatactgccacacagatcttcgtaagatcgtaagagacataactttgcagcggaaataatacggggggatttgaatccttgcggcggatcagcacatggattccgccccaaacttcatcgtgtccgcccagaacttggcctcctgcgcgcgggtaaaaccccactaatcacctggatccagcgtgttagggtttcgagggcacggaacaaatcgcgccaagagagagaagaagaacaagcggcgggtagatctccttcttcacgacgctgccgctcgccattgtcacctgctgctgcgaagctctctttctctctctcctctcttcagcctcacttcctctttcttctttcttttgggcttgactcgttttcctcttcctgggccggctcggcccggtctgactgctaccatgggcttggccagcgagtggccaagacatattcgtattcggtcacaaaatcttatatactcagcaccctctctcaaatcaatcacagccgagccgccggattattgcggccaaaaatcatacgtgcaattcagctccagtctcaagaattccaaagatatatcatcaagtcgatcaccagccatggtccctctagaaaacctacgcgacatgtgcggcgacatcatcgagaaggcgaccctggcgcgagatctcatggtacccatcgcaagccaactgatctccgaggacagggacaggtacaacgacctccatcgacattgtgtcctagcccaggatttcacgaacttcctccagaagctcaacaaggtgagcgcgctcgaccaggtgtgcacggacatggtgacgttcggtgccattgaagctatagccttgtgcgagaggccgagcaacgccttgattgtctttagggatgaagacagtgtagctatcacggtccataggcaggaagaggtcgaaaatgggctctatttcgcggtcccgcctctccaccttgccctcccatcctgtttcatcgaatccaaaattatcaaggtacgtattagtttgatcgatgtatgtatgcatgtatgtatgtttcaatctaatctctccaaaagttttaaaaaataaactagtaaagaattcagactctaataacttttaaaaatatatgttctaaaatataagagattatctgttgtcctatgtcaaactatcctaagtttagtttaattaagttttgtaaagtagagtaataacatcaaacaaataaattataagaaatatatttcataatgatgcttatttggtatcataacacgtaaacattcttatttcttcttttttttctataacgaggtaagaaaatctaaggacgcatggcactaatggcactgtgcaattttatctctattttatgtagagaaaaagaagttagctagcagggacaagtaattcgatctctagtactaacaatgattttttatctaaaccatgcataaattgtttatgaacaaaaaattgttatgctaactatcactagaatcaattaggtcgctctgtatccatcagatccgtcaagtgaaggaaccacgaggccagcatatgatgcagaagctagcgca

SEQ ID NO: 72345 - DNA, 4405 bp, Oryza sativa
tattggtgggaagagagggggtagaagggtacttgcctcatatagtgaatcaattttatcaaaagactggccattagcatggagttctgctcctattcttaccaatcaagcaattatccctcctgaatattcttggggagcatttcgactaaggagtcctcctgccttcacaacagttctgaagcacttgcaggtcaatgtcataacatgcttatatgtttctatcttatgaaaatgttctcttattttcttttctgaaacaaagcagagtgttgggagaggcaatggtgaggacacactggcacactggccaacttcatcaggaataatgacggtggaagatgcctttctacggatcttgcaatacttggataaaatatggggaacaatatcttcttcaggtagtgcaaatgcaccaaaattatgttacctccctgtatatgccctacatttgttgccactgggtaacaatagcttatgttattatcattttctctttccttggttttagttactagcagcgattttttttttcactggaaaacacttgatttacttacgcttcattgcatggccatatttgagtacaatcatgcaaagcatccctgtaggatttaggataagggttgaactgactagattcatatgaagggtcaaatatgtactccctccgtcccagagacatcattttttgcctttatttgtcccacaaaggcttcatcattgagacaatcaatgcattggagtttgagaaagtgggggacaaatgcattgaaatttgaaaagtggaggacattctagtatttgattttgtattgggacggaggtagtactggctaattgtgccaggccggcccaagataggccaaccagtagctggttaattgtgaggagtaccaactttttcttgtgagtttgcatgttttgctcctagtaagaattttgaaatcttgaaccgattcacaatgcactcacttgaagtgaagttcattaaaaaaaattttcatactgttattcgtctcgggatgttaaaagggaaaagggggtaaattgtaagcttgttcaatttaatattttgaacaacagttgtctggcagatcaaagcatttcacattgatcttactttcctgaggttttattttgaaaacccatggagacaacatcatcgtattgaaattgacctgaaatgggcatgcaatcttccaatagaacatccaaatttgatatttgggaacagctttgtagactcttcattttgatatttaagatgaggtatttagagtggcttgcactatgtatacaagctcagtcttgattctttttttttttggcaagaattattatgttgttacttcttcctgaagaaataaagatatatcatgaacaggtattatcttgtcagtgtggtcatgtatattgacgattcctataagtaattatagtaattactatgtcatgccctgtgcatatgcttttttatttgctgtataaataattaaagatagccacacagcggaaaactgtaattagtttttgttgctttggaaagagatatatcaatactctagttaagttgtatttctttctttttcagagaaaaatgagttgcagaccctggcttttataccagttgcaaacgggactcgcttagtcacagtgaaatcactttttgctcgtctgacaatcaacatgtcgccttttgcttttgaacttccaagtctttatcttccatttgtcaccatcctcagagaaattgggatgcaggaaacccttacaaacacttatgcaagggaacttcttttggatatacaaaaagcatgtggttaccaacgcctgaatccaaatgaactccgcgctgtgatggaaattttagacttcatgtgttctggtgtcaaccaagccacagatggatcagaagacatatttgattcagtaataccggacgatggttgcaggctggtatcagctgtatcgtgtgtatatattgacccatatggttctcatttactgagtaacatagatacatccaggataagatttgctcacccagatcttccccagaatatttgcaacacgttgggcataaagaagctttctgatgtcattgtagaggtactactattataggatctttctttttttatggctgtaagtttaattaattttgtatttttcaaataaacataagttttttcccttgtcaggaactggatggaaaagaagaactaaagatggtgaatagcatttgctctgttactctggacaaaataaaagagaagctgcttagtaaatcgttgcaagatgcgttaaggattgttatgattggtgtatccaatcattttccttcatttgaagcactcaatctggcgcagatagaaagtgtactaaaggatatatcacagaacctgcagtttgttcagcgtctccatactcgctttctattactccccatgctccaagacgttacaagaagcagccagcgtcctccatttcctgaatggtcaagcaatggaaagcacagaagtgtttgctttgtgaacaaatccacgggtcaaattctagttgcagagcccccaaactttttgacaatacacgatgctattgctattgttgttagttacagattaggggcacccgtgatcttgccgattgcttcagtatttgcatgcccagatggcacagagaaagaggtgcttaaaatactccgtctgggcactgacattggagtttcaaaacgtgaaggaaggtacaatggttccctgggagcagagttgttgtcccaagatgctcgccaggttcaattccttcctttaagaccattctatagtggagaaattgtggcatggaagacggggaaagagggtgaaaagctcagatatggcagggtccctgaagatgtaaggccatcagctggccaagctctttacaggtttccagtagagacttctgctggtgaaacttgcatgctactttccagtcaggtttactcatttaaaagcgtttcaatggctgatctctctcctgcaccattgcaactggatagtggtagagctgcaggtggacagcagggcttctcacccatcaacacaggaactgaagctgcagatgatgtggttagttttatttttgtgcaaattctagttttgctagctgtatgtgttgtcgtaatttttgtcgtacttcgatttacaggctactggccttgaatatgggaaggtatcttcaaccgagctggtacaggcagtccacgatatgctttcagctgcaggggtaaggatggatgctacaaaggaaacgcttctacagactactctttccttgcaagaccagcttaaagaatctcaagtggctctactcgtggagcaggtttgtccacttcgatatcttcttgggttgttttatattcatttttattgtcaacatcaagaatatgttttgatcagttctgtataccataagagagtagttgtgacccgtaatctgtagcggcacctaaagaaaattgatgtggggaggcatttgttgttgaacgtcatactattggatgctgctgcacacgctgtgttcaccatgctttctttgagatggagatgagggtgggttaagaatttttctaggatcttcaggcattcctttttatgttcattatttgcacagagaatgtatactatcaggttataaacaagctaccaattttagggagccccaaacttcataatttgcattgcctatcatattatattgtatcgtatcatataattactttcttagctctttctgcttatgttgtatgttgtgggtattgaaatttgttttaattgtcactacaggagaaagcggaggcagcagttagagaagctgatgttgccaagtcagcatggtcatgtcgtgtctgcctgaatgcggaggtcaacatgactataataccatgcggtcatgttctttgtaatcgatgctcaagttcggtttcacgatgcccattttgtcggacgcaagtatctaggatgatgaaaatattcaggccttaatttctctttctacaactttcgctttctattagtatgtataatattagacacgttagttttttagctgtaaaactatagggctgtaaatcgagggtgtaaatatacattatagtccatgtacagctacggtgcattttactgtgccgattctttggaaaatcgaagtattcggttccagtttgaggcgaaatctatctttttaaaactgggatgtctcaagacatcttaggtcccgctcttttttctaacaagagttggattaagattaagattttcgtggcacgttttttaaactactaaacggtgtatttcgtgtgaaaactttctatatgaaagttgttctaaaatatcatactacctccgttttttaatagatg

SEQ ID NO: 72346 - DNA, 45258 bp, Oryza sativa
  unsure (1)..(45258): unsure at all n locations
gaagagaggcaaggttgttttgcaaatcttttgtttgaagtccattttgaaaccactaagtgatttatttctttctaagtttgggccgaaaagtgacttgcgtctcgattcgactttaagagatgtttttcaacaactcaatttgtaatgtaccgacctcccgggtcagatcattacttctcggctcacagagccatttcacttgattaagcggctcctagagccttattcatgttctcgaactcccagagtccagctgcccaacaacacaacgatccgcttccactcgggaagccaagtctatgatgcccgcagacatcctgaatcacacagattcgtttcttgaccactcaggtcatccatctgccacataggctgattctagtaacgattcccaatccacaacaatttttcacaaagcacaggcaaacaaatctacgctacaggaaacacctcgcatccgcccatgaccgtgggcacggctgttcgaacagtttaataacctctgcagagggggtacactttacccacacggcattactaacccggatcacccagcccgttcagaacggccacgtatggagaccttgaggctttcatgacaaggcaattcgaaagccgacacaggtttaccatatgccaacgagaggggtcccagaccaacacccggttaggtcccagaccatactatgccaggaagcccgagggttctccccgataccaccccgttgaatccacatgtctcttggcatcatggctcccctgattagctaccggggtcggcttgacccggtcttggccgagctgcccctttctctcgggccgcgccctagccgcccgagggaagtctgtttcccctccctctttcttttcttttcaaaagggtttaattaaatcctttttcctttagaacaaaaatccaataatcttagaaattcaatatcttctcaaccgtatgtccgtttgactccgttcaacttccaaaactcctcaaatctcgatatctatttaatggcacgtttagaggtcaataatagggctttatttttgccgtttgttgagctgtcccgtttcgcgtgtagtttcggagcccgaagacccgtagtgcgaggatttcgaggatcaagctcaagatttcgagcaaggcaagtcacctttgatcatcttgcacctataatttaaatctaagtatttcttttccgcaaatattgcatgaataagtttaacacaagtatttcggccgcggcttgcgagatagcttgccggccacaatcctaattgctgcaattaccctccttgaattattgaacacttagatctcctttgtcgactgttgtgcttcgatgcatgggccttcgggctcgagcatcggaacacttcccttgaaatttaaaatatccaacgatgggtaaaacttggggttttataaaagacttggaaaaacccgacacctgggtaggtgcttgcgaactaaataaatttccaaaatcgtagatcggggaatgtaccgggagtacggtttcccgctcttgcacttaaggaccgttttctttggaatttcatccaaacataaggcaaatgtgaccacataggtggaatgggacgcccctggctgagtaattagctaatcaggggagccatgatgccaagagacatgtggattcaacggggtggtgccggggagaaccctcgggcttcctggcacagtatggtctgggacctaacctgatgtcggtataggacccctctcgttggcatatggtgaacctgtgtcggctttcgaaatgccttgtcatgaaagtctcaaggtctccagacgttgccgttctacacgggctgggtgatccgggttagtaatatcgtgtgggtaaagtgtatcccctctgcagaggttattaaactgttcgaacagccgtgcccactgtcatgggcagatgtgaggtgattcctagcgtagttttgtttgactactgctggtgaaattactgttgtggaatgggttcgatgtttgaaaaatctgcggctgatgggatcagccaggcccgggtggccgtttgaaagctgttggacgggtgccaaccttgaatcaattcaaaaactgatacattgcacatactccgaccggacgagacacactgtctcatccgtgtcgtttgagaagcactcacttagttgtttcaaaaaggagtttaaataaaaccaattgcaaaaacaacagcctttcttttgaagcctgcattaaacacttaattcccatggcttgctgagtactcctgtactcacccttgctctatgtaaataatcccccccaagttgctgaagaggatgatgtggatcctgctgatgaggagttcttccaggagcaagtcggctacgatgagttttagggtttcggcctagttcccaagtcgcgcctgtgatgaatggtccaagtcttggcttccgctttcccttttgtaatgcagttgtgacctcgggatctgtccacagcccaacttgactgtactcctactctataataaagagacctctgttgctatgatattctgtcttcctgtgataccagcactgtttcctgagactggtatcgattaacaggttaatttggagcgtcacaggctagttccgttcggggctagttcggggcgtgacaaatcaactggcacgctagtacacccaaaggcgagctttggacctgcactggagttaagcaaatctcccaggcctcgtgttttctgtcactacatagtaagcaactattgtataaattaaccattagattggctatagataaattggagctagtagtgggctatactattaagctttctcagatattataagccaactataaatacatattgaggagataaaagaagagagagagtagcagcgggctacagatctgtaaccagctgcagtacggaatctaaaacacaacatgtgtataatagggaccatatattaatagtgtagtatatgtgatatgtttatagataactatcgtataaattgattattaaagtgatcgtaaatgatttaaagcaattagttaattagttagctacaccactagtacattaaacttgctctaatactagtagtagtgcaactaggactgtagtaggagtatgtaatcatgatgttgtacttgctatcctgattaggagttgtgactgacgcattcataggacgagacagtatgattaaacggaacaatgactgttcacttctaatgacacattaattcgaccaaaagggtgtgcatgctctcacctggagtggtagtagtacagcgaagagggatcctgattttttatacggtgggtatcgcccaactggtgaccaacagtacatatttctggtgtactctacacaaagaaattgcacagttttttttctgagtatatatatatatatatatatatatatagagagagagagagagagagatgagtgtgaggtgggtgtggggtgggtggctgcaggctatctgcgtggggtgtcagagtctgcctgtctccctctcactgctgctgccatctgcaacctgcaccgttgcagtcaataataataataaacaataacattcaagtggggcctctcgctactgcgcatggtggcaccgtggcagcatccacccgcagggctcctctgacaccgaccagcattgcccattaactatagaaacccatagtgccttctactgctacatgcaccaactaccattcgacgcccgaaagattttactactaccctagaaatactgttcttgcggtaatattcagaagaaagcccccaaaaaataataatataacttatctgaaaactaaattgtgctcaaaattatttgaaatgtataaaaataaaccacaaacatcagcgctaagcctggtaatgtcaaagtccaaaaacaccatatattttgacaccaccatgttgtcgttgcgtcctaaacgagttgttcaccgagactaggccagaagtttaagatatcaacgaggctgtggtggcgctactttttatcctccgtcaccattttgtgctaggtgagttgtccgcaatattagctaggaatttcgaagcttgacgagaccacaccaacactgtatttgatagagctcgatgagggatagcaatggcaagctctaggtgtatcgtccttgcaaggttcctttgcactaaccacttatcaggtggatgagtagttctatgctaagatcatggtttattttttatatcaatgtctgatgtggttcatcgttgaaactaaatttttccacaaagatcgaaccgtcaaaaatttggatagaagaacaagctatacgccatgcaaagggccttattgtttggcttttttcatagtaagccaaaacggcttattagagaataaaaataatttgtagataaaagttttatatatgtgttctcggtgatttaaaagccaatgccgtaaaagaaactacgttaaaaatatctcaaaatcaatgtcaaaattaagtttaaaaattcaaattttgtttttttttctttagttgaataggctatccgatgggagccaaagtttcccggtgacagtctagactatagagacgacgaccaaagcgcttacgactacagtaaatacggcatcaagcggcggtggccagttgctcgcgtcgtcgccggggagaggggagacgcgaggaacctgtggagtttttgcgggtgagattcctacggctgcgcgcgcccacgaggggggcgcacagcagattctgcagcgcactctctgctctgcctctgcatcttgactgaatgacctatcttctgtacccgggacataaattatcggagttaaatatccggaaactattcaaacaggccatcgttcgcacgcctacgtttttcttttaagaaaaaaaaaatatgtcctctgcttcgctcacacgcacgtactactacgtgggctgcttggttgcaagcatccttttatgacaaatctgtactgtgcggtagggttattttccattcttcctactcctacggtttgttcttgacattttttttcacaaagaaaaggacggaaggagtataaagcatgtcgcttgtccaagcaaaagaacagtagccagtggcaaacaaagccctgtttaattcaccccaaacttcccccaactcctaactttctatcacatcacatcacatttaaaactttcctacacacacgtaaactcccaactttttttccaaactaccaactttccccaaacttctccccaatttcagaaactaaatacaaccatagtaccactggacaaacgagtcctgagaatgaaagtgattgactaaaaactattatggccgagtttagtttcaaagttttcttcaaacttccaactttttcatcacatcaaaacttttctacacacaaactttcaacttttccgtcacattgttacaatttcaactaaggctgtgtttagttcacaccaaaattagaagtttggttgaaatatgaacaatgtgatggaaaagttggaagttcgtgtgtaggaaagttttgatatgatggaaaagtcaaaagtttgaacaattattttcgaactaaacacggagtaaacttccaattttatcatgaactaaacacaccctatgtgtaaatgtctcactgttaatgagaagtgaaagatctataaatttctatccggcctagaaacagttgaagtaataacatcactaccttaactaaagatgttgggtttttttttaaaaaaaaacacattataaacgtacacccacctgtaaacatatacactcactttgcatattcggttatattccgacaatataaatggcaaaacttgaaaggtgccatgcatagggaaaaaaactgtcatgctaaacaggaaaatacatacttggtgtcaactacttcgtgggttattatattttgacgaacgcattagtgttaattcacactataatatatttgttgaaatacttttcactaaaaacaccctaatcgctgaagcggtaaaaaaagattagatcttatttggactatagggctcgtataatatgtttgatatgtcattttaaagtttaattaattagataattaccttctagtttacaaatgtctagaacttcaataacatatctggttcatatgatgtcacaataaaatgccagtccgagtgattttctttctaaccgtcgtctaagccgtacatacgtaaaatactccatttgtttctaaatatttgacaccgttgactttttagcacatatttgaccgtttgtctttttcaaaaacttttgtgaaatatgtaaaactatatgtatacatataagtatatttaacaataaatcaaatgatagaaaaagaattaataattacttaaattttttaaataatactaatggttaaacgtatttaaaaaaatcgatggcgtcaaatatttagaaacggagggagtatatataagttagactcatgataatccaactctatacgttaatattgcaattttaaaaggtaaaatatactttttatgcaggactaattgactgtattgaaagatagttgatgcatttacgtagtagtacagtaacgttttatagaattcacattcgtttaattaaaacccaccgtttattaattagaaaatgtattaataaatggccgaaacctgatatttttggcaggcaggagcgcatttcgcagtattaccctcgggttttcttctggatccggaaacagcctccggctcgcaagtcttaaatgcgcacggacgtcgcttcccaccctcaccccacccttccccgcccattacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagagatgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcacgtacgttacacacatcctcctccacgtacgtacgtacgcgttgttgccgatgctaacaaagtccatattgtgattggtgttttcttgggaatgcagtggggtggggttgctttggcatggggtttgggcggaaggcggaggacccggagccagggcgatgccggcgtacggacggcaagaagtggcggtgctccaaggaggcggtacccggacttcccaaggtactgcgagnnaagccaccatgcaccgnntggcaanngaaccgtctcaanngaaagnncctgtggaaatgtccttggccacgccgccgccgccgtcctcctccgccacctccgccgcgtcgaacacctccgacggggtngcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatggtgcgtagagtactaaccttcgtctccactgatcagaaccgtttcttgattcttatggcgagccgtgctgacgatgatccaacttgcttcctgtttggtcttgtgcaatctgcagatgattaatctcttgaagaagccaagaagtgatcaacacgcggaagaaatcaacagcttctttcacggcgtgcgagctgcatgctgatgctccaggatcgatcgatcgatcattgcatctccaaactaatcacgcttcgatctttcaggacttcatcaatgacaggccgaaacctcctacgagttctctgatgatattcttatttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagacaagcgtgttcgcttttgtgaacgccctttttcttctttccgattcctctgcctgtgatagtactcgctccgaaaaaaaaaaaaaaagcaaaccgtggattcttgggtcaacgtgtccgttttatattgtccgttttatatgaaatttttttataattaaaatttctattgttgttagatgataaaacatgattaatatgtgacttattttttttatatattttttttaaataagacggacggtcgacacggttttttttttttttaagaaggagggagtaagtcacatctctggattctgctgaaaagctcactagcgccatcctgcttcagagaatactttatgctttctgacaagtcggtgtaggagtagtagtattgctaggtgtactccactcccctccttaagtacattaccagtgcaacgtaaaacagctttgctcctgagcaacggaaatgcttaataccgtactcttgcacttcgtcagttggttgagtacactgtgcaagtaccaaattggtcttcttaagtgttactactaggttgatcacttgttgaaccgtttaggctgtcgatcattagcattcagggttatcactgcaaagtcccaaacaaaaagattctcccagggtctattctcccctgaaccgttttcccattgaccggccaatgctgcaagaagctggatgcagagctaggagtagctgcagtgcccccactcctgcaccttcctgcagacactcagagagagggagagatggaggactgtgatgactgaccagcacccctgctttggtctccatggattcaatgccaactgcactgcaattgctgccggccccctgagacaatgtcaggcgctgtcagctctcgcgtccatgcgattgaatgatccattgctggcgtttggaccgtcgcctctcctcccctgcctcgcacacagtctgcagcgcatgcatgcatccatcatgtacagtgcagcattggacacaagcctccacatggagtaattgttactgaagaaattcccagaaattacatgtcccgcgttacagctttcggttcatccaacagcagaaattaacctgagagagtgtttgggaattagtactaaactttagtttctcttctagagacttatgttttttagaaagaggctactcccagacaccccctcagttttcgtagtactggcacctgcctatatgtgctggttttcgacgcgtactctactaatctggagtttactccaaaacgaggaaaaactcagctgtcactgtatcatcttcatcaccgaatccagcggagcacgtactgtatgacgtatctgttctgacagcgaagttgaacaaatccacggcgcccagtattcccacgacagagcccacatgagcccgtctccagcacgtacgcgtacaataaaaaggctgtactactactctgtatacacatctgcggctctgcacccatctcgtcagcaaaacgaaacgcatgcatagagaggagaacgttcaaaaccattcattcatcaaccggaggatcagctgcacaagcaagccacagtgcagcatgcggtgaatcgcacgtggagaggctcaggtgaccccacgacttgcacggttttggctcgcaatatcgcgacgagacgaggccgtgacggcatgttattctgctcacactgtcttcgcctcccccactaccacgaccactcgcgtgttaagcccgcatgtgcttgcacctgatcccgtggcacgtactccctcggtcaaaaaaaaaaaaaagagaaagacaaacccagaccgtccgtcttatttaaaaaaattataaaaagaattaaaaagacaagtcacacataaaatattaatcatgttttatcatctaacaacaataaaaatacgaattataaaaaattttatataagacggatagtcaaagttggatacggaaaactaggatttgtcttttttttaggtggagggagtaatggagattttttttcccgttttggacgggttgttcagtcagtcatggctgggagaaaaggctgtggagatgagatttttagcagcggtgcacacatgcgtgcacgggcaacctagacagttgggattttactactgacaggaagaggttgaattaaactagtgtcgtcattcgcggcaactctgagttaggacagactgattgcccagattattcggtttttagtgtatcggcgagggcatctgacgccctcgggatatgaggccctgcaacgtggtggtcgcgggcgccggagttctctcccggttagtttacggagcaggaggaggtcggcgactacttctactacgctctcgttcagtttcagattcttaccgctgtatcgtggcgtttagtttaaaatccctcgcgcgtttggggtgaagggatccgatgtgttttttgcagggatgtggcctggttttccgtgtgtaggggagggagatgtcacggcgcgcgacagcatttctcgtgacagccgcttaactaaacgcctcaatctgagagctggtcgtcagggatcagcatctgtcaggaggccgcaaccagtggttcagctgcaagtgttaagaacagtaaatgatcagctggtggtggtagtagtgctgctgctgctacttgcagtccctgcagtgtcagctgaacgtcaggggacccttcaattcgctggaattgtactgcggtgacatcatacaaaccctggaccaaacgaaacaaaactaggaccttgatcacttgatgcggctcggcttggttggctactggatttaacccactctttgctttcgtccaccctcgatggccggtttccagttgagtaaacaatgtacagcttgtgttgttcacaccaaaattagaagtttggttgaaattggaacgatgtgatggaaaagttagaagtttgtgtgtgtagaaaagttttggcatgtttagttcacactaaacttcccccaaactctcaactttctatcacatcacatccaaaactttcctacttacataatcttctaactttttttccaaactaccaactttctccaaacttctccccaatttcagaaactaaacacagcctttgatgtaatgggaatgttgaaagttcgaagaattattttggaactaaacacggccacagtttcttcatagatttgttgttactactccaggagtactatcttttataccggtcaacgcacagcttacagcaaaatgcaatcccccccccctgctagtgaacagtgtctcatatcccatccaatgacccaaaacctgcacctgattgaactactcaatgaggctgtatttagtttctgaaattaggaaaaagtttagggaaagttggtagtttggaaaaaaaaaatagaagtttatgtgagtaggaaagttttggatgtgacgtgatgtgatgaaaagttggaagtttgggggaaatttgatgtgaactaaacatggccgcacaatgatagaagtgcaatgtgcaaaatggtaagcaatcagccaatcaccacaatactggaccgcgttatcactcatcggtgtcaaccgctgcggcaacgtgggccgaggcttcgaattcgccgcgccgcgtgacggcccatcagaatacgagatgggccggcccacccgcagcgaactcatccctgcccaggccagcccatccactctgggatattgtggccgtccgatgcgatcatgccaaatctatccaacggctggtgtatctgaagcgtgtcgatgtcttcctccgaaaggagcagcctccacatcaaccgcctctctcattaattagcggaccatttctaattcacccctcgcatcttttcgaattttcgagagctcaaagcctcgaaccattcccttcttcctcgtcccaatccaagttccaaccatccagggcgggggttttcccgttaatccgcgcctctccgtgtcggattgaattgaagcggagagggggaggaggaggtggaggtggaggtggaggagggcggcgggtggcgatggcgatggcgaggctgacgccgaacggcgtggcggcggcgctggcgggggacacgaacctgaagccggtgctgcagatcgtcgagctgcggggcgtccaggtcaacggcgcgggcgtcacgcgcggggagaggttccgggcggtggtctccgacggcaccgccgcgtcctccgcgctcttcgccgcgcagctcagcgaccacgcccgatccggcgccctccgacgcggcagcattgtgcagctcagcgagtacgtcatcaacgaagtcggccccagaaggttttgttgcctcctcctccactttcccccccattcccctgcctctgatcgatgtgtgattgcgtgcgatttttggcccgtttcgttttagggttcatgcttgcccctggttttatgtgtgtcagtctgcgtgtggtttagattcccgctttcagctagtttgcaatttaaattaatacttagtacttgccattctgttggtaaattgtcgatgagcttcatgtttcctactagatactagtagaggtgcatcaaaatttttctgacaatggttttgtttatgacatcatttgatcggtgcttgttaaccatttgtccaattgattttaattctgatttgaattattattgtcagaaagaggcctcggtattgcagtactaatcagtggtaactaaggctgtcctgtgacacaaattggtgtttgtcgatactcagtagttaattggctggcattagtattaacgattacaaaatagtgtgatatatgtgcttgggtagcctttggtgttcgccatttctggcaggtagcatgtcaaacgatgaaggtaatatggtcagtttgactactacacactttacagtgttgtctgatttagttcactaatttagttgtgtgcctttttttctctagccaacaaatcgccatgtttgggtgcatcgatttggccaatgtagttagatattgatcagcattaatgctgcaactgtctggtgctgtgaacagtttgggtctaagtactaagtattttttatcttttagctgtagccattcagttcaacacaacaccgtactaaatgcatttcttttgtatctggttcataagtaattggaagcatagttgtgtccattcaaatcatgttggcaaggcgacaaatgcaaaagtgaagataagtttctgaccaaaaggtgttgtaattaaacatagtattcatgtagcagtgtgaatcatcatattctgagccttttgcattcttattttcaactgatctactggttgatagagcagaatcaagaattgttttttgttggttgagctgacttgttgcaatacctgtaggattattgtcattctgaacctggaagttcttgtttcggagtgtgagataattgggaatcctacagcgctttcagaaactggatctcctatcccaaatccgacaagagtagagcaatttaacggagcacctcaatatggtttgatggcagggaactcatcaaatacaaccacaaagcctagtgacaatgttccattgttccaaaattcgatggcaggaaactcctctaactttgccactaggcccagtgacaaagttccggtcttccaaccaacagtccagccatcttatcgccctgcacctaattacaaaaaccatggagcaatcatgaaaaatgaagcccctgctagaataatccccatatctgctttaaatccttatcaaggccgctgggctatcaaggctagagttactgccaagggagatatccgccgataccataatgctaaaggtgatgggaaagtattctcttttgacttgcttgattctgatgggggagagatacgggtgacatgcttcaatgctcttcttgatcgattctatgaagttgtggaagttggtaaggtctatgtggtatcaagaggaaacttgagacctgcacagaagaactataaccatcttaacaatgagtgggagattttattggagaatggatcaactgtggatctttgtcctgatgagaacagttccattcccacccagcggtttgacttcagaccgatcaatgaaattgaggatgcccagaacaatgctatccttgacatcataggtgttgttacatcggtcaatccttgcaccacaatacagaggaaaaatggcatggaaactcagaaaagaactatgaacctgaaggatatgtctggtcgaagtgttgaggtaaccatgtggggtgacttttgcaacagagaaggctcacagcttcaaggaatggttgaacgtgggatctttcctgtgctggctgtcaaagcaggaaaagtgagtgatttcagtggcaagtctgtcggcacaatttcttcaactcagctcttcatcaaccctgattctgctgaagctcatagtctcaggcaatggtttgatagtggaggaagagatgcttctactcagtccatatccagagatatcacgcctggagcatcaaggaatgagatccgaaagacagtagcacagatcaaggatgaaggtcttggaatgggggacaaacctgactggattacggtgaaagccaccgttatattcttcaagaatgagtccttcttctacacagcttgccctaacatgattggcgacaggcagtgcaataagaaggtgacaaagagtactaatggcaattggacctgtgacaaatgcgatagggagtttgaagagtgcgactacaggtatctcctgcagtttcagattcaagatcactcgggaacagcttgggtgacagcattccaggaggctgggcaggagttgcttggctgctcggcaacagagctcaacgcacttaaggagcgcgaggaccctcggtttgcagacaccatgctcaattgcttgtttcaggaatatctgctcaggctgaaggtcaaagaagaatcatacggcgatgagcgcaaagtgaagaacaccgcggtcaaagtggagaaggttgatccttcgggtgaaagtaaatttctgctggatttgatctccaagtcctcggcgctacattagcagactgtgctactctatcagctgctcgctcgtgcgtggtgaggtgagcgaggtgaggtgttgcagtgcccatagccctcgccctcctgctcgatttttgtgccggtactttaatattaacgccacttaatagtttatatccagattagtgctttaatagtttatatccagattagtgctgatatttccatttttgtgccggtactttaatattaacgccacttaatgtatcagcttttatacctttttctcgatcaaatgattgccttctagctgcagtgcaatttctcccttagttttggtttgtacatgcctgcaaagccttactctgtcgcgactaagaaatctcttgtgctcttccatgcaatcgaacatctgttttacattcgcaaggctattaggacttgggttagatgcaaacaagcggatccagagaagaagttaatatccgtgcaaacgaaaaaggagcatttattctttcaataacaaggtgtttaaggtgactatgtcaatctcaaggtacgttagtcaaatctctcggagaacataggaagtgttcgtgtgtagaaaaaggagcaaacaatacatacgtcgactctttcttttgcacgagaacgcgagtcgcgatcacaactttgctatacaagtgtggtattcacagacgtccaaaagcgtacatcaatctcagtggtttccccctctatttgcatgcaacacgtggatcacaagaaacccgaaactttcccctgtacaaccgtagtgctctgccctgaaaacttgatcggcactctcacgtcgccagcttgagactgcatctcagccagtttttttactcgtagcagaatcgacactggtatcggtatggcagaaggattgctcttccgtggacaaacaccctgttcagtggcaaagagaaagttgggtaaataaatcaagatgcaaagcaaaggggaaaaaatgccagaacgtgagaaagtaggtcgaacagaacagcctgttcatcatacatcgttttcagtggaaagttgtgtctggctggccctgatcagattccgccatttgtcctgaataagcatcatgattcattagaagaaataaaatgcacgaacaaacctaggagttgaaaaggcaattgcaccttaagatccaccgaggtgcggtacgaatatgatgagaaggctagtcttctaatctcggaccatttgccagccccatatcgggccacaccatcgaccagcttcacaacctcacacaatgtccatgctcgatgatgcttccgcttcccaccccgctttgttttgggattgtcatcagagtcgcaaaaatccttgtcctgcagaccctgaacatccttttcacaagatgtttctacatgtactcctttcttcccagtgttcttctgctagcaagttgaagaaaaatattatataacacataatacagaagtagattacacagcattaagccattgaggtactatgtgtttcaaatatatttctagtcagtacttcattctgaagttggattttcactatattgtccaacatgaagaaacatcatactagtggaacttctatggctttgcttacatggttcttccgttcaccttccttttccaaattcactacatctgcagcaggggcctcagtacattccacagaaggctcaggatcctgatgcaataaaaaaaggattcaggtagctacattgagataattataccaaatctaatagcgtatgacacatgaaaatatggttttgtcctaaattattctgaattggtatatggtgcaatatggtacatcagatcaaatggaatattggcacaatgatgaggaaactatcaaataaagactacaatggcaaaatcagttaacaaaaagttcagagatttcccacatttaatttatgaaatatagcacacggtgtttgtaggaagtaccatgggcaaagagtgaaattgtgaaaaagaaaattaataatctgcttgattgaaaatgggcatgagtctttagttagttggcttccaagaacattttcccttagataagtttcttaggtcagatgcattctgagcaggaagcaatttacaggccaaaatgcgttaacataatgctttatggaaatccatattattttgataaatagagaaggtacttgcaatctcatatcaaaagaagaaattctaaaaaggagcagaaaaaggaagcatctaacataaaaagaggacatccctaaaatagttccaaaaatggagtaaccaaatatattgttggtcctgtatacttgtatagtaatcgaatatttgcgcaaatgtcacaatgataataaatggtagtcaaattgtccagagctggaagattatataatgcataggtagacaattaccaaaaatggaatgaagttactcctagggcgcccccttctcatccttgaaacataaggcacatgcacactacaccctccaagagtatcttctctagtaggataggctgtgctcaacgaatcaacctcatgcaaaggcgctatccgtggtctcaataacacctcatcatatacatgcctttttccaggtgaagaaagtctcccagtggattcatgagtgtcaatatctgagagctcctcaatgtatctttttgttggctttctaattctcttagtagttccttgttcggcaaaaatagttacttgtggttcatcattatctgttggtactcttttgagtctcttggacgatctctgttgctcctcactatgataggaaagacttgatggtaaatctctctcatgtccaggattcattacttggtccctaaccaaattagcctcaagttccatctttggtattgcttcaaccactggtatttcttgtttggcacccatggcaataactttataatccctaacaacacaacctgaacttggaacatcacatgaattgatcaaccccattgcaatccgtcttttgagccatagcttgtccttgacagtagtttgacgcccaaatgtggctctaaatgcttcctgaagttctctcattgtaagatcatccaagcagacttctccctttaaaatggaaaaatcaggaactgaactagtaaccccagaaacagattgtcctgcagatgcctcatttacaggtttcgagcaggcatcagccttttctttatcagaagaaaggtcatttaatactgttgattttgtagtctcagtcgaagcattgtcctgttgggcaatgatatttgccccttgttctgtatttagtttatccagctgctggtcatgaacagctgaacaatttgaaggaagaactatcgaatcattcaatgtacataacctgtcttcctgtgaaatgatatgcatctatttagtgttacatcaacttgaatatgtagattgaaagaagatgtatacaggtgcatgtttagtggatggttttaagggaagtgctcaaataaaaatagattgccctgggattgtatttcacacagatcaatctcttattaccacatctttcaatgatctacagtcagtcagatatgtctcaccgcatatcctgtgttcacttaaagaactcagcatcttctcattacattgaagctcatcccatagttttgatccatccatccatctctatgtcagttcttgatgacgataaaaatatgttcctaactagtactaaacaaagttgttacatacaaaagtggaatttgttgagaccgcatacaattgaactttgaactgctaattagacaaaaaagaactaatccatatttttaccatgccagaattagcttgaaaaaaatgaccacagaggtacctaagaacaaactaaacctattatctaatagaattaacatactatctggtcataaaatgcttatactcaatcgaagatacttcacttcgattagtgagggtattgaatgaaacagaaaataggtttagtgaatcatgttcatgatgcacaatggataagcaatatacctcataggtttagtgaatcatgttcatgatgcacaatggataagcaatatacctctaagccagcatctaacttttgtgtctgtacatctgcagtgtctaatttggaaggcccctctgtgaaaatatagtaataagtcaacatctcaagtaatcaaaccaatcgaatcaattcattaatcatgctagcttgcaaactacaatttatcctcacatggcatgatattcagttatcgatctaaggaagtatgatcacccaaacagaaatgacaataaagtagaaattgagatagaataatatttctgagggcaccttcaaactcaggcttcttcactatgcaatcattagtaaaatattcctccacatgtgttacatcgtcaatagaaggcagatcatcatcaaccttctcatcatgaaggaaagtttcaaactgtaagacctcatcctccgtagcaggaataagtgttccatcaccttcaacctgaacattttattttaaagaaaatgtgtttctcaaagaactgactaaacaattggaaccaattatgtatattagtgtatagccaatagaccctatgatgagaacttacccgaactaactggtaaacaacaggatcagaattgtcattcttatcaaagtcattatcatcacttctgttgtccagagcatcttgtggaccacccacctccatagatcagtacaagcttcatccaatacccttactaatcgaagtctaccaaggtgaaattctacagtcagctaataagtttaggattaagattaagtcaattaagtaattcagcaatcctggagagtagagagaacaaatataaagaacatttgcaaggatttatgactaaacaaaaggattcaggtaattgttggacagactattgcgatatgatccacgctatctttaggcaccactctttttcccctattacaaaatgagcaaatccatgtgtggtgggaatgacaaaagcgatcacacaccatagtgagatcctcaaaatcccaccaaaaactactgaactggcagacaggggcggatccaacttgggacatgggggaacaaacaaactgtttcttgtattaaggttaaggctctgaaatcaatagaagaagcttcttccagatctagaagagaaactagggttaacgcaagcaaattccagacaaaagtactcccggtgggagagagatgaaccagaaagaggatgtggatgctcaccaggatcccctccccctgctctgcgcgccagacggagatcggcgcccctcccctgttcagccgcgagatggcgcaaggagcggaggagacgagacgggggattttcttttacgcgaagggaagggggagatacggagatactcgagctgctccactctatctcagtttttttactttaaaactgcacttaaagtttgagatggataatcttgtgctacttcataatatgatatttcgaaatttttgttcaattttgaacactttttgttccatggataattgcgtgagttaattaaaaaaattatacagtgataatggagtctaactagagggcgatggtatattatactccctccgtcctaaattataggcgtcctccttttaagaaaaatcaagctcagtaacttttaactaacaatcatactaaatatatatacgctaagtattatacatgttacttcctccgtttcacaatgtaagtcattctatcattgcccacattcatatagatattaatgaatctaggcacatatatatgtctagattcattaacatcaatatgaatgtgggaaatgctagaatgacttacattgtaaaacggatgaagtatatcactagatttatattttaaagtagtttcatgtgatgctaattttatattcgttggcaacaaaatatagagtaaattaatggttagagtatgtcagtaaagaccatgtaagaaaaatacatgccttataatttgagacggatggaatagaagttaagcaaaatacgatatcatattatataacgagtcaaaatcagtgacacaatgaattctctttgaaaaataatatagtcgaatcgttttttttattttagtcataatagaacttttttttacctaaacatgattgggggactttgagagaagataggaagaggggataatgtcactagccaaaacacatggggggaggggaagttgcttacatccatggtatgttttgataatatactattattattaattttgttcttcactgtaatacgatgtaaaactaaaaaattaacatatattactatttcattattcacttttcttcttattttctcgatcttttttattttcaatgacaatattgctagaggtccgcggagccgataaccatgtgggggtatttcaatgaagctaattttgcatagtagatattgctaactattatctataaacttagtcaaatttgtttaagcttgacagtcaaagtgactcataatatgaaatagaggggtagttgcatgcctatgcattacaatatgatctatagataaaaatatgatttagtttatttctaatccatttttatgagatgttggctttttttatttctttaaagaagttatttagggtatagttttttgaaaagtgaggtcaattttttaagggagaaggagcattaatacttagatggattcttttttatttctttaaaagttttttaaggagaagagaatttttttttgaaagatataggaatatgtttttaaaataattaatatctccctcactgtcgctcacccccttgtcgtcttaggtactcctctaggctttaacttttcgatttcgaagtaaaaaaatcgctcttcactggtttaccaaatccgatcaaaaacgataaaaaccaacgatttttagtcaacgccgtacggaaaactagctaataccgaccggttttcataaattcagacctaacagtttcacaaaagtcaactggttttcatgaaattccatcggttttatgaaccgtgccaccctccgctgccttctctccctcccaccttcctcagtacactcctcctccacagaccacagctagtcgtcgtgccagcctgctcgtacattggagccgaatctagttcgagaaagaaccaccatgatgactatcaggaggaaaataaacatggcgggcgctaacaggtatggtggtaagagcaggtacaatagctgtctataaaccagctataaaacatattttaaagagttaaaagaaaagagagaagagcagctggctacagatctgtagctagctgcagcacgaacttcaaaacgtaatatttgtatgacattgtgggaccatatattaataatacaataaacaattattgtataaattgactattatattggttatagatgatttatagctagtagtgagctatactattgaacttgctctaagcccatcgtcgacaagagctcgttaggctgcatccaagagacaatgtcgcaacgtgggagcagagcagagaaagacatgcggagctctcgtcgcgggctcatgctcaaagggagagtacacttctcgtcggagcttctcgtccacccacggaacaggccggcatcagggacccggagtcccggacacacgcgggcgggaagtttaggcccatctcgattttactagctgcgtggccagcgtgggagcgtgcggcgttgccaaccgccaaccatggcacgcgcgcacgggacgaggcgcgtcggctgccgggagagcgccaccgcgccaggcgcccgtgacgtgcatgcgacggcgtggccgccccgtgcgggacgtttcaaacaaaaacataggcagattggtcgtgcgacgacgtgcgataaaaagtggaggaagcctagactagacgagacaagctgcgtgcgtgtgcgcgtagtggccaatgtgggggcggctgcggcgcagttgatcattagccgcggcgcaatgtcgcggtggattcgctttcctttcgtcgtccggtggaccgcgcgcccatatgcgatgcgccgctgcgcgaaagggaggatcgcgaagagacgtgcggaggacgcgcgcgaagactatcagtgtgggcctgactcgtgaactcttttgggaacgtttttgctgcagcgagtcgatgtacgtgcacgtctggatcaccatattctagtgtaccgaccagtgttcaacacatcaatcattttattttagataatagaataaacatcccggcatttacttatcagagctacatccaattattacaaagtatcactttaacaaaatgtgtagtttaaatgaaattaaacacacccaacaaaataaaaaaccaaaccaagataagaagaacacatttattaaagtctgtttatgaatttccatccatagcttaaaaagagttgcataaccgtcgtcttaagcatcaatcatggtgggtggtgtttcatcgccaatttactttgtagggttcaggtttataagttagttttttatacaagcttttgcgtcggcactggcctgcaccatcatgaaccgtagttagaaaaagagcacgattcgaatatcttacaaggaaagaaattgttcattgtatccagcagagaaacgatgcaccacccccgcgcctttctttgctccgggaaagagctcgctttgccgctcgacggaaagcttctctgttttatgaactaactaacgacacgtacgttaatctagcatccctagcatccggctaaacgggctaaagtaaatggaaatcagtgaacggagcacatgcatgccatacggaagggccctaatagtcacaaaaatttccgatcgtccaaataccgttttcataccgagcgtcattttttttatataagaggtaccgtttacaaccgttaccaagtattgcaaattctaatttctttctgcatcatactgatatcaacgccgagtaatttaaatgataaatatgatcaatcaccgattgattgagcgtcggtttcgaagagatgctatcgattctcgttgttttcactcactacatcttttttttcgcgaactcatcactcactacatcgatagactgttttactgttaacgcttcaatttccactgcgggagaaagaaaatgtacaaattgtcgacgggcagtgtctttgcatgactcgagtttcgctttaccagcacgccgtcaccgcgcgccgcgcagagccctcaccgtccgttcctccccaacaaactccaccgctggggaagagacgagcaactaaaaaaaaaaaaggcgaaaactcgagtgcgcgcagtgtcatccgcccccgtttccacctgtgcgcgcgcgcggcgtttttcaacccccacggacacctccgcacgaacgcaccaaccaaaccaaaaagcccctgcgaatctgtgatcctctctccctcgccgcgatcgcgttcgtcccacggccgcgcgcgcgtcgcgggggcgtcactatgtctccgcaccacagcggccgtctcgcgccgccgcgccgcaaccgggagaacccgtccttctccgccgcgctgctcgacgccatctaccactccctcgacgccgatggcagcttgccggcgtcccccgccgacgccgaggggtcaccggtgcccggacgccgccgccgtccttcgcagtgcaacaacctgtcgccgtctgcttcttccgtgcggtcgccgcggctgcagaagacgccgcggccgtgtcgcgtgcggcctgacccacagccttcgcttctcttgccgccgccgcagccgccgccgccgatgccggagtcaacaggagacgtcgcggagaagaagaggggcagaaggaagaacaagaatggtgccaagtcggcgccattcgcgtgccttctgaatgctctgctttgcaacaggaggtcagccaggtcggccgagccgacgacgccgcgggctctggcggtggcgccggcggcagtggcagtcaccgccgctgagccggcgtccgcgaggtcgatcctgtcgtcgcgcgcttcccggcgacagcccgcggcgacgggtgggatcctgactccggcgaggcgggcagtgcggttctcgccggtggcggtcgtggtggacgacggcgagcacgggtgccgggacgccggggtggcgaggctgcgcggcgcggagagggaggtggccgcggcgcaggagtcggcggcggaggcggagaggagggtggaagagctgctgcgcgcgctcggcgtggcggaggagagcgagagggccaaggagagcagcgagtccagctccgacctgttcgagctcgagagcttgccggcgttcgacgacgccgagctgccgcggccgcgagctgccgccggactcgtgctggcacgtccgcgacctcgcgtttgttgagagttgcacacaagaattaatacctcttcttcgacgtgtaagctcaatgcagctatgcagcgtgcttacgcttgtctggatgctgaatggctgatgaatgtttggaaatggcactgcattgtcgagtgaaaaacaagtacaggcatagcattttgcatggggctatcacatggcgctttgttgttttccctgccacagaaaagagtgtaataaatttcaccatggtgcccaggtttctccagccggcccggcagatttgttactctgatgtctttctgcccgttgtttccatacaagcaagtaatttttttaaaaaaagagatttggaacgagagacctccaaacattttttttaagaaaaaaaaatgagtgtattagggattgaacacaatatttcagggttgaagccatacacccattaccattgcactaccaagtacatctccatacaagtaattgattgtgttacttccattgtttatctacaattctacaaacgtagggctgttttggtttgacgtcatacttatcttactagatatttggtaactttaagtagtagttgtttggattgctttcaatctttaccaaatcaatacaattaatactactattctactatactaaaactgggtactgccaaatcatacccaaaatttgacactactaataaattagtgggatggtagagaaccaaacaaatccgtactaccgtaagtttgtcttacaaaacaatttcaaactcccttgtcgtgttaactttttcaaacgttttgaggtcaagaatgctgtcaaagaaactctttcgttctagaacacaatttatatttatgaaataaagggggaaaaaggaaaaagaagaacatatccatgcatctcagagtagttcaggaagaacatgacctgcgcaggacgctgcttgttgggcaaaaacatttgggctagttggcctagctctgtatcgcacatatggcccatcggctcacatgacgaaacgggccggaaattccactctcctggactcctgcgcttggagccggcccaaaccaaaccaaatcccaatcttgcaaaagtttttaccgctatcattctatcaagggctgttctgcaaaatttgctaccatcagttcgtcggaccgggagcgacttctaccattggatgtagcatcaacggtgggcgagagcccgcgccgctcgccggaggtctcctcgcctcgccgcctccttctccggcgtgtgcccctcctccgctcctcgtccccaaagccaatgccgcctcgatctcctcgccgacctcctccacagtacagctgggccgccgccgccgccgcctcctccccgcgctgcctccctctcgcggtctcgttccaatattggcctccctctcaggtctccgcggccgtctcctcctcaaccccaccatggagcgtcacgaggaggtgggttggagcctggacaccgtacctggctacctgtttgctgctgtaaactgccaacttgttcttgttgatctctgcactaagacctaatcttcttttgtatcaggagttgcctcctaatgtcccataaaaattcctcgtgtgtctctttcctggttttgggcgcttcggatcaatccactttgggctagaagaagcttatggtaaggtgcattttccctgctaacaatctgattctggaggagaaacaacattagtgcttttcgattctcacagattttttgttaactgttctgaactcttgatgataaattggcacgtactgtttggatgtagaaaaggacatgttttgcatttcaacttgttgtatgagaacaagccttttgtcttgcaatctgatgaaacactgtcattctgttatcaagttccattagattttattttgttgttgttgttgtgagatgttgagtatgcttctgaaagcgtcagtggagagatcctgacttcatgagaagggcaataagtgggttgagcagtgcgaatggaaattttaggaacaaattaattgatgtttttgaagagaataatgtttcaactgattcacagcgatcatctttgtctataaaacagaactctttcaacttcagctccttaattacatatagcaaacgaaaatgacaaaaactcggttatattatgtccatgtacttatttgtttggctgtgggtttgtgcttttgcagcttgctatctagtgaatgagtaagttgagctgagagctaggggtttgaacaagctattgaatctgtcattcttcagaaacaagttcatttaatccggtatgctggataactgcacatcaagcttgaatcatggtgtcttatcagttccggtttggttgaactaaatctgggacaggtgatacttttggagcattggtctcacttctgctcaccttgaatttgctgtactttttgtcctcgtaatgaaacctgataagttatatgacatgttggttagctgttattccagctgcacttgtttcaggtttttttagcaatatgtctccggcatatgaccattgctgggttgtgagctggttactttcttgtatgggctaatgttctttggagtttggatttgacacacgtccagaaaaacttcaaataacctttgaggtaatagtttttttactacatttttgctggtagtgtcttgcttgttatattctttgagtggtttcaattggagcagcatatggtgttatcagttttacattatcaattaaccatgctaactttatcaataagatgaaaagaatccatcagtgttattcttagtattacttccctaagaagtatagcattcactgctttggatctgctgtgatttgttgaactttttggaaacaagaaattaaggagtatctagaccttgtattcataggtgctgtcacgccccgaactagccccgaacagaaccagcccgtgacgctccaaattaacctgttaaccgataccagtcctaggaaatagtgctggtatcacaggaaaactgaataccatagcaacaaaggtctctttattatagagtaggattacagtcatgttgggctgcggacagatcccaagctcacaactgcattacaaaagaggaaagcggaagccaagacttggaccattcatcacaggcgcgacttgggaactagatcgaaatcctaaaactcatcatagccgacttgctcctggaagaactcctcgtcagcgggatccatctcatcttcttcagcaactgggggggattatttatatagagcaatagtgagtacaggagtactcagcaagtcatgggaattatgtgtttaatgaaggcttcaaaggaaaggctgttgtttttacaattgattttagttaaactccttttttttaaaaaaacaactaagtgagtgcttctcaaacgacacggatgagacaatgcatctcgtccggtcggagtatgtgcattgtatcagtctttgattgattcaagattggcacccggccacaactttcaaacggccacccgggcctagctgatcccgtcaaccacagatgttccaaacatcgaacccaaatcaacaatagcaatttcacaaagtagtagtcaaacaaaactacgctaaggaatcaccttacatccgctcatgaccgtgggcacggctgttcgaacagtttaataacctctgcagagggggcacactttacccacacgacattactaacacggatcacccagcctgtgcagaacagccacgtctggtgtccttgaggctttcatgacaaggcatttcgagagccgacacaggtttaccatatgccaacgagaggggtcccagaccaacaacaggttaggtcccagaccatactatgccaggaagcccaggggtcctccccaacaccaccctggcaaatccacttgtctcccggcatcaaggctcccctgattagctaattactcagccaggggtgtcccattccacccatgtggtcgtacttgttatatgttcggatgaaattccaaaggaataggtccttaagtgcaagagcgggaaaccgtgctcccgagacgagacgggcactgtgacgagaggccgacggcacgagagtgatctctccggcctcgggccggggaagaggaagaagatgagtgcccggagtccccttcacgcgtccttcgcatgcacctgctctcctggtgctttggcgacgaatggcggaggtgcaagcagggcagagcgacgatggtgtggcaggcgctgacggcggcggcgactggccggtcggccagcacggcgcgcgcgcgcgggaagcaacgggtggcgcggcgatttgagcggcgtcggcgggagcggcatcgagagggagcgagagcagagagagagagagggggaaagaaagagagagagcgagctctcttgctcagcgcccgagcggcgcacgtgcctcgcacgtgcgggcaaggatggaggggagaggagagatgggctgagaggaaatggccggggagaagagatcggcccacgaactcgagggaggcaaaatagactttttcgagaagatttgattcgggacagattgaggttagggtttggattcgacgatggattggggatttgagatctggaatggcacggacactggacaacaaacaaagaaacatttttcgcatttatgatttttaagagatagttttcccactaggtgccacgacggaacgggcgctagagaccaatccccctaacaagaatctcgaccccgagattcagcacctaagggagcagctccggaaactcggcgcggagatgatcttctcgttcccaggttgccttatctttagaatggttgctccattggaccttgtagaacttgatggtctttcttcgagtctgacgctttgcctcttgaagaaccttgatcggtctttccttgtaggtcaggttgttttctagctcgatgttgcccaggggaacttgttcttctggaactcgaagacatttcttcaactgggatacatggaacacgttgtgcacatctgcgagaccttcaggtagctcaagctgataagccacttcgccacgtctggctgttatgtggtagggaccaatgtagcggggtgctaacttgccggacatcccaaacctcttcataccgtggaggggtgatacccgtaggtacacatgatctcctttttcgaactcaagatcacgcctccgattgtcagcataattcttctgacggttctgagctgtctttaaacgttctcggatcagcttaacttgttcttctgctgccttgagtatgcaggaccgaacaccagcgcttcgccaacctcattccagcacaagggagtgcggcactttcttccgaacattgcctcattcggcgacatctgaatgctggcctgataactgttgttgtatgagaactcggcatacggcaggcaacgatcccatgtgccttcaaaatctagggcacaagcacgaagcatgtcctctaagatctgatttactctttccgtctaaccatcggtctgcggatggtaagccgtgctgaagttcaaattggtcccgagagcctcatgcaactgcttccagaaccttgaggtgaactgagtacctcggtctgacacgatctttttcggacagccaaatcgacataccacgtgggtcatgtagagctctgccagtttctttccatcaaaggtagttttcacaggcacgaagtgagccgattttgtgaattggtccacaattacctagatggagtcatacccgctaggggttcttggtaaaccggtgatgaagtccatcccaatttcttcccacttgcattcggaaattggtaggggttgcagcagaccagctggtctctggtgctctgctttaactctttggcaaatgtcatagagagccacatattccgcgacatctcgcttcattccagcccaccagaaatatcccttaatgtcctggtacatctttgtacttcctagatgaatggagtaggcagactcatgggcttcttttaaaatgatatcttttaattctttcttggctggtacgcagatgcgagatccgcaccacactgtgccttggtcatctatggagaaaccggtgtatttcttctcgtgtattctttctattaactcttttatacctttatcatctttctgagcttcccggatttgcgattccaatgtaggttgcactgtcaggctagcagggatggccgactgtaccactatcagccttaacttttctaattctctgcacagacgatcttggtctggccatactttaactgcattgcagtaggtcttgcgactcagtgcatcagcgaccacattggctttaccgggatggtaatggatcccaagatcataatccttgattagttccaaccaccttctttgcctcatatttagctctgtctgagtgaagatgtatttaagactcttgtgatcggtatacacttcacacttgtacccgatcaagtagtgccgccagatcttaagggcatggatcacggctgctaattcaagatcatgggtgggatagttgacttcatgaggtctaagctgcctagacgcataggccacgaccttacgatcttgcattaagatatcccaagccttgccttgacgcatcacagaagatttcaaagtcttttcgtatatctggcagggtgagaactggggcagtggtcaatcttttcttcatttcttgaaaactgtcttcacaggctgctgaccattcaaacttcttttctttctttagcaactcggtcataggtctggctaacttagagaaaccttcgatgaatcttcgataatatccagctaggccaaggaaactgcggatttctgacacattcttgggggaattccaagcaagtacagcttcaaccttcctgggatctacttcgacaccgttagaggagatcacgtgccaagaaatgctactcggtccaaccagaatttgcacttcgagaaattggccaacaattgatgttctcttagcttttccattatcagcctcaggtgttcagcatgttcttccgcattcctcgagtatatcaagatgtcatcaatgaataccacgacaaacttgtccaagtactccatgaagatcttgtttatcaggttcatgaagaaggccggagcattggtgagtccgaaggacatcaccgtgaactcatacagaccataccgcattgaaaaagcggtttttgggatattctcagatctgattttaagctgatggtaacctgacctgaggtcaatcttttagaaaactttcgctccttcaatttcatcgaacagatcgtcaatccgaggcaacgagtacttgttttttatagttacttcattcagggctctatagtcaattaccattctctcagagccatcctttttcttaaccagaagcactggggctccccaaggggatgagctaggtcgcacataacctttactctccaattcttcgatctgctttttgacttctgctaactcattaactgccattcggtagggtctttttgcaattggtgcggtgcctagtgccagttctatggcgaactcaatctctcggtctggtggcatacccgttaactcttctggaaatacgtcgggatatccacagactatgggcacttattccaagggaatggcttgcaaactggttaggatagaccgacttgcggtaagggtgttaggggtaaagcgaacttgctttcctccaggtccttgcaaggtgatggacctttcggcacaatctatctgtcctttgtgcttagccaaccaatccatccctaggatgatgtccaaactttgcgagtctaggattattggtttggctaggaaatcaattccctcaattctaatgttaacttcggggcatattttagttgcccctatatcccttccaggggaatgcactatcattggaacttgcaatttttgggttttccaaccatttctttttacaaaagcttgcgatatgaaagtatgggaagctcctgaatcaaataggacgattgcgggtacggagttgatagagaacatacccatcacaacatctggagcatcctgagcggtttcagcttgaatgtggttcacccggcctcgaccgaagttgttggaaacatgagatccctgtccactagcctgagaactaggacgagacggagctggtgcgggagtaggagtcctggcggtgctgccattagaacgtcctgagttggagttggcaggatcctgtgggcattgcctggcatagtgtctcatctggttgcatcagaaacactgaacagacgccattcctgatggtgccttgaaggaggacacactattcggtgcagtattactgctaggggcacgctgctgcggctgaggcgccaggcggttagtctgaggacgaggtgcatagcttggctggcggttagcatgagtgactgactggtgatattgcatgggttgtccaaagcgagggcgaggtgcacctcgggaggaattcccctgatgattagacttgcgtttcttgtattcctcggtagcttcttttctagcatcttcaaacagaagagacttgttgatcatgtcatggaaagtggggaaattatgagcaagcaactgaagtctcatcccaactgcaattccctttaagaacttcctgatcttcttcttatcggtgtccacttcctcaggggcataccgagccaacttgttgaactgactcaggtactaattgacactattattgccttgcttaagcctgttaaattcctccttcttcatatcaatggtgctttcaggcacgtgagttgcacgaaaagccgtagcaaactcatcccaagcaatgttagtggggtcaggatgagcattgcagtagttttcccaccaatcagcggcaggtcctcttagctggtgagaggcgtagagtgtcttctcgaaaggagtacattgtaccaagttgagcttcctttcaacatccttcagccaatcatcagcctcaacaggcacgacggtctgagagaactcgagcggacgagacctcagaaagtccgtcagcttggatctgttgttacccatgtggggatggccatttccatgtgcattatgctgaaagccggctatggctgtggctaatccctgcaagatctgtggctgtggctatgccatcaagtgctgcatgttgttttcaacatggggtggggaaggcatgcatcctccaacagggtcgcgattaacagtgtggtgagagcggtgagaaccatgggactgctcaacctcggcatcgcgggatgctgtgtggtgcgaacggttagtgtggtgagactgctcatcagccgactcgtgatctgcctctggctcaactctgccttcttcaaaaccaaaacggttcggtgcacgggtagcgcggcgaggacggctagccatctaaactccctgaaaaagggcggggtgagaatcggacaagcacttaatgaagacaaggagcaaaataaataacagctcagatagcacacactaggcataaactggttttctcaaatcataaagacacctgatacaacggatgtggacaagtcacagagctacgccgagcttgactgtacgcacaccacctaggagaaccagactaccaaacaacacccacatcaaacacacggacgcactacctcgccacgactccgaaagagttggcggcggaacaaaagggcctaacacacggacaactgctgaagactgcctcctctactcctcgcctgcctggctgcctcctgtggtcagttcctcagtcgaagaaacgtagatcggcgcacgcgaagggaccggcggaacctgtcgagggccggcaacagcacgggccgctggcggagggggagttgggtagtcgaagcggaacactgtggaagagccaacaacacgcttccgcgcagtgcggatgaagcgtgggccacggcaggaggaagcaactagagtgtgtccgggggtgtagaaggggctaactgggtgtgggtagggagagtacactggtgagtacggcgcacgcgagccgggggagtgcgggccactgggagtgcgagcagagccgcgggagctgtgggaagacaggtggctggcgtggcagaggcggccaaagtcccaagaggtagtgtcaactgaggtgacaccgtcctcggccaggcgggtctcgagtgcagcgtagcggcgtgcaagggagtggtaagcctcaaggagaaggtcgtgctgggtggcctgagccttagaaagctcaaccatgcgagtcagcacaggctgagactcgttgtacgggcaagggtacctggtgtcagtgcggccagaaggaaggcgtgggagctgccggaaggcagagcccccgaggcggtggctgtagtcgtgggccaagcgacgaagtgcagtccaggagaggtcctggtacgcgatctggagagtgggcctggccatagtgaagtggtgtgggcgaaggccagccccgtgtatacctccacaagggtaaaggtataccgaaagctcacaacgagggggaacacggtccacggagtaccccgtgtactcgggacacgagaagccaaggaagcgggcgaggtcacgaagctgagcgacgtggtgaccctcaccaaaaccatgggaactgaagctggcgttcactgccatctacaattttgaaagagggagaaaagatcagtaaccattttagcaacaaactactgaaaataaagaaagcaaaaagaaggcttagcttttcacaagtagtttttgaacttaatatccttagggtcgtcctaaacgtcgggtttcgtccaagggccaagcctgtgctctgataccatcttttatcacgccccgaactagccccgaacggaactagcccgtgacgctccaaattaacctgttaaccgataccagtcccaggaaatagtgctggtatcacaggaaaactgaataccacagcaacagaggtctctttattatagagtaggattacagtcatgatgggctgcagacagaccccgagctcacaactgcattacaaaataggaaagcggaagccaagacttggaccattcatcacaggcgcgacttgggaactagatcgaaaccctaaaactcatcatagccgacttgctcctggaagaactcctcgtcagcgggatccatctcatcttcttcagcaactagggggggttatttatatagagcaagggtgagtacaggagtactcagcaagtcatgggaattatgtgtttaatgaaggcttcaaaggaaaggttgttgtttttacaattgattttagttaaactcctttttttaaaacaactaagtgagtgcttctcaaacgacacggatgagacagtgcatcttgtccggtcggagtggatgagacagtgcatctcgttcggtctgagtatgtgcattgtatcagtctttgattgattcaagattggcacccgaccacaactttcaaacggccacccgggcctagctgatcccgtcagccacagatgttccaaacatcgaacccaaacccacaacagcaatttcacaaagtagtagtcaaacaaaactacgctaaggaatcaccttacatccacccatgaccgtgggcacggctgttcgaacagtttaataacctctgcagagggggcacactttacccacacgacattactaacccggatcacccagcccgtgcagaacagccacgtctggtgtccttgaggctttcatgacaaggcatttcgagagccgacacaggtttaccatatgccgacgagaggggtcccagaccaacaacaggttaggtcccagaccatactgtgccaggaagcccaggggtcctccccgacaccaccctggcaaatccacttgtctctcggcatcaaggctcccctgattagctaattactcagccaggggtgtcccatttcacccatgtggtcgtacttgttatatgttcggatgaaattccaaaggaataggtccttaagtgcaagagcgggaaaccgtgctcccggcacgtcccccggtctgcgatttttggaaattcatttagttcgtaagcaccgacccaggtgtcggtgacatgggatcaggagtatcatgactagaggtttgaggcaaactccatttcacacatgcaagggcacaacgaggggtcgtcagcacgcaaagcgatgtcgctccacatcgtttagtccatcagataggataagaccgcacccccattcgtcatcagggctgaggcgccctgacccctcgtgggtctttgctccgagtgcatgggttaggtcagcacagtggggctcacctaaccacatttattgcggttgggctgagcgtgtcacgccgtatgtaacgcagtgcagtgcactcgtttatccggtctatgaccagtcacagaccggtcagatcgcgggttaggtggcgacaggcgatctgacgcacacctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaaggacgagcatgtaggttgctaagctgacacgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatctccttaagatataaaaggaggaccttgcccactgagatgagggagtagactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccatgagtccccggccgaaccggcaaaggggggcctgcgcggtctcccggtgaggagccccacgctccgtcatctggcgcgccaggtaggggtccaggcctcgggacccgaggggagtgctcccaactcccttagattgattgcttggatcgccgagatccaagcatatctcacagataagactctacccgaggaccgcgaagggagtgaacgcgtccatcgcatctccaaacgctacgtgctggtagaagggaccctctatcggcgcgtggctaatggaatcctcctgaagtgcattcctcgggaacaaggtgttgtgcttcttgccgatatccatgaaggcgaatgcggagcccactccgcctcgcgcaccttggttggtaaagcttttcgccagggtttctattggccgacagctcttaatgacgcggtcgacctggtccggcgatgtagagcgtgtcaattccacgccaagcaaatccatcagccggcccaggccctgcagaccataccactttcgtggccatttgctgtatggggactcgatatcctgggaccgtttaggcgggccccgggcgggtttgagtatctgtatgtcgcgatcgacaggttcactaagtggcccgaggcttatccggtcgtcaagatcgataagcactccgcacttaaatttattaagggcatcacggcccggtttggagtgcctaaccgtattattacggataatggcacccaattcactagtgaactcttcggcgactactgcgaagacatgggcatcaagctctgcttcgcctcacctgcccaccccaaaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgatggcactgagctgcctaacccgtggaacatcgaacaccttcgtcgcttctacccctgagggggggggtcgggtgtcaggtttcgggctcgggccaaccccgcacccccctcgggcgtgcagggttggccgggggctacaacatatgcatattcttttttctcttacatctgtatttcaataaaagcagtttcaatttcctaaaggctgtatctgtgctgttttttccttttgaagaatcttgacttgaaataggtcactcgtgctcaatcctgccctcgggggctcgggtcggctaaaatcgccgaacggggcccagaaccgagccgtgccccgaggcgtggtgaactccggggggggggggggggaatcggcaaaaacccacaatcgggtcacccataaccctcggtcaccacgttcccggcctggccagtctcgacatgtggatctcctcaggcactagccccgacccgcgccttttgaggactagaacttgggcacgagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccaagccatcgaagctgtcgacgatatggtcggcggcatcccggacctgcgcgcgcgcgcggtcctcggtcccaggagggaactcatccagcgccatccatggggagaaattggggtccctggcctggtaactcgccaggacgagctccaccgctccttgggcgaggtccctcgaggatgacttaattgtcttctcgagctcctcggggagccgttggagagccccggccatcttcgagaggcgctggacgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgtgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggctgactgccagctgttgcgccgcggcctcggccccctcgagagctcgctcccgctcggtgagcacgtcctcgcggaggcggagcgtgaactcttcttcggcgcaggcagcctcgtgcgccgccagcgttgcttcccggatggtgacagcggcctcgcggtccgccagatccctctccacgacgcaggcgcgctcttccagcgccatggcgcgcgcctcaagggcctcttcacgctgccgggacgccgcttcggtctccgccgcccgctgttctcgggcagcggcagcgtcaagcaccccctgggcggcgtcgagcttcttccttagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgccaatggaagtgccggactcggggatgtcccccggacccggttggtcctgagcgtcgcccgagggagtgggcccaagcgacgcgcccgcggcctcgtcgcgagctgcctcggaagtcgccatcgcctcgtcctggcgaaatccgacttcctcccgagcggcttccccggcctggcgggcccgggcggcctcctcccgagcagtttcctcggcctggcgagcccgggcggcctcctgggcggcctcctcggcttcccgtaggcgatccgcggcctctcgccggtcagattcccgcctgagggcctctgcggccgccggatcctcggccttagactggccggacttggaatggcgggagggatgcgacgggatctcgctgaaacaaaagaaaaaaccagaagacgaacaagatgggtgagtgaaaactcgtgtcgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccgccctgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctacgccgtcgtgaccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcctcgtcggcgaggggagtgtagaaccagtcgctcttccagtcgtcccacttcttgcggagggtgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacaaatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggtgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcacattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagacaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgattgccctggcataacgccgggggctactgtcggtgacatgggatcaggagtatcatgactagaggtttgaggcagacacaatcgcacacgtggcctggtacccccgagggacgtcgggcccaagggtgatgcgttcgccctcctcttagtccccccgagggggg

SEQ ID NO: 72347 - DNA, 568 bp, Oryza sativa
atcttttcttcttctgatcttgactgttggatgccttatctgcgtcaccttccacgatgccatactcagatacttttataaacatttggtgcttgtctacttggtcaagccatttatcttctggaaacatggatcctagaagggatatcaaatccttctttgcagttttcccaagtagctggtacgctcggaacaaatccataaacaggtgcctccttgacatcgcagacctgagtgcaagatgcgaactcagatacttatggaacttcctggttttctctgagttgtactgcccgagctctcctgcgctctcttttagttcagaaaaaagcttaatgaagtagccagggacctgcccttgagctgtgcgaaagtgtttctctagtatctttgccaactgtttcagatccttagccattgctttacaacttgcatgggaagaagctgccttcgtgattccaaatgttgattcatttctgactagtagatcatcaatagaaaattcaccacaccaactgcgtccatctttatgctgattgatgatatatatgaggaaccctaggaacac

SEQ ID NO: 72348 - DNA, 2921 bp, Oryza sativa
gccgcatcccttcccatcgcgcatccacgtcggcatcccggcgagcttcgccgccgccgccggccgtcgtcgcgcgttgtcttcccaatccgagccgtggaatcggttcgccttgacctcctctagccaccggtgttcgtcgctcgcttcggctcgccgccgttcgccggattccaccgcgcaccgtgagccgtccgatgccattcccgcccccccccccccattttctctccccatccgacgtggctgcccacgtggcgttgaccgggcctgcccctgcccagtcagccggtcagccgtccccctccccctttctcccctggctcgtgggcttggcccattggccagccttcctcctcggcctaacaaaacaaaggaagtttacttttactccttcttccgagtccggtgcccacacaccgaagagctaaaagtccgcaattgctccctccaattgctcctctctctctcaccttcttattggccccactcgtcaatgagtcaaagataatcttgagaatgtcttttccaatattccacaaatatttctctcttctataaattcagtaaatcattttatcttatttcgtgagttaataaatcttttttcccttgatcccataaatcaattctctattccaaaatttcatgaatcatttccttataaatcatttcctttggtcccgcacgtcagagacggtcaataatattcttgagaatattatttctataaatttcatgaatcaatctccccttgttccacaaatatcttccttcgccagaaattccaattaaacttccaaaattcgtatctctcgatccaatcgtccgattgaccccgttccacttccagtatttccgtaaaatcgagatctatttaatggcactattatttagtctaaatagggtctttttcttggtctcttgtttaggtttttgtttgtttgcgcatagttgcggttaccggattttcgtcgatcgtggatttctcgaagattcgtgaagctcagtgaagaccttgagcaaggcaagccacctttgaacatattgagcctatatttgaacttaattatattgctcgcaaaatattatgcattgataggattgcacttaatctgtttgcaccgtctgcaaggcagaccggtgggcctacccaacttgttgcatctgatccttacattgttaattgttatatcatgttcccttgtaaccatctagctgcgcctcgatattcgtgcactctgtgcgagtatcgacggtcgccttcaaacttaaaatatgagtaacttcttgggtaaaacttggtttacaaaagcttcggaaaacccgacgcctgggtcggtgccttgtgaaagaaaatgagttttaaaaataaaactcgcgacacaaggccattcctaggcggaatacttgtgcggtcgcatctaaggaccgattcctttggaattacattcgagcatacaatagtgcgaccacacgggtggaatgggacgcccctagctgagtaaattgctaattgggggagccttgatgccgagagacatgtgaattcaacggggtggtgtcggggagaacccccgggcttcctagcacagtatggtctgggacctaacctgttgttggtctgggacccctctcgtcggcatatggcaaccctgtgtctgctctcgaaatgccttgtaatgaaagcccttaggtcaccagacgtggccgttctatacgggctgggtgattcgggttagtaatgtcgtgtgggtaaagtgtaccccctctgcagaggttaacaaactgttcgaacagccgtgcccacggtcatgggcggatgtgaggtgattccttagcgtagtttttgttttaccctgttttatgaaaagggtgttaaggtttgggaaacctaatgcttgggaagcaattagctgtccgggggacagcgggaccgggtgtccctggaagtaattggtcgtttggggaccactattatcgggaagtttggaaaattggtttggtttgggaaaaaccagatttgaagccaactctgggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttctgccagctccgaagatgaagttgaagtgaagtgaagattagggtttcgtcctagttccctgtcgttgcctgtggcgttgggtgttagtccgttggttggttccgctgccgctgctgttgttggtgtttgcctcgtctgtgtcgccggttgcattctggggctgtctaagctgcaacctaagttaaggtaaataagtcctctattaattataaggatttgtaatgattcatgtttgtcaccgtgggtaccagcgctatgtcctgggactggtactgagatcgcagtttcgtaggacgcggttcaagccgtttttctacgacacgctcctgtcaggtgccgttgtacggcggtaccagattggggtgtgacatctaccctgatgagatttgccttttttcccctccccgtacaaggtgaatttgaagttcagaattttcatggtagcaaagaacagcatatatatatataggccgtgtgaagttccaaaataattcttcaaactaccaacttttccatcacatcgaaactttcctacacacataaacttccaacttttccgtcacatcgttccaacttcaaccaaacttctaattttagtgaactaaacacaaccatagcatatgtttgaaaattgtattgaaggtttttttttca

SEQ ID NO: 72349 - DNA, 2375 bp, Oryza sativa
ttattgtgttcgtaacaattaaatctttacaacatgatctcacttgattatatttgttgatgaaaaattacaaattacttttttaatatatctaaataatttttagatttcatcaaattacttcttagacatataaaagtgaattcaataaagcttaaaagtaatttacatatattatagaagtaacttaaaataaaagaaagtaacttgtcatgacattaaaagtaaatctattgtgggggtaaaaacataagtctatctagaaattaaatttaatcaatatattatagaactaaccaataaataattgttcactgaatgtctaaaaactaatttaatcatatctaaaagtagtttatatatatatatatgataaaattaacttacatatataatttacaacctaattattttttatcataatataattatgtaagattgctagaaagatttaattgtaacgaacacaatggtgtaaatagatcatatgtgtaatcagatcatagatcagataaataatttaagagaaaattttatttaaaatttcaaattttccctagaaagtatgtggggtctgtaaagtaacagatgaaattgaaaaagtgagaggtctcgatttaagactaacacgctactgcactctacctagacgcgtcctggttgggcccactgcatattaatgttcattttaaaatttgtgcaagcacatatcccacattttaactactaattcacatatatttaacaacctacataatttctaccatatatacttgacactaatatggattatatttttcacaaaaattcgaatttgaaccgcaaaagtatcagactttaacccttgcattctgatctttcttttaactgatataatttttcacggtgcaaactgcaggaaatggctggtactttaacaataatattacctgagagtcatttgcttctgaaccactgttcgtaaagaacactttgcccatttccctggcagtaaacatgctaataagttctttcgcaagatcctgcaagtagcagcaaacctccaatcatcagtatttacaagttttttttttgtttgcagaatgactaagtcagtcactataacattttctcatgtagtattaatatctgaaaaaaaagaaacaatacaaataaaacaacgattgatgaattaaagatgcagaatacatatgtaccaaagaaggcctggttgtatggttccaaaaggagtggtagaagggtaacttgtttaattgctccgtagcagctttgactaaacgaggctcactaccacctgaaaatagcatgcatgagtggttaatgcatcagcgtttataatcagttattgatcacttcactgctccctctacccttgatcaataattagttcaatatcattttttaacaatggaattagttcaatatcaatacgtcgattacaagataaaatggtactacattggattcatatttaaaacttcggctggatttactacctggaacaattcaatttatccacttagcaagcctcctgacaaaacttcgtctgaatttactccactaaaacatttcaaccggtttaatctactgtaacgccccgcttttcgcgagacgttaaaagctaatttactgaaaatcctaattgcgaaaatttcgttctttgagtgttgaagtctaagttgtgccaaagatctcaatttacatccctcctttggtccatctttgtgctatcaaagatcgtctcctcaaagtttccatcccaatatagtcccgaagctcgattccttctattcggaatcccctcatggaaccccatccgtgaactttgtcaaatgcccgaaccctaactccgtccaaggattcaccttcgcgtcataaactctctccttggttccttcaaaccgattctcaaattcgaattcaacctctcaggttttgtttcatctatatttctctctgtattggttcgtcaatctacccttgttttctttctcgaacttctgacccaagtctgaatatgcaaatcgagatcacttccacccttgaactctaaaccccaagattcaatccctttcgccttgagttctccccaaaatgatttccgttccgaaataatctcgaagtccgaacccttctatttagacttccctccaaaatccttacccacatatctcgttgagtagtcaaactcaaactcccaagttacactctctttctctaaattatccatctcactttgactcgtctctgaatattgttcccttccttgactccttcctattctcccgagaccgagtatcaacctcgaaactcgaatccagaccccaaccctaaaacctcccaattaaatctctctatgaaagtctatttaacct

SEQ ID NO: 72350 - DNA, 1293 bp, Oryza sativa
taatatttatagtcaaaattagttttattaaattaataattgaatatattttaataataaatttgtcttgggttgagtacaaatttggtcaaacttgaaacagtttgactttgatcaaagtcaaaacattttataacctgaaatggagggagtatctcttttgtttttatcaatcgcttctatacaatattatagaaatagccgataattcagtatttagagcaataatagatactgtattggctattactccaatacagacttatataaacaacttaatcgatataaatacatcaaataacagtcgttcgatcagggcggaataaggcggcgatccgatcggagatcagctacgagggggcttgattggattgaatttcgtcgttcgatccgaactccggcctatctcgctcgctaattgtaattgccatgacgtcgcgtgaagccattatgctatttccacggatcgcggggcctcctcgccgacgccggcccgcgggcgcctccctccctacagcagccggagctccgccgccgttcctcgccggccgacggatggtcctccagccagggttttcccttcggagaagcaagaaaatttcggtgggcaccgaaattccgaaatttcagacaaattctgatatttcgaacgaaattttttgaagaaatttttttgctgatttcgaacgaaatctggcttttgaagaaagccggaaagcaagagagttcattacaaaacgaaaggtaaaacacgaactctaacgatggggtcgccagcttgacattttattatagtataataactgaacaaaattcctgagtatccatttccggccaatcatcaggggaagatacagtttaactcaggatagataggcgaaaaccaaatccattacagaaagtagcatgtcttgaacagaacaactctgataaagtagctcattaatcgcccagtctctgcagctcgtttcatttcttcaacccagatagcctacgtgattcattaattaattcctacttcttctttcttgagactctattaaccccagtttttacaagagttcctgcctcacctgcatcaaacacacaacatacagagagagggtttaagtggcacttcaaaaacaaatcctaggagtgcaccctgaaaattaaacacactcatatgaatcaagtttctaaccagacaacttgtaaacagtagtcaaagtgaaggttatgaactatccattagattatcggagtattatggtgcaacagttataaagcaaacctgtagccttgataagatat

SEQ ID NO: 72351 - DNA, 2377 bp, Oryza sativa
cctgcagcccgcatgcttaacgactaacgtggtatgatcagctagcaataattaatactcctagaacagtaagcttttgctacatgtacggaaaaggatatactatagtattagagcaagtttaatagtatagcaaattgctaccttcaaattatttatagtcaacttaatagctaatttatacaatagttactataaacatatactacataattaatatttagtcccacctgtcatacactacacatgtattttaaagtccgtactgtagctggctacaaatctgtagcccgccgctattctctcacatcttctatcttctcaaaatgagtctatggctaacttatagcctgctattgtacctactctattgtacctgttcttagggcatgtgcaatggtagtctcttaacgttactaattagaaatgtttgctaaatgatagagagagagagaaacaaggagaggcaaacattatttttactatggttaacaactttttagcgacgactttgaacatctataaaatgaaaactttgctgcataaagatgtgaacaaggaaataatagtaataaaaaataattttgtagattaatggtttagagtgtttgctgtgttcaccgttgtaaggacatggtatctaagtaaacatatgttactaaacccttaaatactacctcccgtcccaaaatgtaagtatttttagctagtgcccagattcatagctaaaaatgcttatattttaggacgaaggtagtatttaagcgtttatatatatatgggctctgatttgaacatgcctaacaacggcttttagccttcatacaatgaaaacatagttgtatgagggtgaaaaaaaaaggaaacaatggaaataaaagaatcttatttttaattaatggttatattagagcttttatcatctcactgttgtaaagacatggtttctaaataatcttatattgcctaagcgaccatactcgtctttactattgaacgtgcctttactctctctctctctcgcaatatattcttaactaaagcaagtttaatatatataagagagctagcggttgtctccaaagttgttcacatcaaaggtaggaattgctaatatatacaataactagctattggattactatacaaaaatttccaaaaaatctatcatccaacttttaaatataatcaaatttaggcccccaccactttagggcttattcgattttgaggaatttgaatccataggaatagaaaaggtgcaagaataggaatgtttgcatacatcaatccataggaatttttccaacatgtttgagtggatggaaaaattcctatgttttctctatacaacttgtaggaaaggaaactttcctttgattttcctatacctcaatccaacaaatggaatgacgctcataaaaattaatcttatgaatccaaatgctttgtttttctctaaaacggacaagcccttaatctgccttttctctcacccaccaaactaatttttcttccaacctatggaaggccatgcagtcccacaaataatgcatggtattggcagcaccagccgcatgcaggcgctaagtactttctctttatcttgtgctatcgcctggcgactgcatgattaggagtagatcaaacggtcggaaactaattgatcctctctaaaacgttatcatgacagacaccactgtgatttagtaaagtgcagtttttagttaagcccttaactagtctgtgaatgcagtcaaaatatctaataaacactttatttttgaaataattactctcctgatggagtaataattactctctctgtttttattttttacgcgtttaacttttggacgtacgttttgatcatttgttttattaaaattatgtaattattatttatcttattgttatttgtttaatgcctaaagaacttttagcagaattacatttttaatatttgcataatattttgataagacgaatggtcaaattatatccagcagtaaacggcatcaaacattaaaaattgaatggatcataagtggcgcttctagaaataaaacagtactagcagaatgatgttttttacaataaccctgggtgacgtaccgtcaagacccagctgatgcagttaaaccaaatcggctgcggctttatgataaacaagtgacaaactctaaataatccctctgtttcaggttataagacgttttgactttggtcaaagtcaaactactttaagtttgactaagtttataaacaaatatagtaattttataatatcaaattagtttcattaaattaataattgaatatattttcataataaatttgtcttgtgttgaaaatgttattattttttctacaaact

SEQ ID NO: 72352 - DNA, 13872 bp, Oryza sativa
gtcggtgaagacgtagacgcccaacaacgggggcataaaggccagccatgcaggcggaaacaccagtcgtcagtggcggatgcgtcggccggttggtgaagacgtagacgcccaacaacggcagcataataggccagccgtgcaggcggaagcaccagtcggcggcggacgaggcggccggtcggtgaagacgtagacgcccaacaacggcggcataataggccagtcgtgcaggcggaagcatcagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggacgaggcggccggtcggtgaagacgtagacgcccaacaacggcggcataaaggccagccgtgcaggcggaaacaccagtcggcggcggtcgaggcgagccggtggtgacgttctgactgatccattcctggagcgtaagagataagcttaaagccatgaatcccttttatgcatatctggatctggatcctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacgtccaacaacggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccaatcggcggcgacggaggcaggccggcggtgaagtcgtagacgcccaacagcggcggcataataggcatgccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccagtcggcggcgacggaggcaggccggtggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccactcggcggcgacggaggcaggccggcggtgaagtcgtagacgcccaacagcggcggcataataggcatgccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagatgacgatgcccatcaacggtggtgtgaccaaccgaccgtataggcggggacaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgaagacgatatcgccatcagcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccagcacaaagttccatcgcacttctcgacggaaaactcgacgcagcccctacctggcgcgccaactgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatgatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacacgtggcgagacaccatttccgggcgcccgagcgaggcgtcaacgatggccaactgccggcgagcgcgaggcggcggtcggacgaatctcgtgttcctttcgctccgtggtggcgcgtcctaccgcggtactcgctacctcccaaaatataatgattttaaactataataaggtctctaaaatataaaatattagtttgactaccaatatctgtaaaactagtattgtaaaactagtattttaaggtaaaaaaattacatattataatagtttgtttaatgataaatctaataccatcaattttacatgattgatcttttttaaatttttttactattaataattaaagtttaaattttttgactttttttgcggtggttaaattttttgacttgctactctgctacaaaataattagtatattttaagacggaggtgtacttgatacgtaccacgacaccggggcagttggtcccccaatcacggccgtttgcttacccgataaggaaaaagagttgggaggagacacaactcgcccatgcactgcacagagagcggctggttggtcaccacggtagcgtacacgaacacggtcgatcgggagacgacagacgagacgccatgcatgttcgcggccgctcgccggccggtgttagcggtggccggtgaccgggtgtctgaaatcctatccgatctccttgggaaccggagccccatgcgcgaacatgagcatcacaacgtctgaacatgacgggaacgtggctggggtccgtcccttcccttcgcagcccgaaatgcgcaacgtgctgcagatcagtggttgattactccatgcttgtttatgtgcaccaccggggaccagtgagtagatcacgtgttaatcggccgcacacactgacgggatagtgccgtactagaatcatcggcactggtgtacgaagcgctactgtagtagttgccgcttttcaccgatggataccagggaaatccaacgtgcaatctgccgcgaggtttaccgggcggcgggcggcgaggtcggcaaattttgcccgagacgcgggcagtcggcagtgtggccaactccgcgtgaatttcttttgcccactcgggggaggtttgcttccgcgatttcgcctccgatcctgcagttgcttggcttgagcggccacttctccgctccgcttgctgctgtggcctgtggcatgtccgcgctgtatgtgcagcgtcagcgcggctcgcgcaacacgcgtctgttgcgtactatctccccaccttgttggttgatggccacatctcacgccttccagtctcgccggtgtcctggtgtgccctgctgacccaatgaacgcacagtagcatcgttttgctcatcgaagagccgaagatatgtccaggcagctacagattgtctatttgtctactttttcttttgaaagagaattactaaatgtcaattaaaaaaaatctatctttgcctgtgagcattgctagtggccggtgtctactagctagccaagagccaaaaatgggtgatccaatagctgtaggacactgcgccgaccggagcccatctcccacagattccagtcgattcctcttatcgtctcctattatttttttcccacgagaattcagatggtatcgacaatatcctagagtaggctccgtcctcgtgcaccaattattcatgcacgcaataataatttgaatagtgcaactatgattaattggaaggattagcttgttgccctacgcaacgcacaaccccaaacccaactgacggggttaatatctatcaccagcacgactaatgacatgtcaattaaactttgattatccgagtcatcatcgaatggctttcttatctcgcaactcgcacattgctttttcagtgacccaaagggagctctcacaaagtcccaaaaggaaagcatttgactctgagttagtgcgagccacgttttgccatttttctgattgcaagatgctttcccttcctgactgacccaggagagcttcaccgattgctaagcaacaaccctgtagcttcgtcttatggattttctttttctgtaatcacatgggggtatggacttgtagctggtgaagtagataagctgcttaccagataagatacttcacgagaaaacagtattatattaaaacagatactttcacgagaacatgaaggcaattgtgactgactggctatatatactccaggatgaacccattatactatccctccatctcaaacaatagagcgtatttttgttttgttaggacagggaatactctattatgatataattctcacaaaattaatatgctttgcacgactgatcattgttttacatggcattgatccacaggtaaagtatgtatgaagaaaagaagctatgtatcaacagctcattcatgtttctgtgcccactgagatcaccacctcaccgtcagtcccatgatcccatcctgaaacttggacaggcttaacaacagtcagtcagcagaaggcagtgacgtgaagccgtcaactgggcaagagaaaaatcaccatctagatcatggcgtccaagcaaggtagaccgcagacatctctcttcaaaactgatgccccgcacattcctggcggctacacactgaggagaacatcaccctcgtcgaccatgttcatatgcaaagagctcctagatctggtgcaactttagaatcgtgatcccggatggctggtgtttcatcttgttctttcttcttttgcttcttccccttctggcctttcccttggccacctttggtcctgatagtaaagcacattaagcagatagtattagtacataacacttccagcattgtgttaaacatgcaatgcaactaacctccctagtgaaaaaggaaatagtaatcaggtcggtgactttaaggcatatgggataagtgcatattttgcagcaatactgttaaggtttcataggccagatacaacagcagcaatgcactatgcaaatacgctggaaatattgatttcaccccccaaaaattccatttgaaagaatgcttacaatgcgaacagcaggacataagttcagttgtagaatagaatatggtaaaagacaaacaaaaggacagaaacattataaaggggattagctatatttaagacaccacattttccaccaaaaaacaaaaaaaaattaaaaccaaatctcaatacttacaccatattttttgcagcacacactatataagagaattaggatgaaaacaattaattacctacttgaaagaggagatagtagagcgaaacatacttacataggagtataaaagaatggtagcaatccgaatgggaaaaaaatgactgaaatcaagtcaaaaatgtggcgccatatttttagcaaaaccattataaagccatactttggaggttctctcgatggtgcagttgtttttggaggttctctcgatgctacagttgtggctaaattacaagaaggcttgtgcttcctagcagatccacaagagcattccttggtttttgactttccctgtgcaaaagaataaagggataattcctatttattccttccaacatagtattttaacaaggcaattcaatgtttggaaactattaagagtcgtccacatgatagttacctttttagaatgtgaactgttgtgtttctgagctgtttcgcctttgctagaacagtccttttcttctttcttgtgttcatccagttgactctcatcctgcttcatgctaagctcatcctctatggtctgtacatactctgctgatccaggtaatatacacaataaaggaaatgagttcagtgcatggccaatgtaaaacaaatattacttgaacaggtatgagaaattggatattaattgaaacagttaatgccctcagtttacaaaatgaactacttgtgcttctaaaatagtggtctccaacaataaccagccaaacaaaaatgttacctcctacagggtggttagatagcacactaactcttagtacagatatacctcctacagggtatgatattgacctttggcaattgcagaggaactgaacatggaaaacacccagcacagcaactggtatgggctgtttggtgggagcttaaaattctgagaaacagctagttggtaaccggcatctagttcattttctggattctatagctaagaatctggattgtttgagagagctgaaaattctgggagaagctgcagtagctagaagctctccaacaaggccgtagtcttacttgagctttctataacaccgttcatgcttcttggtactgttatcatattttgatgatcttaaaaataaccagtaaatggtaaatatcatattagtgaggcataaacccaaaatgccatgagcacaacacccagtataggttttacctactagatttatgctactgaattgaggggtgtgcatgaaacgcttgctcaggtgaggcagctcatgtttggcaagaatatgaataggattaaacaatgaaaactcaatctatggaatcccagaagtactccaaatttcaccataaatttcattaattgtcataagctgaagtcctcaagaaagataaggatgagattcattcatagggacagccactttagacttcagaataatcaaatgtttaccatcacatgcatagtccagataaggatctccatccgcatcatcagaacccagtattagttgctcagctaacatgtactctatagcagcatcaatgtcaccatccatgtctttcaaaacctatgtgatgtggcattgaccattaatatataatgactgattggctgctacggtcagcctaggctcgcagttgcaatacaagaaagtcgatttgttgtataattcatacctgttcaactgcagcgatattagaacatccagttccagccatcaccaatttaaccgatatatgatcatactttgatctgtctgaagatttcttcaggtcctttgcttttgtttgagcattattgcttgtgctagctacattggcatctgcctgtaatttcataacggataaaattaagattagtaacagagcaagttgagctacaacaggatctcactgtccttccagggacacaaaacaaccaacagtttacaatttggacagtgagaaaccttgataataactggcattgcaggaccttgacatggatcttccctcagtctgacactattgtagtgctcaccctgatgatacgatctatattggaatcaaaacaaaggaacatgagaatgtatgtccttttactgccagtattagcatattagtttaaaacagcagaacacacattaacttacaaatgaatcatactggtagcttcacgatcagaaaagtttcttatgtaccatcgtggtgagttaagctgcaaatcattcagtaatggtacaggcatcaatcaaatgttacagtacgttctcttctatagaagaaaggctataatatgaaaatgagtacgaaaaataacagagaaccatcaggggatatataagcagcacattgatctatatcacccatgtgtttcaaaatacagactaggcaaggctcaactgcctagcgtgttattcataggttgaagaaatcatactgcaaagcttgtattgaaaattaccatgtggatgcatatgttttttctcttgagaatagaagctgcttgcaactccatatgaccagcccaagtcccatcctcaagcatagagtcacaatatttctcaaacggttcctcgtcctcaatgaatggctcaaaatccacacggtgctcctgtaagatgcatacaagaaagattatgaagtgtaaataggccaatgcttgcttgcagcatgtcttttagataaaagaacaacccagcctggcagcctgtactctacgcccagatcagatgtacacagccaaagtttgcagcatgtgcaataccttattgattcaatggcaccctaattacagttcttaagtcacagtgttacaagatgtttcttggtcatagccaaagcttgcagtatttctaataccttattgattcaatggcaccctaactacagttattaagtcacagtgttacaagatgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataatgcatatactattcctcctttcataaactaacagtactctaacatatcgtacaacatcgattagcctcttcttgtaaaaagtggcaagaatttgagtaatggaatcgaaaagaagacctaaagaagcagttgccatccgcactaacttcgataatcttcaaccccagcgagtccagctgcgcccggaactccgtcatgtcggccttcttcgcgaacttcttctcctcctaacaaatcaatcaccaaaaggaaaaaaaaacgagaaaatatattagctaaagctcaattccccttccaccaaaaacgatccaatctccagctgactgaggcgcggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaaccatggcaggcggtggcggcaagtccgtagcggcggcgctggccatggcctgcttcctcctcatcctcgccgccttcgctcccccggcggcggcggcgccgccggacatcatgtcgatcatcaggtacaacgcggagcacggggtgcgggggctggagcggacggaggccgaggcgcgcgccgcgtacgacctgtggttggcgcggcaccggcgcggcggcggcggcggctcgcgcaacgggttcatcggcgagcacgagcgccggttccgcgtgttctgggacaacctcaagttcgtcgacgcccacaacgcccgcgccgacgagcgcggcgggttccgcctcgggatgaaccgcttcgccgacctcaccaacggcgagttccgcgccacctacctcggcaccacgcccgccggcagggggcgccgcgtcggggaggcgtaccgccacgacggcgtcgaggcgctgccggactccgtggactggagggacaagggcgccgtcgtcgcccccgtcaagaaccagggccagtgcggtagctgctgggcgttctcggcggtcgccgccgtggagggcatcaacaagatcgtcaccggcaagctggtgtcgctgtcggagcaggagctggtggagtgcgcgaggaacgggcagaacagcggctgcaacggtgggatcatggacgacgcgttcgccttcatcgcccggaacggcggcctcgacacggaggaggactacccgtacacggccatggacggcaagtgcaacctcgccaagaggagccgcaaggtggtgtccatcgacggcttcgaggacgtgcccgagaacaacaagctgtcgctccagaaggccgtggcgcaccagcccgtgagcgtcgccatctacgccggcggccgcgagttccagctctacgactccggcgtgttcaccggccggtgcggcaccaacctggaccacggcgtggtggcggtggggtacggcacggacgccgccaccggcgccgcctactggacggtgcgcaactcgtgggggcccgactggggcgagaacggctacatccgcatggagcgcaacgtcaccgcgcgcaccggcaagtgcggcatcgccatgatggcgtcctacccgatcaagaaggggcccaacccgaagccgtcgccgccgtctccggcgccatcgccgccgcagcaatgcgaccggtacagcaagtgcccggcggggaccacctgctgctgcaactacgggatcaggaaccactgcatcgtgtggggatgctgccccgtcgagggcgccacctgctgcaaggatcactccacctgctgccccaaggagtatcccgtctgcaacgccaaggctcgcacttgctccaaggttttaaatttaaattttatgtttacttttaatttttagagttgattttagcgtttttataagtaatttctttttcatcattgacttttttttaagttgttaagaacatatgtaaaagttacattggccgctaatacgtgttatgtctgtgtgtgttatgtgctcacacgttgccatgttttttccttgacagagcaagaacagcccgtacaacgtggaggcgctgatcaggactccggcggcgatggcacaaagtgttccggaacaacctgattcaatctcttttgtagttttgaatagggaagatctagtatagaagccttatctttgttactgttaccgagtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataataaatctatatatatataaacacacaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctattcccaattttccatcacatcatatcacatcaaaaaaaaacttttctacacatataaacttcaaactttttttctaaactctcaactttctttgaacttttattttttttcaggaactaaacacacccctgctagcatgagtttccaaaatataaatatcaggagaatcctatttccaacaa

SEQ ID NO: 72353 - DNA, 4809 bp, Oryza sativa
cttcttaatacaatgtttggttggcaaagccggcccggcgaaaaaaaagtttttttttgaaaggagggcaaaagctttgcctcgtatattgatagagatggagaaaaaaatacagagcgacagaaatatgtacagggctagtctaaagaactaaacccgtaaaaagagagagttaagtgatatctcccaaaattccaaactcttgaagctttgaggctcctaaaaaaaagtagaagagttgaaaaaacattaacagaattataacagaaccagctggggaatttgtatgagctgttttttttagttgttgacaattgtttggcagtggattattgcattacaatggattatatttgttcatgactgattgatactaatttgttccatgatcttgtaggtacctggtatagacttcttggtggcttggcgcaatcgtctacacgagatgtaacgtcatctgactccggtgccatctgctggctgctgcagatgatcaccggacattaggagcatgcagcagagagcagctgcacctgctctcttgccatctattcagctcctctcactcactgctgcagaggtagaagatgttaagattcggtcaatcacttgctctgcacaagcattttatacaaagataattcacaaatggatgataccaaatgcatggacgcctatgagaagcattttagaacaagggataagtatccaattactctggtcagctcatgtagtagcctgtagatgttgccacgctgccgcccatggttatgtattgcacaagctttggttcggcttccgcctgtctcctcccaccaagaaatggcgagcgtgatgcagaatgtaggtggataatacaagagaattggaaataaattgctaagccaaataggtatactaatatgagctgatttacgaaatcttttcatttgtattattttgctgataatcatttaacagtggacaactgcacgcagaatgtatcggtattggttggtaggccgtaggcctataccattcacaacccatgtgacggtgtcccatggaatagcattcctgtgtcttcacaagtacatatctattagcagcgcacatatggtgtaccctgccttgcctgtcctcatatggcagccagcctgccagccatccatcgtcaaggtcagttccttgaattcaggtctgtctagtttagtataagtggttgtcgtttcgtattttctgcttatgctcagttgctcagtatatagtctgatggtttttatctcagcgcatttcgtattttctgcttatgctcagttgctcacttccctagagtaatggaaaaataaaaggcatgagtgtgatgttgatcgtggatgaaaagcagaagagttgaaaaggcattaaatactccctatgtttcatattataagtcgctttgacttttttcctagtcaaacatttttaagtttgaacaaatttatagagaaatatagcaacatttccaacacaaaacaaacatattcaatgttatatttaatgaaactaatttagtgttgtagatgttgctaattttttctataaatttactcaaatctaaagaagtttgattagaaaaaaaaagtcaaaacgacttaaaatatgaaacggagggagtaaaacttagcaattttatggacttgcagggacatcaacataaccaaatgagagataccatgggctgatttttttagtcactgattattatttaaagttgtgtgaaaaactcttcataataattgattgtgcattacactggattcgatctgtttatgatttacaccgtcattaattagttccatgatcctgaaggtactcgttgtagagttcttggcgctgtcatctacacaagatgtaaagtcatctggccctgctgcagctgatcattagacagcaggatgagcatgcagtggagagcaactgctcctgctctccgtgtgaagcttgggtcaatcacttgttctgagcaagcattatgcaaagagaactgacaaatgtagatggaaccaaatacatgtacacctatgagcagcttaaaagaaaaagaaagaagtacccagttaatctggtcagttgatatgtggtaccctgtacatcacgccacacagcagccaatggttatttatggcgcgatgtactctgttttttttttacttcagctgcatttttttttgtttcagaatattcacttgcatagattagtatgaaaactgaatttctttctcggtttcaatatgtgagttgcttcagacagttgtacgatctggagtcctgtggcttctgtggagctaacataacacatcgaatgctggagagaaagcaagaatcagagatgagatgtgccagtcagtccagccaagccatatgccctggaatttcaatcagtgcttggtaagaggatgaggtaaggacactaacctgccaagaaaatattgttcgtgcctgaagttttctcagaattgagcatgtcgggagaatctgaacaatggtggttgttgctttgtagtctggagctcaggtgggcattgggcaaccatggggaggaggagcataatgcaggtgctggccagatttttctgggcttctgatcgcttccatgctgagttgagtcgttgcaagcatgtctccaagctctcaagtttgcttcagatgcaggaatgcataagcagaatagtgaagaaacatactccctctttttatgacgttggtcagttcaaaaacattttgggatggaggtagtatgtttgtaatatcgatattggcctatatatatttgtggacgacaaccactgattcttttgtcagggaaactaagtttctgctatcttgtaatctcattggtattcctaatctctgagtgtaattcagtcgcccatgaatgaattagctcatcagtttattggagcttacatggatccggcaagtgtcttgttgtgactggactggatattgtgaacaatgtttcagctttttggtgttctttttttctttcaaaaagaacagattagtgtaagatatggccgatgaattagagattcgtatagtcgatgagatggtgagatcatccagttcgttggtgcaggcagccggacaaattcatcatcagttgttcggatttgctaatcttatacggcgggcgcccgcgacttgtgttgctaacgggcgcttctctgcactgcagctatttggtcaccgtgctcgctcaaagctgccgcgaatggccaccgaggaatgaaaccctagttcacgcccaccggggatgctgcgactgcgaatctgcgattcgtcgcgcggcgttctcgcgggatccaccggtggtgtggtggtggggattccgcgccggcgaaaatctccgccaaatggactggttcaaaggttagatccaccttttctgctatttcatccttcagtccaagtgaaagctgaaaaagaaatgaatctgaaaccggatattttgtgtaggattggtgttttacttcaacagttgcgactattggttggatcatggattgggaggtccgaatcggctgttcattgtaccctcggcccctgtgttggcaaggtcatgtgatacatacacaggtaggagtaacactcaaaacactgtgtgctgattaggtgatctacaagttgcctcctcgactactagaatctatagtgtgtgttcacttcactgaccgagttcaggcctagttcggtcattgttagcacttgctttcacgaaattggcacaaagccgtgccagtggcagagctcgagctcgacgggtattggtggaggccatgtccttgaagccttgtttggatcatggactggcagaatcggtttcattgtgcgctacgcatgccgctctcttggctacatatgttcaggacttcagatcagctccgagctcgttgatacataatggaggtaacacgtgatgtcgcaacaatctttttccctctgcttatgtttcttaggctcaaaagatgaactgctgaatcatactcagcgaccttatcatcttcttatcctcaacatttaggcaacagcatctagtagttggtatgtaacatcacatgcttagattttctgcatggtcgatgtcacagtttgctccactagctcgtaatcacagactcacagtactaccaaatattacaactgtggagccaaagaagacttgacttgcagtctcccatcggctgtgcagactacacatcattcttctttggctcttatctcatttgctccgtaccttctcagttgatcccatcttctttcattgcgccactttcgtctagatccatcctcttgtgcaagggttgttcttgctgctgctacaacctccttaggtgcattggggaacgatgggattggtttccacagcagctgaggctgcaataggatgggtggtgcaaagcatactcgggagtttcttcacaggacagatgcaagtgtggactcgtgaagttgggctcgacaaacaagtggaggagcttgagactgagatgagaaacatgcagatggtgctcgcagaggctgagggaaccaagattgataataggccactgtccgagtcactggatgagataaaggagctgatttacgatgctgaggacgtgatggacgagcttgattactaccggctccagtgacagatcgaaggtggtgccaaatctcatcaatctttcattccatgtttattgttttctaggagcatttcttttgtatttggctatgcaactaagagtagccgaataccatagacatcaccagtaggtttgtctcttggttaagtgcgaatgt

SEQ ID NO: 72354 - DNA, 1946 bp, Oryza sativa
agcaaatgattatgtactgatattacagtaaccattgtttcagattacaccctcctgtaggaagcaaaaatgaccagagatgtaaaaatgaagccatagcactaatttttgtaatgaacctaactttagcatgttagagaaaaggattaactaatactactgtattgaataggagtatggaataggatgcttttcagtgtccagcaaggagaacaaaagctgacattttgatgtccactgtctgcagcccactggaagatgctctctaaactaaaaaatgactccacaagctaaagaaaagcttgggattcctcatgcccatgctatgtaactgtgagcgccataagcatatgcgataactgctaacccagttgaacgaatcaaagaaaaaactcgaaatgctactgtccctgtaggaaaaaagaagaagaaaaaaaaaacacaaaagcgacttgtgcggtggagaagaaaacattgtgaacaatcatcttaactagtgccagtgtttctctttgaagcaatcatcttggcgaaagccaggagcttgacaaggcacggatcaaaacactggtggaatggaagaaaagaaaaggaaaggaaagaaattcgagggggcgcggcgcttacgggaaccagagcgggaagaggttgacgaatcgtgaccagaagggctggaggatgtacttggcgacgagcgagtggtcgacgccgctgtacttgtacctccgcagcgtcgccaccccgtgctgccccacgtaccccatcctctccctctctccgcctccgccgcggccgctgcctcggaatccccaaatccgaatccccgatcggaacaagaaagaagaataagaagaagaagaagaagcggatgaatggggaaggaaggaaagagagcgggaagaatccttgggaatcggaggaggcgatgtgattggcgcgggggagggggaggatctggctggcggcgaggcgatggtggtggtggtggtggtggtggccgccggtggtgattggttgatatgctgcgagaccccaaggaggagggaacaaaaggaaagagaaagccgcggcgattttacggtttagtcccttcattttgggaatcatttgtcatctcaaataggagaatgaggatagtgcgagggcacatttcaaaattcaagtgaattaatacttgaaaattaggagtactactatacttcctctatcatagttttacactgtttatatttaacatttgatcgttcgttttatttgaattattttatgattaacatttttattgttattaaatgataaaacataaataatattttatgtgtgactaatttttttaaaaaaaattataaagatggatagtcaaatattggatatgaatatctacagttgtacttattttttcatgtgtgtgtgtggagtattaaatttgaaagtgcaatagattggataaataaatgtaatccagataaaatataaactaactttgaaacaaaggttgcctatgtttggtcacttttggtggtgtgcaagtggagtggtttataaaattatgtcatcgtgttgctcgcctctcgtcgtcttcccctcttcccacgcgcctctcccgtcccgtgtcccacctgcgtggggtcaaccggtcaacgcgccacacgctttgcaattttccactctcacccctcctccccccaaaaatattcaatctggcccaaccagtacaaggctgacatgacatacatgggcagggaccacggcccaataatgcaaagcccaacaaactccattggcccaaatacggcccactaaacgaaagcccaataatatatctcatgggccaaaagcctcctccttcccgtctccttctgtcaccattcgattcccaaactctcgccgccgccgccgccgccggggacgatggggaaggtgccgcacgccatgcgcgccgccaa

SEQ ID NO: 72355 - DNA, 4822 bp, Oryza sativa
cacagaattcctgaattgctgtagagtctggcgatttgttctgcgagaagaattcaaaggcgtcattcccaccagcactgatgaggaagatggattttgacagcaatgttgacgctttttcggcgctcaatatggtcgaaatctggtctctgagatctgagaagtactctatctgctttgtcatgctgattgtagtcccctggtgcaatgataatttgttaagtcagttgtcagttgtgtgcagtaaactgtactagtagttgcactttggaaaagtaagtaaccaaattttgaaccagggagcagaatttatagctttagttgaaggttggaagaaaattttcaactttaggtagcaaccatgctcctaccaaacttcctttttttctggtgatcataaatatataggacttgaaattcaattttgtgtccaacaaaattactagcattacatgacatcacaatccacaaacatatccatcataataacagaaataacatgcaggatcaaaatggttttggagaattttatgcgtactgtggaatcaagaacaccggagcctccggaagcaaagctggctcctttcatggcggatgcagctgccatcatcatgttgctcatcacctcaccactgctgttagcatccatggcgatgagagagaggtaaggtggtggactcctggtgaaccccatcgcagccgctacaaatttcattttcaaatattcttctccattcatcagaatttacatattgaatttgctgaaatttgttaactcaagtgacgacgagatgatcacttacacttactttttttccacctttgcatacaattgcaaaccgcaatgacttcaattattttcagtgatgaagctacttagactactactcacctatgaagtcgacgccgatgaggccattgctgaacctccccgtcggctcgccgccggggaagtcgacaccgttgtgagggaagtcggccctggcactgattccggccaggtaattgttgttcccggcgtcgaccgtcgagtcgccgaacacgaagatcgccggaaccttcgccgcgccgccaccggcagcgcccctcgccgtcacagcagccacggccatggccacgagaagcaaccggagctcggtagctcgtagcacagccatggctatgagaagcaagtgaccttgtgacaatacaagcagatcagctagttatatatacagagaagagagagagctagctcagtgcttaattagtacaggatttgggttggaatgtgattacattcacccttacagttacttgttactacaattaactgtactcagtaactaccacaaggctcaagagagaacaaaaaggaggaagccagcttgtctggaaagttcttgattcttgatgcccaggacaaaagcactaggggataagaaaaattggagcaagatccaattgattgtgcattttacaagctatgttttgataaagatgtagcagtgcttatattttggaacagaggtgcatcttcaaatgagaatagacaagttcactccaactctccaagtgtcatcatccattcagcaaattcaaatcatgctttcagagcccagtacatcagctcacccggagagaggaacaataatctattagaatataatagtatgtatatataagtttactctctctctcaaaaaaaagagcatgaataatatgtaaggcataatgagcatcatttttagcataaattgtacacctgcatctcaggtgatgctacaatgtaaaaattacaaatgtatcatctgccaatctgctcaacatgtacccccaaaaaaaaagttttgccgagcatcactgaattgaagttctaggtgatacaacaaacaaaatccaactcttccaaggacgtcgtttccttatcagcacaagttctgatgataatttcaatctcggataatagcaatcctgggaataacaaatgcaaatatgatctgaagagcagaatcttcatgaagaataattgaaaatatttgcctttttgcgcaaatataacatatgattgccaaccagagcaaggcaattgtggatggttcacaattatgcctttttcctagtgatcctgtcaccacacaaaaaacctcgtgtcaaacatttgatacaaaatggcagaaatgaagtgcatagcagtgactaacacaaacctgaagcaatgaatcccgagagcattggtgatttcatggataacagatgtagcaaaatgcatgtagagagccactgccaaaattgatcaaaatagtgagatcaaacatacgtggaacaaaagggcttgtacaaggtaagatatgctactactgtaaaaactattgaaaagaaatcggtaaaaactactacttcaagcgccatcggtagtaattaagttctggaataatgtagtaccggtaaataagcagtacattaggagaactagctgctcatcaacaagggggtttctgcaacaacaatcgatggccaaataaggttggtaaaaagagttatcatgtagaggataataaaaaggtagttaggcacaaacccatcatcaagccgtgcagtcagcgcatttgcaattgcaaatgggaaatatgctagggactgcaaagggaggcacaatgtttaatcataacaaaatatatgcgtatcatcatatattacttataaaaggtggtggaaaacaaaaccaaagaacaaaggtgattaggcaacaaccatgcacatccctgtcttcagacctttgggctcatcacataagtgagccagaatcattctgccctgtgcataatagaagtagatattaggtaatgctcataagagtgtcttttgcaacaaaagaagcatgtcagaccaaaatatactggcttacataaactatttttagcatgacagacctggaacgatacaatgctaaaactataaagtgatcatattataaactgttgcttagagttgcacacctactctgaacagaatctttaacacaaaatatcaaatcatgccagcatggtctattgagaaataataagatgagcaatattataaaccattccatgcattaggccaataaggcgattttcatagcagcaggcaggatgacagacagaaatatatttcacaatgacaggaagttaaaagagaaacatccacaaaacaagtatttgcaaggcaataaatgtatgagttatagcacaaggccttaccacaagaaagccaaatgcaaaaccagttccaataactagaagatgtggctggtttctcattatatctgaaggagataggtaggacctgaataaaaatgaaaaatccttcagtgacatgctggaggattttttaccttaactgctagcttctgttgtctagctcaaatttaataaattaatagaaagaacaagaaagatatatacaactaaactagaattaggtgaacaggtataccagacaagaactccggccaacagcaaaccaaaaggaaagagctggcacaacaaaatagaatatcatttgaaaaaaagagagacatgaatacatgataaaatcacaaaatgacatatttagatcttaccattgctagtgccagcagcatgcttccttttcttgcctcgaccactttgtacacattgtgaatgctgtaggtttagaataatgcaaattgatcataggttgaatgtttatcggctatcaaataaagaacgttatgatatttttatttaaattcaatagttgcctcgagagtgaattgataaataaaacacaactattttttcagttgattccaagagaagcttgctggattcatatgctccatagtccatagatgactaaactgacaggtaatataaaataattcataaagtagtacatgctgtgcagtaagaacttacttagatccaatcgtcggaattacagcaaaagctatcattagaaacagtgcaattccatatactgggacctctgcaaagaagcaaccagcaattaattatagtataggcaatgccagcatttgtagctgtccaaaaccctacgtctattgcacagtattaacgaaaaaattgcactgatatagatgaaatagtatgctaaaacaattgagtaccatatgattaccaaaacaataaatattacgaaacgattataagcttgctagtccccataccaggaacaagaggtacccagtttagtaggggtattgacttccggaaatcttgtgcccaccattcagctcctgtgaaaggaaagatgagctattagtattgctataaccacatggcttgaatgtgactggctgatatacatgcacagtaaattgtcagaataaaaccacaaagatttacaggctcagaatagatttgattagttaaaagttgataaaaatgggaataaaatagtacctgtgaagaaggtgaaaaaatggcacaaatagattagcataaggccttcagtcggtccgttgactataggaagaattagtgtgtttgtgaaaaagctgcagagatgacaattaagtgtgaatagaaaggtactactcaaaatctatgcagtgaaagtctcttaatatcaatgcaaatatagaaacaacaatgagcagagtatctagtttattagttcttgaacttgaaaaaaagtagtgcttctatcatctatgttcttgcagaaactaaattgaattgggccaatgctgataaacccttgattttcttaccggtgctttcgaattctttaagagcactaaagcattccacagaccatttcacaatagatgagtgagcataaaaaattggttcatagtgtagttgatgctcta

SEQ ID NO: 72356 - DNA, 22957 bp, Oryza sativa
agtacatatattttggtagtttagtttcacaataccacagctatcgatgaatggattcacccgtgagatgacgtggttattccatctaggatgagaacgtggcatcctattaatttcgtgcgatggctggtaataggatgtcatgtcctcgtcctaggtgaaacagccacgtcatctcgcgggtgaatctattcatcgaagtgtggttttgtgaaactacacaaccaaaatgtatgtacttaagttccaagtgtcaaagtgtgtgtggttttctgcaacttggaccacaaaacgtgtagttttgtgaaatttactctataaagagtaatgcctgattccagtagtgatttttgtacacacatttttgttctgtttccaattgaagtgattgatagttgctgtcttgtacttttttatgtttatactgttcagtgtagaaaaactgactataatttattgatggtttaacactttgctttacttaatagcttggtagcactaaggttttccttagagctggtcaaatcgcaatattagatatgcgtcgtgctgaagttttggagaatgctgcacgccacattcaaggtcgtttcagaacattcattacacgcaaagagtttgttaaaacaagggaggcttcaatttctatacaagcatattgcagaggtaaaatttctgttgctttgtcaccttatttcctccatgaattctgatatattgctgctttcagtgctaaattgctgctacattctggttgctaattttaatgactttgcaggctgtttggcaaggaagatgtatatggtgaaaagagaaacggcggctgctataattgttcagaagtatgtccggagatggcggcttcatcggacttaccagcaagctcattcagcagctcttcttattcagtcctgtattcgaggatttatcgctcgccgttatttctcagttatcagagagcagaaagctgctttggtgatacaggtgtgtccctcctcttaagtttcaacttggttatctggaaacagtgctaggatagtaaataaataatttttaagctctcttttgaagtcataagcatgttccttaatttgttgttgagctgttggctaaggtaagtctagactaattagaatattagcttcatagcttggcatggaaggttatattgtattgtgatgccatcaattgtttatacgagaaaaaaactgactcatatggttgagttttcaacactgatttctgttggcaattgcagtcattgtggagaaaacggaaggttataattcttttccaacaatacaggcaagccactgtgaaaattcagtgtgcttggagacagaaacttgcaagaagagaactaaggagactcaaaatggtaaattctttgtgctattcgatatattatcttttggcgattttcaagccgtactgcaaaactaaaatggaccattgcctgttttagttttttttggtttttctacctcaaacactaccgtattactattacttgttattctttcttcctccacatgctcatgagggatacatgtttctgtgtacttgaaatgatctggtccaattttccttccaagttactctgatctgctccctttgtgtcatctggcaggttttattatcctgtttacagactagttttgtttctagcctgttattttcatgcattgtgaatactcttaggcttagttcatttctatgtatagaggttagctactacctcgttatttgtgagcacgcttcccaaactgctaaacgttgtggtttttgtaaaaactttctatatgcatttcttttataaaatcaaataaacccaattttcaagtttttaagagttaatactcaattaaccatctgctaatggcccgcctcgttttacttgcaagtgaaaagctgtcccaaaccgttcattcgaacatagccttatacttggtttatgttataggctgcaaacgaagcaggtgcactgcgtgaggcgaagaataaacttgagaaaaagttggatgaccttactctgagactaactctagaaaggcgactgcgtgtaagtgttgtctatcattttttacctttgtgttctatttgttaattagtacttaataagatttgctgttgaggggagaccacacatgtatatattttactaatatgcttgttcctaacagtattatgacacttatatctgtcatttggtatttaatgcttccataccattgtcacatcatgagattaacctaaatgtttcagaaactgattctgtgaaaaaaaatttcatgtttaataataatcataataatgtatttcgcctcatggggcatgaactttaaaatgtaggctgctggtgaggaagcaaagtcagtagaaatattaaagcgcgacaaaatgatagaatcattaagtgccgaatgtgctgcagccaagtcagatgctcaaagtgaacatgacaaaaatcggctactccagaggcaattggatgattcgttgagagagataactatgttgcagggtagcaagattatgacagcagaagcagaaaaggagaactccaatctgaaggttcaaaggctttccttgtcattttaatcgcaatgatgcttggttaactacattttcagttattctctgctgttttttttacacctttaattgcatctctcttatttaatgatttttccattgtctaattgctgtacttctaatgtgataaagttaccacaatcatttttttatttagttttaccattagttttcattgctgctgtaatttgctgttagcaatatgcttctgtgtttctcttaattgtactttggctgaaattattctatattactctgtacagaacttagttgagtcattatcaaagaggaattcgtcactggaatatgaactcacctcagctcgtaaaggtagtgatgatacgatgaagaaattgaaagatgttgagggaaaatgcaaccatctccagcaaaatttggacaagtatgttttccctttcatttattaaaccatagagtgctagaaaaatatgtatagtattctaaggtttattgctgctcgtttgtattgggatgcaaagcatctaacagctactggtttgctaattttagattgcaggagaaacttacaaacttggaaaatgaaaatcatgttcttaggcaaaaggcattaaacatgtctccgttgaacaatatgtccatggctacaaaggcttttcctcaggttcttttctttgctctttattaattgcttcagctatctgtttgttgctgttaatatttgatctagcatttaagttcttttattgatactcatatttgggacactgggtactgctctagtttgcatctcttcttaaatagtttactgacatgctgcttgaatgcagaaattcgctacaccgattgggcttccaaacggcgagcagaagcacggatatgtaagcctattcttttgatcgacgtacagaactgctatagattcgtctgacatattggatctcaatttttgaattgtaggaaacaccaccagcagcaaaatatctcgcttcacttccacagagtttaactggatcaaggagaaccaggatgcctgttgaaaggcaggaggtaaattccacatcatatttttcatttgttaatttttgcttgttctagctctgttgataccaccttagataagatggcaaataatttgttctggacgatgtgacattattcaacaaaatttcttatgcatcttggtgatgattttgtgtcatgcaggaaaatcatgaaatcttattacgatgcataaaggaaaatctaggattcaaggatggtaaaccagtcgccgcatgcatcatctacagttgccttttacactggcgtgcttttgaatctgagaggactgctatttttgatcatgtcattgaagccataaataatgttctcaaggtaaacttacttcagactcatctattttgctgtttgtgctaaatgtttatttgcggatgtcaaataatcatggaagttctcctgttcttactccagggggaagaggctgacggtagattaccttattggttgtccaatacctctgcattgctatgccttctgcagaagaatttacggtcaaatggattatttgctacaccatccggccggtctggtggacctctagggataggtgacaagatagtgcaagtaaggaaccctgaaaattatggatcattttcttaccagtactattgaattatgctcagtgtgctgatatccatatgaagtaatattttgaaagcaatgtcctagtttaactctacattattttatcatgtctgtatattttttggacatgacctggctattgacccagtcaacaactcaacgtattgggtcactggttgaagctgttggtcactgatggggcccctggtttcattttagcggcaaaaacaatagcatgacggtgcttagtaaggtcttaaatagcttattcggttcaactggaataagtagtagctaccttagttggttaccaggcagatgcagcacacatttttggaatctttaagctggtggagctagccagcagttgtattagtctatgccgtcagttacgccaaaactacctggttttaacataggtctttggatttgccacttcaaagtggccatcaatcagatttggtctggttggactgtcatggtgaaagtgctggttctcctcctccctcctttctgacaggccactctgctgttctggggcagatctggtaaatcatgtgtacctgtagaggatctatacgcttcccataatgggggaaatggaaacatcatggcatcatgctcttcaagtattcttaatttgcacaactgtataagcccagtaacatgttttgctggtatagaaatttgttgtgcaatttttattttccttttttttcgaaaattcgggtacgataaaattattgtttccctctgttactgaaatggctcctgttttgtttcttgcagacactcagatctccttcgaagcttatgggacgcattgatactcttggacaagtggatgctcggtatccagccatattattcaaacagcaactaactgcatgtgttgaaaagatttttgggcaactcagggataatctgaaaaaggaaatatcaccacttcttagtgtctgcattcaggtacttatccactttaaaatctggacgacaaatagatacattggaaacctagatatgtcagtacaccggctcccatctgaatattttcatgcaggctccaaaatcatcacgtgcacagcctggaaaagcatccaaaccacctggggttggtgcccaaccaccatcaaactcccattgggacaatattgtcaattttctggacttgcttatgtccacgttgcatgcaaattatgtgagcattttcttaagctttttttcttcatcagtggatttaaaggctcttggggtgaatcattcttttttattattatttttttttgctgcaggtgccatcattctttatacgtaaacttatcactcagctattctcttttataaatatacagctttttaacaggtaatttcctcaatttttaaatttatccttgttacatttacatacaagcaaacaaaacagtttgcacatggtaaccaatcgatgttattgaatgggtagttattccttggatgatataattatgtcttcattagttttgcaaatagcgtgatcattgcaccttttatttatgatataagcaaagggcctttttgacagtgaactgatggaattctgttggttaaaagttataataggagatggtggtagaattactttgggaaaaatcggagatggtggtagaattactttgggaaaaatcattactgtattatgtttgagataaagttataggtaaaaataaaatgatgaaatcatatggtttgtaatgatattaacagtcctgttcccattgttccatcagccttcttcttcggcgcgaatgctgtactttctccaatggggaatatgtcaaagccgggctgtcattgctggagaaatggatttctgatgccacggatgaggtaggtgtttgcattctgcttgtgaagttgttttgcactctgagaatggactatgagaaggcctgataaaattgttagcttatcccactatatttgttcccagtttgcttatataccttgtgttttaggaacttaggagcaagcaacattattatacattttatcggtgctctgactttttcacattgctttactagtttattatccttgtactttcagtttgcaggaacatcttggcatgagctaaattatatcagacaagctgttggttttttggtaatttcttgtgcatgctgcatttgtttccatgtttctgtgcttcttttgtatgcctgccgaacatctcactaattgcataacacaggtcatacatcaaaaaaggaagaagacgcttgaggagattaggcaagatctttgcccggtaagacttgctgcatgtatgacctccgatttgtgcatatccattatttatgccatacctcaactagttattttctgctcttgttctttgtagaacttgagtgtacgccaaatatacaggatatgctcaatgtactgggacgacaaatacaatacccaaggaatatcgaatgaggtaatcacttttggattggaggctttccattttttggggattcactatgcttttttgttctgagaatttcgggatctggcaggttgtttctgcaatgagggaggaagtaaacaaatatactcagaatctcgtatcaaattcctttttattagatgatgatttaaggtatgcgtgatttcttggttaaaattttagacagcagaatcagcctttttgtgtatgtaaatcactactatccttattgcagaacatgatttactatctgttaatttgcccttgtatgtgatgctttctttcagtataccgttctctacagaggatttgtcaatggccatccctgctatagattatgcagatgtagaatttccagaatcgcttcatcactatccatcagtacagctcctagtcaagcatcatgatccacagcctgtctaatagtatggttggggttgccttgaagattcgtttatttttgttcccagtttttagtggggtttcatcttttgaactgttgtatggttgttaggcttgtagtcttaagtttatccggggtgaaaaggttgtaacagaaatggtaggatgtcgtttcaaagcaacaattgttgctcggtgaaaattaaacaatcgtggaccctggttgtccaccagtcctatcttcagatgtacatagtgttgtagagacagttaagcatttgctatgaaaaatatccatgttctgtagcgttagttttctactcgtgatctgatgtttggtgcaatgtttggcaaaaacataactacctttgggctcgtcaaaacaaaaggagaataggaaaaaaaacgcaattagtatacctctgccattacccgattagtggtacctgcatcttaaaatttaagcttttctggctatggagtagtcaacactaacatattaggattatttgataactgttataacggttataaaaagacttgcaatgggttttaaggagcgagtgcgctgatgtatctgtggcaaaatctgtcgtaggtaatgtgaaatgtacgtgaaagtgttgggaaataacgggaattgtttgtattcagaaatatccagggaagacaatcccttaaattgtgcgtttttttctgactaatgtagaaatgttcatcgatggacatgtagtattatgcgggaaaactgatatgcatacgactcaattgtttaactcacgtacaactgaatttgatcagcggttgtaaacagttacagtgtatatgaacatgctctccttatataattgcatatctctagttatatatgagtagtggtgaaatcgggtcgggttcggtcggatctcactcttcccatatccgaacccacattttataatcggaatcgggttggatacggatagtatcgaatacggatacaagcacggataatatcgggcacaaatatgagacgaatacgtaccaagacggatacgaccactatcggttacgaatatcttttcggatatcaagtcaaagcaacgatcatctatactatatagataatagctatatattcaaccaaccccatataaccataatgcgactatattattagggcttaagatgtacgggcaatacgacaatgaacaattgatttttaactggaaaaattgaaagtttggttgaaattggaacgatgtgatggaaaatttgaaagtttgtgtgtagccgtgtaagaaagttttgatgtgatggaaaaattgaaagtttgaagaaaaaatttggaactaaactcggcctgacatgtgatgagctgctaacttcctgttcctgaagagatgaggatcggctctggcagcaaaggcatgtagcggcggtggccgcggctcagcggacgcagcaggtggcgcaccggtggcgctcgtagtctcggcatcattgctcaatgggattagtgaacagtaattagtatttttggttattgggttgttaggcatggtttactggttgatggtggtcattgtactagtgggccttttggccactagtgctttattgggctagacatgttatctaggtattatccggatatttaaccgggtaaaacccatatttttgctggataactcgtatccgtcggataccgtcctcccaaacccgatctcatatccgatagaaaatacccgtattcaaacccgctacccgtaaaaacttccgggtacccgaatttttgacccgaaattgtctcgaaataatacggtcaggcgggcaggcgggaaatacccgccccgttttcacccctatatatgagttgtataactggatcgtacttatagcagtagaactgaagtttagttcttttcaattgaatggctgcttttgactgaaccctcttttcatttttcacatttattattttccgggattcagcggtacaagctgaaaacaaagggaaaaaaagaacaccattttcctcaagaaaacaaaaggcaatattacattttttgctcttgggatcgaaaatagcatcaccaagaaaaagaatcaacgaacatgttactgcacctcctgcactttgcatccaccgtagaaatatgttaccactattatgtacacttgaaacgatctcgaacaatacacgctcacacgcgcgcacacacgcagtaacaggcaaattcacgccctgccgcggtcgcactttgcatccaccgttgaaatcttgagctagccgcccctgtccctgctctgcctcggcgagccggacacggagctcgcgtaccggtgctcccccttccgcatcgcgccctccgcgtgcaccgccgacgccacgtacctcctcttcgccttggccgccgccgccacctcctcctcgccgtcctcacccgcggccgcggccgccttcttcccgtcgtccttggcagcaacaacaacggcggcagcggacgggacggtgtagacgaagggcccggcgagcacgtcgccgcaggacgtctgcagcagcggctcgagcgcggcgacgacgtcgcgcatgtgcgggcgggacttgggcacgctgtggaggcagtggtacgccaccatggcggccttccccgccgccttgtccgagtagccgccctccaggctggggtccatcacccggtgcagccgctccggccgccggaggtacggccgcgcccagtccacgaggttctgctcccgcccgcgccgccgcttgtccacgctccgccgccccgtcagcagctccagcagcaccaccccgaagctgtacacgtcgctcttcgccgtcaggtgccccgtcaggatgtactccggcgccgcgtacccgtgggtccccatgacgcgggtcgtgacgtgtgtcgcgtccccctgcgggccctccttggccagcccgaagtccgagagcttcgccgtgtaatcctgcatcgcccaacataatataaatctctccgtcagccacaacatcataattaactatagctaagagcaagtttaatagtatagccaactactaactttaaatcatttataactaatctaatagtctattcatacaatagttaactataaaaatatactcacaattaataaccggtcccacctctcatacacacataatattttggagtatgtgttgcagctgtttttctctctcttctcttttcttctcgatatgtgattatagctggcttatagcatgcgtaactgctctaatgtagcattgttgatttgaacttttgtttgtatatggtgtcagcttagtctatgtttctgtgtaacataaactgtaccagactcgataatgttcacgtgtgattttgctactacaagacgatttcgtgtcaaaattcgatgctacctgccatgggccggcatgtgtgttttactcgtagaatgttctctttactgtttaggtgggtaattaactagtcaaagagagtggttagctttgcaattaattgctcggacaaacgcttgacctgtacaattttactgttctagaggctttgtagccacagtgctcatgaacagcctttgcaacaaccaattgtgtaatctggccggcgatcgatcgacaccaaaccgtacgtttccctaatttacatatctgcttagaataacacggacgtttttgtccgattaggtaggaggcataaataaacaaccaacccggaggagagtagtcctacataatttgttcatttctttaagttttggatgcactagtacttaattaattctccatttcttaagttggccgccacaactaataaagtttgccacaaagaatcgacagagattggccaaaaactatagttcaaatcgtgtactctctactctatatacgtgcgtgctgcccctgcagctaaggtatagcttatggccttattagattcagaaaattcagaattgactagtggcgatctggcgattaggcgaacgggtcgtagtcaccaacgcagattaagaaatcttaattattggagccgatcgtacgtacgtgtgcaagatagacctggtaaaactaattaagcataattaataatcagaggagtactcaccgagtcgagcaggatgttggatgccttgaagtctcggtagatcaccggagtgtcggcgtcgtgcaggaacgcgagccccttggccgcgcccaccgcgatcttcagccgcgtcgcccacggcaagctcgacagcaaatctgcaagattaatcaattaaccgcgctcagttaatgatagcaattactggttaataatgatagtgcaattgattagtgagggtgattaagcttactcttgaagaggtggtgctcgaggctgcccctggccatgtactcgtagacgagcatccggtggtcgtcttggcagcagtagccgatgagcttcaccagatgcggatggctcaacatccccaggtacaccacctccgcctgtgcgtgacaaaaccacgcaattaattagctacgaactcgactaattatcgtcaaagagtaccacggaattactctgtacgtaccagccattcgcggtggccctggtcgccttcgccgtcgaggtacttgacggcgacgtgctggggttggaggaggccggggcggagcttggcgtcgatgaagcccttgtagacggggccgaatccgccctcgccgatgaagttgctgccggagaagctgcgcgtggcggccttgagctccgccagcgtgaaggcctgcagcccggactgcgccagcgtccgcgacaggtcctccagcgacagcgaccggagccgccccgtcgcgctccgcatccgcctcaccgccttcttgttcttcaccaccgccgccgccgacgccttcttctcctcgtcacctcccgtctcgtcgccaccgccgccgaagaagcaacgcaacatcctcctcatctctggcaccgcgccgccgcgcgcgagtgcaacaacaacgacaacaacaacgacgagagaagaagtcttttcgcgggagagagtgcgggtgaggtgaggagggaggacttggtggtggaatggatggtttgacacggagtggggtatataaagaggaggcgggagggagggaggcgtgtggggggttggttgggttgggttgggtttgttcgttgggttggctctcggagtctcgtgcgcgctcgcggagtcgcgcgtatgaaacggccggattgacctgatcacctaggcgatgcccacacgccggccggacggctgggttaacttggtggtttccgcggggggtgatgtgatgctgagctctatagcctctatgtccccctatgaggccgaggccgtccaggtagcttgacataatggattgtttctctcctgttttttttgtctatattttataatagacaaacattatataattagaattatataattagagcttggctgtatcggtgaattgaaaataaaacccgagctaggttagacaaatataataggtgattggctcggtagatggactaaagataaaatactagatctactatggttccgcacacgtgaagagggctactacatatagtggaaaggagatggaagaaaaacgattgcacttttaatgtagcagagaaaattacactttaattccgatgaatattgtggaggagctataaaagtttcagagccaagacaaaactaaccagtacattgagtattttcttaaaaaaatatatatgcctaatttatgcaaaagaaaaatgtgttcaccaacgagcccagctcgtcacccaaaagttgttgagaggtggcttcgctattggatgaattaatataatagtaatgattctagattaatcctttcacgatcctcgaggtggtataattgagtgccacagtaacactaaatgtgtactccctccgtcccaaaaaaaaaggcaaaccctgggtttccgtgtccaactttgactgtccgtcttatatgaatttttttataattcgtatttttattgttgttagatgataaaacatgattaatattttatgcgtgacctgtctttttaatttttttttcataatttttttaaataagacgggcagtcaaacgttgggcacggaaaacagtgtttgtctttttttttacggagggagtactatattttcaaaacttatttaaggatcttaagtattctcttttcatagtaacgttacttcgtacatacgttacatgcgtataagaaattaattaatattttaatgcagcattcttggataactatgacaatatttgtgctggaccacactgatgttgtttaaactaagaagttgtaataagcgttggaatttcacacatttgaaaaatataaagtagtcaatctctagcatttgatggatgtaaaatggtttaaagatgatgtgactgggaggggctatgtatgttgcttgtggaaagaattaaagcatggatatggtcggcttgttgcttactacctccgtcctaaaatataactatttctagcacagtactttatcccaaaatgaagctatttttctacctacctttttctctcaaccaatcacaaccattctttttcacctactttctctttttaaccaatcacacaccttcttcaatcattctcacctactttcttaatacccgtgccaatctaaaaaatatttatattttgggatggaggaagtatgttttgcatccgagtcatggtaagacagagacatcttaccttcccttcaagtttctattagaagatcacttcatttatgttgttttctactagatggtttattttatttttaaaggggaaagcgaccatgcaaaaactaatgatgtgtttatggatcttatcatctggacttgtagagtttaaacagacctaatgatcagggtgtagaacatctgatttgaatatctatctatctatctatttcatctgtagctaactgaagccaaaaacaattcgactagggcttatgatcaaccgattgatgttgaaggattatagcaatgaacgtaacgacaatagaagtagagaactgccttatttttacctacatcaagctcgtcagttcaccctaaaacatatggatgcacaatatatagtctatctcatattataagtcgttttaattttttttatagtcaaacttttttaagtttgatcaagtttataaaaaaattagcaacatataaaacattaaattagtttcattaaatctaatatttaatataatttgataatatttttgatttgtgtttaaaatggttctatatttttccctacattttgataaaattttaaaaaaattgactggaaaaaatcaaaatgacttatgatagggggagcgcagttaattggacatctagaaagaaagcctcaaaatagagaacatggataactagctatggcgatagctaattaattaatcaaatgcttttatgctaaagataaacacgactaaactttagtaaaaaaatgcaggatcaatatcgatgttgaaatacaaatgtaggggggagttactccttaactagtggaagagcagcattctatatatattatgcatttggtgaaatagtgtcaagtgcatgggtttgcttcgaactaaactatttggtgctcgtgctcaccatgcgatcaggtagaagaatctcatgcacatgcacacatagttccaatcaaaggaacggggaatccaggaaggctggaggaaagcaaggcgctgatacgaggaacagtaaaataatcagccaaccaaaccaacccttgcactgtactagactgttcatctatctgttgttagatttgcctatggctggacgattggcctagagtaagtttaatagtatagcccactactagctccaatttatctataactaatttaatagttaattcatacaataattgcttactatactattaatatatggtctcactgtcatacacacagtgtgtactggagtccgcgctgcagctgactacagatctatagcccgctgctcttctctcttattttttatctcattaaaatatatttacagctggctaatagactgttattgtacctgcccaaagaaaatatgtttagatcaacagatagatggacacctgtaagaccatatcataatacttctggtgagaatacatgatggagaccaggatgaatgattagccgtatctgcactcgatttgtacgatgtgtaatctctcaacgattgaggtgcacatgtgtgtgtggatgggtgtttgtcgaggaatcttggaatggttgatgaaataatggccattgattggctctcgtttctcctgagtcaagtagataatcactttgtttacaggcgttgttcactcttcgccatcagcataaccttttaggttgaacgaattatttcgccatcagcataatcttccgtaaaattcttgctttttgaacgggaaaagagcctgtctattcgtgatgcggaaacaagtggatggtgttaaagtgaaaagaatgaattatttgtagtcctacagataacgagatcataggtgaaaagatagcgtgaaagccatcctgtcttcctgattttgtaaaaaactctcactctgtgtccctataagaacagagcataaagatggctactcatactgatttttcaacctcgattttcagtgatatatgtacgattggttgatgaactaactgcacgattcaccgtcacaattactcagtacattcgcattcttatccactaattaatccatcccatttttcaaaataaaaaatatcagccttgaatatatcttgacttcaatcatcgttcgctcatagtataattcaatcccagctctcaggaaaaacctgtgcagtattttttttctcataaccggaaattactactgctgctgtactatgtacttgcatcagcactaaaccattttaattttaattcgccactaattgtaaattcgggcgtgtgccctcgcggacacggtgtctggtttgatttaattttcttccaaccaaactgggccatgagacgctccccgacaaaattggaggattattacagagattctttgcagaaaaaacacaaatctttgtggattaataactaactaataatgcaaacacgttctccaaccaaccctgctcgagatgagtacgagatgaaacatggttttggatttttggagctgtaccatgtttctagaaatggagcggctagctaagacattgaccatttctgcttaacctaactactccctccgggttgataatacttatcatttcggaaaagggtgaggtcaaactttagaatctttgattatcaatcattttcaaaatatttctctttcaaatatggtgactatatgtatagattggtcttaaaaaaatactttaataagatcatatatttgttaacacttttatatatattataatagaaaataatggttaaagttgtttttttgacaccgtgccattgtccaaaacgataaatattatcaacctggagggagtacccgtatgagctagccatgattaggggaccagcactgtactactgttgcattagcacttagccgcagctacttatctgtgagatgatacttcagtactttgtttgtttcttaaaaaatggatttgggttgtcatgtagtatgagttggtaggattagtcttaaatggtattcagtagttggggatgagaaaaaacaatatcactcgacgcggaacagttcatcaagttgtaagtaaaataaaattacgattggcaattttgtaagtatatacttgtgggcaaatgtatcttgttaggtcaatggctgctttgcaaggatttccttgagctgcacaatacaagcactgatcatttgagaggatatcatatcatgtcacaagattgtaagacctcccttgtgggcctgtggcagtgtcgtaattctgacggtttatacgggttgtttaagtatagtcatgttttgaaatataaatatttctaggttttgtaattatagattatgtacatgttttaaatgtaaactttgtaaatttgtagaaaattaaaatttgagatgaaacagagattgtctggctagaatagtacaacatactccctccatcctaaattatagggtgctatcctttaagaaactaggtgataccccgcgttttgctgcgggacttatgtataagtatattttaaatattgttaaaatgataaaagttgaaatgttgagaaaataatatgaaaaagatgatttgacacatacttgttgatctctataatataatattgtagatgatgtatcatgtttgcatgaaatttaaaatatactataatagtaattgctagtgagtgaaaatatgacatgtttgcatgggattttaaatgggctagaaaagtaattgctagtgggtgatgatgtggcatgcttgcatgttgagctttagcttctaataattgttagtgggtaccaactatatagaaaatatagatattaaactcggtatttttttctattaattatattaactatatgtatatatgctaggtatatcactagatttatattttaaaataatttaatacgatgctaattttatattcattagcaatataatatgaaataaattaatgatctatcctatgcacacagaccctcacgtgtacacacgtgcacaccaactaaaaaatatcaccaaaaaatctaaaaaaaatcatacacatactttcaattgtattacatttagggttaaaatcttaacgtcaaattcattatgttttagccgtaacaaaaaaaaaacaaaaaatctgacagttttaaggttgtaattttgtcagaattttatcttttttgttattctctatgtagaatgaatttgaagatgcgattttgcacgtagatgtaatactattgaaagtacatgtatgaatttttctagaattttttgtgataatttttagttggtgtacacggtgtgtacacgcgagggcctgtgtgcataggatacgctcccctatatcttggaagatcgttcttataatttggaaggaatggatagagtaccgtacaagcagccttccaatggaagcgtagaagcaggattttagtactgtagtgcacatacatttcaacctccaccgtgtgcagatgtcaaagggctaaacgtttgacgagagctcccaacattcagaaaccggacagcttcctcccttgaagaattcagtcatgtgctcaatttgacctgtctcagtactcctacggagcactagtgcccacacggctctacagcctttggactcttcctcctcctccgtccagacaagggagagcttctgcttctacgcgttcgtgacgctggatgtttctgcatacgagagaagagaaaaaaaatgagagctctgcatggtttggtttctgtcattctgtgggcaaatgcaggccatgacggctgtaatctgtagaagtattgaatttgaccgagacctgcagtagttagttccggccgatttggtcaaattctaattttcgtctcaaagtgctgctttgcggctggcacctggctagcgagcagtatggtcctttcttcaggttcaggttttgatttttttgaaattttccccaacttgaaaatgcaaaggtttctggactttaaaagcggtatgattgtcatttgtcaacgtttgaattctctagagacctctttcgttagcggctgcggcaggtggtttaaacagagtttttgagtttcacatgcctttttaagttgctattgtttcgtatcctgaaacacttggtgagttctagctgtttcggaaattaggcaccaaaatctgctgttaggtccagtgaagattcgcctttttttatcgattgtgtgccggcttttcttctctgtgtccagttccaaattgatagcatatccaaatctcaactttgcaacgcacttttcagagagaaaaattctccggttgaccaaataggcttcgaattagtaatgttcagtccaaagttcaaatccttgccctattggtgttgctcatctccaaccaaacaagaggttttaatttacagcccacaggtataatacataggtaaccaagttgggtttcattgtttcacacgtcttctacctggtcaatgcaaagaactgttctttctcctggtttcaaaactctccaagtacgccacctaggcttattaagtatgtgacattatactttaaccattaatattatttataatatatatataaacgactacaaaattagtatcatataaaaatattttaaatacgaacataatggtgctgacattaaacacatgtattttttttactttaattattaaccaaaattcctgatatcttatattttagaatgtacagacactcataacgcacgcacactcacttctatgaacataacacacgcacgcacataaaccctatctctataagcatcttctcaacgtcgttactaccgaggctcttctaaactaggctacatgtactttcgctctaaactttaattttattctcgtttaatttcgtggcctttgcatgcatggagagctaggattgggaagctggcaacaaggagaatcagtatgcagcttcaatctgacgatttctctggacgtgtcatgtttaacaacggaagcaaaagcaaacgcttgctgatgacgtgccacgcgttgtgtggctttcagagcgtttaaagacggtttttctctgtgctctgaatatacgtacatgtgtagtacgagagatcggaggagaaagcgaaaacgacggcagctagttgtagcagtagccagtagcaagcgtacgtacgcgaaagcgaaatgacaactaaattaacctcgaatccgtgctgctcaagatgcccggagagcttcaacgcttttcgttttttttcttttgtttaattttatcacgcttaagaagataactgaaactaaaacgtgtttgcctcttcataaacatatatcatcgattaatctgcttttccgagttgtttcacgcgacgacttacgcacttacatgagagtgcaaaacttatcaaataaataaactaatatatatttttattttctgtaaagttgcactctttttgtttcctctgttgcttataagccgtgcaaaaataacgaagtaactaaaaatagcctatgcgtgaaacctttatctatgcgcatttagcaatttaaaagctaatataaaaaaaccacaataaaaacccttaaaaataagtttcaaatttaaattttggctatggcaaataagccaaaagataaacgatgtaagactttggcattgggatttctgaactcctgaaactgtacttatcgtctgtcctttctttctgaagctacacagaaattcagttcattgcggcccagatgtaaacacgtcccttttctcagtcactgtggcagcctagtcatcacgtgaagaacactatcgagctagttgcactgatcgtatctcaactcaattggtcgtgatcagataagattggcaccacacgatcaatcaattctgcgacggccaaattgcagccaagccgttgattggtttaatttcagatgttagcgtgtcaccggcctcttcgccattgatggcagcaagaacgcaagaacctggagatcgaccggtctgacgacgacgaagacgacgcacacgcgcgtagtaatcctcaaggcaagcagaggatctagctaataagtttcttgcttaattaatccatggaggggcataagaaaaatgatcaaaaatgtcagcaacaatgataacaaaaagacgggtttagctcacataattaagagatgataatgacatggcataaacaacaaagggtcgggctaactcatgtcgaaaacgaaagtaaacgggaagcacgtgaaaagcaggaagacgatgcacaactaaaccttacaaaatttctttcagtaatcgcttagcattagtcaacagcaacataagaacattcttatcaatgtctgtccctatgttaattaatctgccgagtaaaccggatagtttcacactatggagactggagataatacttttttgcaggccgcgtagttgaaattaagagggcagggctagtccatcaacgagtgattgattgcatgacatcagtgtatattcagcgccgcggtcagagacttcagggttaaactaatggcgtttttgtttagcctgacgaaactatgtagtagtagaagctgaaacacgctttaaattgcacgaagtcaggatacgtacctactagttaacctgaactgcatatctgaagttctgaaacgtgctgacaatttgtgtatgatcgttcaatccattcacattgctaaaagtccgtggattagcactgtaaaggaaagttcatgcgttcgtccaggaattgaactcttttctgtcaaatgtcagcattccagatgaacatgaaaatctagcgtttttgaaagccctgcaacaaatggtgtgtttagttcctgaaaaaaaattggaagtttgaagaaagttgggagtttaaaaaaaagttggaagtttatgtgtgtaggaaagtttttgatgtgatatgatgtgatggaaaatttttgatgctttttggtttttgaaaaaaaacatcgacagcaattgggtcggagttttattctccgactcgcatcatctccgatcggtatttttttattttctccgatgggcttgcagaaaatccatatagatgcagaaactagcactgcaagtctgcaggagaaaaagttcatgcgtttccctatgaatatttgagcatgttttctgtcaaacgtcagcattccagatagatgagtctgaaaatctagcgtatatttctgaaatccctggaagaaaacatcgagggcaaagggggcagtttgttttttcaatttccgatagcctgaacacgttggtcagtattatcgggatcggagttttaatctccgaccctccttgagtcagtatttttccttttttggagccctcaaaaacaagacgaacagattgaaactccgaaccccttcggtcgatatttcctacgagacgagacaagacatgcaatccggcccattaatttgtgtccaaatcgtcattcataaacagtccatattacagccggcagaaaacgttacaaacacaagaacattcttatcagcgtccatatgttaatcaatccgtagaactcactcactcaggtatgctggacagtttcgcactacagatagacttttgcaggctgttgtgtcgaaattaagaggcggttctagacttctatacttagctgctgacgttagtcctccaacgagtggtatgagaaaattgacatcagtattccgtgggcagaaacttaaaggttaatctaagacgttctgttagcctgacgaaactgtaatagaagctgaaacacgcgctcttcaggaaaacctatcaatcaaaggacgtgactatcaaccgtgctgacatgctgtgtaactgtgtatgatcgctaactccgttcatattgctgaaacgtgtctaattgttttgagccttttggggtcaaagatgtgacgtaaccgtggagagttttgccgatgagcagtgtgctcaagaaacgcagcagcaatcttgtgtttatgtgttcctccaggagtattttatatttgctcagtttctgtaaaacgtcagcattttaaatgaacctggaaatcttgcgtatcttttgaaattcttgaaagagaacattgagggcggtggcagtttatctttcgaattttattgatagcctgaaaaattcgatctagtgtgttggagttcctgatagagggcaacgcggccgccggcaaaaaa

SEQ ID NO: 72357 - DNA, 48739 bp, Oryza sativa
  unsure (1)..(48739): unsure at all n locations
ctcaagaaaatgctaccaggagctactgaaccggtaaatcctcaaaattcattttcagaccatgtacagttgagtactgtcaatttcagactatgaacagtagctctaacacttgtgctacacaactgcaggtccagtatttggtttcaaggtggggaaccgacccgaattcgcttggttcttattcctgcgaccttgttgggaagccagctgacttgtatgaaagattctgtgctccggtgggcaacctgtttttcgctggggaggccgcctgcatcgatcactctgggtccgtgcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggtatgaattattcccacttttttgtaatttttttttctgaaattttatctggtaggagtacttggtagtggtgcgtcgtgaaaggtgggaatatttcccattgatcatagtatttttagaaatctatctattgtactttagaattaaattttccacatagggaaggtgatcatcacactttagattttacaagattattagaatttataattctagttgggtacaaattggttagttagttggtaacttgggtatctacagtattatgtagattagtgagcttgatgttcaacgtgatttctctctcttatgattcacatacctgacagtaaaaaacattttttgttcaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggtcagtctcaccctgaattgttagtgtgagaaattcactttagattctgttcatacaagcttacttactgttcattccaaaaattcaggctccacggcgtttgtaatgagaactccttggcaccattgattggctatcttgggctgaaattatatcgcactagtggcgacaactctgttctgtatgatcatgatttagaaaggtaatcttttagctcttgatcttacgcttttctttaccgatccgcacaatccttgttgattcttacatcaactctgtcaattgattctgttacagttatgcactctttgataaggctggccatcaggtctcaaaggagacagttgctaaagttgaagaaacatttgaaagaattcttgatgaggtacataatgaactcatttatacttggtacttctggtgccgtttgaagagcatgttcagttcactatctaatttctgttgcattaatgttccaaaaaaaattttctgttgcattgcagacagttaaagtgcgtgatgagcaggaacatgacatgccccttctacaggcgatttcacttgttcttgagaggcacccccatctgaagtatgcacattcttgtaccatgctatcaatttactcacaacatacttaataaattcgtaggatgcatcatgagaggttgactgatatggttaccattatttgtaggttacaagggatagatgatcaagtcttgcaatggtgtgtctgtcggcttgaggcatggtttgctgcagatgctgatgaaatatctctgaaaaactgggatcaggttagctgaaatcagtctatattagcacactgcacattcttatagtgacattagtttgcttagtgaaggatattggtaaattacatcgaattgtttgccatcttgcatagttagttacttatgtttgtattcctcttaactatgcaggagcatgttcttaccggtggccatggtctgatggtgaacggatactatcctataattcaggctcttgcacaaggtctagatatccggcttaatcaaaggtgtgttcttttacctcccgagcatacaaacacaacaattaatttcagcatactgaagtccctttttcagtgtattttggctccacaaaattacttgtcgtttcacttgtcaatattgctaaacagttttgcttactcgcttttgctactgctaaatcttcagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctgtgagtttgccatctcagatcatggccacagttagttccattttcgagttcgcattatctgaatgaattcgttgttcttgcgactgacaatttgcacttgttgatttgtgttattgcagacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatgtatttactccatcgtcacttaaagatttgggagggagaccggttgagctgacatgtccacgatggcagaatctcccaagattccacgtggaaccctaaccttccctttccaaaaagaaaacgagagcccttttcctattgacgcacgtgagcgcaccgcttaagccacgctacccacgctacgcctctctatacctaacgctttccccgaactccaagagatcaaaaaaaaaaaatctcaaacggcaaagtcaaaaaaatactactactccgacacgaaaaacaaacagaaaatcgggggaaaaaaatctctgtccattcgttcgcttctcccatggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgagacgccctcgcctcccggggccccttctccgagcaggtgaaacgccgcctccgtttctctcttcctctctcttggccttcgcccttcgaggtctcacaatgatggtgatggggatggatgataatgaacaagagagcatgcgtttttcagattccaatttcttgctgtcaattgcttttgttaagttgatggatcccctgcatcgagtacggaaaaggctttaagtactaaattgttcttactaaagtcttattatgctataagtaaatctagatttcctctaacccccatctagttaaatcaagcggttaagatcattgtttgtaagagttatgtaagatttttttgtagtacgtgtggttataacaacgaacaggaaaagaatgatccttagggtgcctaaagagatggcttgatgtgagaatagtaatgtattacttctatgtttttcattgttctgtgtctgatccgatttcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggtgagctagttatttgacctgactgtaagtatgcaaaacacatacttgcaacttctcagtatacaattatgatttgccttcaaatttgcattttcatatttaagaggtgaaatcatatacatagcatgcaatttgatacacataatgtgtaacttgattgctgaggtagtattaatctttggcagttcaacattaagacgctgtgcctttataatcagcttgatctggttactagcagcattttggcgactagacaaatcaatttgttaacctttgcataagttggtagctatgcattagtttacttaggtgtgccataattccataaacggatcagttaagatgctatttttgtgcctatattgcatatatcgttgaggccaacaatcatcaactacttgttaaatcttatccactggaactattttgtgctttggtaggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttggtatgttctagcttgtgttatttttatttattgaattcctcacttgtaatttgctagtaaaagactaaggctttgtttgtttgggcattcggcagttgcaaattccttgttttccgttagcatgcttcccaaactgataaacaatgtgtttcttttttaaaaaaaaactttttatatagaaatttctttaaaaaacaaataaactcattttttaattttatttatactcaatttatcatgcactaatggcttgtcttattttatgtgcaaatgaaaagctgaataagggaaagtttacatttagtttactttggcatcgtgccgtcctctctaagctgtcatttttgcagtgtgagccagtggaggacttctacagagcacgtggtaaactattggagttcaatctaccaggaggaattccagaatcatggccgaagttactgcaagcattgaatttagaccctggcaatgaaagatctgcagcagcatgatttttgctttaggaatgttcgttatgtatttgtagccctacgccagaagtagttaagtaatgagtattccttgtacctctagaagtagttcaatcgggttaccaaaattatattgatatagcactcaattgtataggtgattcatcatcgatcttgcatgatgccatgatcgatgagtgtgctggttgttattcttaaatgagaaagcttccaataaaccaatacacatttatttgtagccaactatgcttgttgaaagcaacacaaggcaagccttgtgatgacagtaatattttccttgcaactatgcctgtttgaaagcaatacagagcaaccattgtaatgaaattctggtgctattgacacattgagagtgtttgcacatggttctgaaatttcccttgccccaggttgggtcttatctgaatatgcaagtagcctgctgaatactacctccgtcccataataagtcccataataagtgtagccatgagtttctgtgcccaactttaatcgttcgttttatttgaaatttttttataattagtatttttgttgttatgagatgataaaacatgaatagtgctttactcgtgacttatgtttttaatttttttaaaaaaaaatttcaaataagacgaacggtcaaagttggacgcggaaagccatggctgcacttattttgggacggaggaagtacagcagaggtcacagactcagttcaagtagcaaatctgtcttttcgaatgcaatctcctcacggtaagaaatgtgtctacccttttagcaggaaccaaatagtatctggattagaagaaggtatcacggttaaaggcgttaggaattgttatactacagcattggtagcaactcaccgtcacaacgggggtgtagctcatatggtagagcgctcgcttcgcatgcgagaggcacggtgttcgattccccgcacctccaatcttttgatctttttttgatttccattttatcataacttaaaacctgttttttgtttttcattccaccacagcttcatcactcagaacttccatttcatcaaaactaaaaatctgttttttgttcttttttttcattccaccacagtttcatcacttagaactttattttcttgtgatgaaatgaaatgaaaaacaaagaacttcgtatttaggtagtacaaaattggaataggccgtagaaggtgcctatgattctgggctctggctgtccgctgatccgctggccgtagaagtcaagcccatctcacagtctgcagatcgcttctttttacaacccaacgggccattttcagaggcgtcacccgtaaatccttgggccaatgtgacccaatcaatttcgtgaaaagtactccgtagcaaacaacgcgcgcgcgttccctgcaaaaaacgccggaaaacgcattgccgagcgagccgtttcagcaaataagggatcgttagactttatcagtgactgtatgaaacttttatatatgtgtgtgttcttacgacttaaaagataatgctgaaaaatttatttcaaaatttaaattttggttttgacttattatatatttttggggcaaccgatggggctatgaggctatgagctatccatccatccatagcgcaacgtgtgacagcgtgaggtgacaagatggaaaaccgtgagccgcgccaccggtgtaaaccccctcccttcacgcgcgtttactttgcaagcaaaggacaaggaaaaaagccgtaattggcgaagaatgttcttggatttgattagcagcggtacggtaacacctctagcttgcatttgcatggtagggtgatttggctaggagagcaggatcatccgtgcattcaattttcctcatttctttttgcaggctcaatagaggagaggaggggcctagctagcaccaagataatgcagcaaaaaggagagaagagaacatgtcatccagtccaaagtgcaaacgtctctatacaaatggaacatatggagtggacctaagcctagttgcttctgtgtcccaagctcccaagtgtcaaagccttaatgtgcaaaaccacatctgtggggactcctgaaagcaaactaaatgattgcaaaagagttcgtttattcacctatttatttatttattttattttctttccatgtgtctgttgtttgatactttgattgatcatgtgctaaactgcagaaaaaaccaacaggcccagagtaccggcgaaaaggctcctcgatgaaaagtgcagggattctgggggagttgccagtgcgcccccgttggatttttgcacacatataaacaggggactctgctgcacctctcacacagtaacatatatagggacggttccaccaagcacgtttgggaaatggttttttgagcaacatctcatgcgaacaatttaggcactatttacttgtaccttcaccttgtacgtgtgctccatcccatagctgcattatttgcatcaatcattttaattgcatatatacatactccctctcgtatttattttttttaataaatgacatctttcactttttatcacacgtcttttaataagacgaaatatcaaacgtatgataaaaaaaatcaataacgccatctattaaaagacagattgagtatatgcgagacatttaattatttgccacctctcaacaatttaacactcgtgtgacataggagtagacgcatagggtaacaaattgctaaacgtcaagtaatctatgagtagcaactagcaaatacttaaatatctcctaatatgttagcattgcaccaaagtctataactatattgagctttgtcctgtccatggtaaagtgtggggttaaagtgttaaaaagctattggtagcagtatctagtatggcgtggcaggccggtgcagataaaaggggccccgggttttgcccggaaatgaggagaggacgccccggcagctagcggacgctttgcatttgcatgcatggtgctctctacttctccctccgttcccacggcaaattgcaaaacgcatgctagtatttggcaccattagcctaaggtagtagtatcagcgtgttacagaaagaaaatagttaagtagcagtaattaattaaagcctgtgattaaggtaaagcagcagtgcagttacaaaccgaaacaaacaagagtcagcgaactgaaaagaagaccgggaagaagaagaagaaaaaaaaagacccgaacagagttttgatgagcagtgtcaggtctgtcacatgagaagagagcgaagtagctaagctcagcccccactcgctcacatggaacgcctctgctcgcctcgactacttaaccagctaaacgctcggttgattaggagaggaaaaaaaacgagggaaaaaacgggtggaaacacacgcaaaaacacaacgccgtgcggccttgtaaatacggacgacgccgacgcgcatcgctccccgaacaccaaacgcctcagcttgccttggctctcgccagtcgctacgcccgcgacgacacgaccgcgccgcgcgcgcgcgagcgagcgagcatgtcgggctcctctgccgacccctcgccatccgcctcgaccgcgggggcggcggtctcgccgctcgcgctgctccgcgcgcacggccacggccacgggcacctgactgctacgccgccgtcgggggcgacggggccggcgccgccgccgccgtcgccggcgtcggggtcggcgccgcgggactaccgcaaggggaactggacgctgcacgagacgctcatcctcatcaccgccaatcgtctggacgacgaccgccgcgccggcgttgggggcgcggcggctggtggcggcggcgccgggtcgccgccgacgccgaggtcggcggagcagcggtggaagtgggtggagaactactgctggaagaacggctgcctccgcagccagaaccagtgcaatgacaagtgggacaacctcctccgcgactacaagaaggtccgcgactacgagtcccgcgtcgccgccgccgccgccaccggcggcgcggccgccgccaactccgcccccctcccgtcgtactggacgatggagcggcacgagcgcaaggactgcaacctccccaccaacctggcgccggaggtctacgacgcgctctccgaggtgctctcccgccgcgcggcgcgacgcggcggcgccacgatcgcgcccaccccgccgccaccaccgctcgcgctgccgctgccgccgccgccgccgccctcgccgccgaagcctctcgtcgcgcagcagcagcaccaccatcacggccatcaccaccacccacctcctcctcagccgccgccgtcgtcgctgcagctccctccggcggtcgtggctccgccgccggcgtccgtttccggtaatggtcggtgcgcgcaccgtacacttaatactcatagtagctgttacatcccctcccctccaaaccatttactactgttctctcacactgatatgtgggcccacctcgcagcgagctgagctccgccactatacgttattaaaagcccgcgttatgattgggctagttacgttgttgagttgagctggtcgtaattatttactaccgctacattttttttacctttttaccgtggggttcgggagagggtggtcgcggtaataataatgtcctcaactcaggggttgggagaataaagctgcgtgcagtgtggtgcagttcatgcatgggaaaggtgatgcgaatccggatattttatgggggtttaattgaaagatttactccacgacgatactaccctctactcctgccatgctgcaagcatgcgtaatgcgttacattgcgaaatcactcgctttgaatgaaaaaaaagcctgaaactttggagaaaaaaaaagcaccttttgttttctcctcgtgcatgcatgccgcgctgcgtatcttgaactactttggacttttgtatcgatcaacaaaactatacctatattagcagtaattaatactacatttgtagatatcctttgaccgttctatcttatttttgataattaaaaaaattagttacatttaaaaatgctatttatattttattatctaataacaataagtgtattagttaaatattaaacgttggatatgaatagtttaaaacgttggatatgaatagtttaaaactgtattgttttggggcggagtgagtaattgattgatcgattaattaagtggttgactaatgtgtgtgtgatttatttgtgtagcggaggaggagatgtcggggtcgtcggagtcgggggaggaggaggaggggtcgggcggggagccggaggcgaagcggcggcggctgagccggctggggtcgagcgtggtgaggagcgcgacggtggtggcgaggacgctggtggcgtgcgaggagaagcgggagcgccggcaccgggagctgctgcagctggaggagcggcggctgcgcctcgaggaggagcgcaccgaggtccgccgccagggcttcgccggcctcatcgccgccgtcaacagcctctcctccgccatccacgccctcgtctccgaccaccgcagcggcgactcctccggccgatgatcgccattgcaatcatatgcaatgcagcaaggacgatcgatgtaaataacccatggagatgcatggatcgaggcatcggattattgtttggaatggctgcaagaagaggagtagctatatatttttttttttgagtgtgcatcgccatcgcgtcgtctgcgagtattgggagtacggtgcattgcatgcacaacgcctccgtttcttgatttctttctttctctcctgtgtcctgtgatttttttgttgtttattcttttcgtgcaattagtggagagactggcaggtgtgtggtgtgaatgatcgaaatggttagtgtggctgctgctgctggtgctgttgctgttgctgcgttttttcttctcgggtgttgggtttgtcgtggacggcgatcattagcggcacagtggatgagagagctgagctctagctgcaggtcgcttggtctcgctgcgctgtcatgtgatcactactgcgcatgggggccacggttaccgctatagctgctgcaactgcgtgcgagaacgagctcgtgctgagctatacaagctttgctgctacttctgcttgcttttgtgctatggtggtgttggccgaatcagatcagagtttgtgctaccactttacattcgagattccgcttttgcccccgtggtgtacttgcaatatactccgttcataattaaactaattaacattgaattgaattgtacataacctaatataataaattaaatctgatcatgcatatccaaatttattgtattagattgtgtcacattcaatcttaggttgatttattatgagagtacaaaaatatactccctccgtcctatttttaagtgtaattatgagattttgtgtctaacattagaccgtctgtcttatataaaaaatatgattttttttttaaaaaaagtcacgcataaagtatgttttatctataataaaaataaaagtattaatcaaaaaaaaattaaataagatagatggttaaacttcgttggacaaagaaacacactactgcttttttttttttgacaaaaggagtactagtacagtactacgttcgtgtggtgtaataattgttgagcacaagatagcatgagatcgagcacagcggagtacgtactcatgcaaatcacctgatacgacgacgcccgtccatgtccatcgagtacatggaattgacgtgcattgtaccgatccatgcatgcactggctacactcttctgtcaattaattaatggtatcactagtacggtactctagctagcacaatgttgtgatttgcagatggtaatctgagcaaatgacaattaattgtagggacgtgtgtctctctgcattgccgggtaagccaagtacgctgctcccatttcaagtccggattaatgcaacgcacgcatgcacgcacgcacgcacgcggccaagtgatcaagaccgcgattaccccacagtcccacacgtatctacgctcgccgacacacgcgctaaaccctcactcacctcacctgcttttgctcgcgtgcatgcatgtgtctcgtctcacagcattgaactcctggtcactgcaaacttaactgtggtttaagaaaaaaaaaagtgataagttccatcccttgagggatacaaccttactgtttactatatgttatctaaatagttattaaaaaattaaaaaataataatatagattaatacaaaatatatcacatgcaaaaccaaatttaatttctataagctgcaataaaaagaacaaactaaactgaaaatagttaccgtacattcacgtctacattggttatttttttttacaatttataggagttgaattttaatttgcatatttgtaaagtgatacatttcatattaatctatcttgctaaattttttaattttttttaactatttatatgatatgcacaaaatggaaggatacttcctcgagcggataagttgttctccacatgcataggtcggcggccggatcgaacagccgagctgagcagcagcgaacacacaaccacctctctagtatagctagccctgcatgcacgacacatatattactactagctcgttagtttagagacgatatcgtagacagattaatcatgtggtagtacgtagtacgtgctgattctccaggttaacaaccagctagctctcgtagatgctttgcttacgttacagacagtagtacgtagctcctcgatccctagctagcctgcatgattcctcacgatttgtttcttcttgtgaaaagaatttaattacttatacgaagtacgtagcttgtgttccaccgagaaattaacgcgagaaggaactagtaggggagagattctcttctctggtcgattccactagctactctgctgtgctgcctgtgtggtgggtagcgtagctttgccaaaagctcgcgatcgatggatcatcgcatgggacgcgcgcggtcaaaaaaggctcaaaacgcacacacgattctgcgattctgcgcgggcggcgtggtggtgaggagaaggccgtcgcgcgaggtaggcggccggcgaatcgcggggttggtgcgacggctgcgctttgctgggggatcaaccggcaccgccctgtgctgtactacctgggctattatgctaatctattctagcgagagagggaaggtagagactagagagagagagagagtgggtgtgggtggaccgctgtcttgtcgctttgctcccatcatctcacctcacctcacctcaccgtccccaaaggcagcgcagataggggcatttcggtcttttcattttgggcataaaaacaacctctaattttccattgtcttgcctggttattcaacggcgagaaaccaagttagggagaactgtaaaagaaagtctcagttataaaaagagttaacttctgataataaatctgaccaatatttatcttaattagattcattgttaaaaattagttttttgggacgtaaggtgtacttgtactccttggagatagatttgttttctttctcacatgatgttccctgtttcatgtatgttgtgtaaaaagttaaatttttcaaagaattgaataatacagatcaaaagatagcacatgatatgccactacacaaacatataaattaaaattcaacctataaatttagaaaaagaacccataaactatttattatatattcgtagtcaaatttattaatatttttgcttagcttgtattagttgaatctaatcttataaatatgtttgtgaagtggtatattatatgttgatttatcttattaattttttaactttttaagatgatatattacgacaacacaagttatggtaatctacatcgttcatcaacgctaagcaagcaaacagatcaggttaagatatcaggggtaaagtaaggtgctctcaataaaacatatacatctcagcaatagactagattaataataaaccatctcaatagtatgtctatatgggtatttatacctctttaatccattgcctcgtttttctctatagactatctccaggttagtagatagttttgctttctctcttcatttaatcttttccatataggaaaatatgctgacatggatcttttatatatagtctataagagcacccgcaatgttaaagtaaggtactatttataaaacatatacatctcagcaatagattagattaatagtataccacctcaatagtatatctacacatgagtatctatagctttctaatctattgcctcgtttttctctatagactatctctaggttagtagatagctttgctctctctctcttcatttaatctctttcaagtaagaaaatatgctgatatggatctcttatagagagcctatagataaccattgtgggtgccctaaataactattacggttgacctcatatactgagatggcggcacagcgtataggatagtactcgtacgtttggtggcgatcaggctttaattgattttggtggcgatggcgatgattttggtgtgggagagtgagaggagaggagagtggacaggacactggacactggacacaggcggtggtggtgaggttggcttggagtgctagtactacacgtactactactactactgggagtatatggattcctctccccgctttgtggtgtcagaaaaggccctgacaatctcccctagctgtcatccccgctcagagccgtagtcaaacccccttgaccggacagagtagataccatgccactcaactcactcatatccccgaaatgcccctcccttccaatcacaaaggtatacgtaaccctagttaaggacctgtttcgagaagtttaaaattatgagaaacagaaattaaatggtactctcctcgtttcacaatgtaaattaatttactatttctcacattcatatcgatattaatgaaactaaacatatatatttatctagattcattaacatcaatattaatatagaaaatggtataataacttacgttatgaaatggaggaaatagttagctttaaagaatttaaaaatatttaggtttctcggattctaactcctactttattttctggttctataactatatatatttttagaatctgaattataaactgaagcttcccgaatagggccgagtttagttttaaactttttattcaaactttcaacttttccatcacatcaaaattttcctacacataaacttttaactttttcgtcatatcgttccaatttcaaccaaactttcaattttagcgtgaactaaacacaccctagcatcacgtttagttccaaaatttttcttcaaacttccaacttttccatcacatcaaggtcctgttcactttggtaaagttgccaaaattttggtaatttgctaaaattttagcagaatttcttatatagttaccaaaatttgatagcaaactaaatgtagcaacttttttggtaactttactaaaatttggtaagattgtaaatggcatcaaagtgaacaggtcccaaaacttttctacacacaaacttctaatttttctattacatcgttccaatttcaaccaaatttttagttttgatgtgaattaaacacagtataggtcttaaagctaattccacatgtctctagctagaagtagccactactagtacgagttcaactttgctcctttcaattcacctcaccgatcatatcgatcacccttataattcaccgcccatgcaatgcatagccgcctacgagtagtttttttgacgttacgcttcgttgtcatcttgctgctacagtacagacagggcagtgtgctactaccccctaatctctattgtactacacaatgcattatgcatgtctctaattaagctcaaaaaatcgtaaaatttgtacttctactccttggactacaaatttctcaagagaaaatggtgtggcaacgctggagcaggggggcctacaggtgcgtacttgcaaagagcaaaagcattggagcattggatgctagtagctccactgaaatgggctctagagagagagagagccgcgctctgtaaaaaggcatgcagatgcagtgcgtgggcaggggatccggagctgagcgagctagcggtgcatgcaagctgtaaaaaaaaaaaaggcacagcctgcacgattctccacgcacacacgcacgcacgcacgcacgcacgcacaaggacccccgttcccgttccgtccaacaagtacggtgtacttatatttgccagaaaagagctttgtatgactcagaataaaaaccttaattcgtaagggaatgtttggtggtattttgcctgaattatgtgccacatatacagccccatcgttgggcttatatctggaataagccaaacaacatatttataaacgaaaaataatttataaataaaacttttatatatgtgtccttagtgatctaaaagcacagactgaaaaataaacttctataaaaaaactcaaaatcagctttaaatttaagattaaaaattcaaattttagctgataagtataagcgtaagcgaaaagatgagcccggtagaatggaatgatacatactgtttaactattcattaagaggaagtggaacacgtaccagcactagttgcaaaactgaactttcttcgagaaaaaaaatgtattggattattttcagttgaacacagtatgctctaattaagctagtactgaatttggctaactcaagtacgtatagcagtttttcaagctactaaacaaccccttaatgagccaattgtgagtcagctttaattgattttttttaaaaaagctagtacttcctgaaaaagaatatgaggtgcagctacaaacaacacactgtgaatgcatggttcgacggccagatcgacgagaaacgccgtacctatatagttaagacaacaataagctcatggatggacgtcagaggacgtggtgccattggaggagcgtaggccgggcccctacttacaacaatctgcctatacattcaggacataaattgagcttgtggccatttatttcaggcttttgggttggagccttgcacaaatagttgcattattatattggaggaaaagaaataaaacgaaagcatgaactgctggttatatccgagaaattagtacacacacagtgggttactgatgatcaggtgatttgtaaactagttgaagtgagctgcagaggcaagccgaactgataagtgatatacagtgttcttgcatctaaaaatattagtattttgtattattagtataagactttgactgataaattgctctacttatatactattcatgtgatgaaaagcataatcataaaaagtacttctgaatataaaactattaacaccaatttgatgtcgaaaaattatatgctaatggagtaattatcggtctaaatcatgtcttaacgtaacaaaatatgtcttaattttttgaacaaaaggagcccttaatcttgtgttattagtcgagagatcctggattgattgaccagaatatatagggtcctctagtacgacagtagcatagctagctagtcatacaagaatagaattacgatgctatcttaaacgaccacacacaggagtaattgaaatggagtttactggcagcgagacggtggtactggtacgtcgacggatgcgccggagatggcagcttgtataaatgcaatcccggcccatgggcaggggccaaaccgccaccaatcacccctcctctcctatccgggagggacacgggggccagtgaaaacgaagaagccaagccaaagccaacccacagctgcaataataacgcgtagccacagccactgccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttcccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaaaacttggttaaaagtttggaaaaaaaactttgaaactaaacagggtagtaatatataggttaggccactgggatgcatcatgggttaaaaaccttgaatgctgcgctggaacgagaattccgtggtagtactgaactttaattttagtcggtagattgtctgtgagagcatggaacatattgtgaattatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaattgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctaccttttactacattttcttaatcctacattaaaaaggtggtcttataattaaggaaattcatgaaaactgaactggttcctattaaattatttttttaaaaaaattactttgataaaaagagctgtagcattcttaccttttgcgtccaactacagtctacagtcagtcccggagacatttaaccgacatccgatatataatgatggttcacgtccagacaaagtcaacagtcaacatggcatgcaaagcaactgttcacgctcctcgatcagacaagataaaactgtgcccgtacggacatggctggtatggcagtagctctgatcaccaagagtactccctcggcacaattaactggagcctgcctgaacgaaacagaactcaagagtaccaaccaaaaccatcacacccttgtcttttcccaaaaagtaagatgcaggtaagcgcaaggattaccacgggcaccatggttattagtggactttctcttccagcatttgacaaagatccaaaggtaagaagaacaagattttatcagcatctgttcaggtataataatattatatgcattaaaagagaactggagtaaacctactcaagagttctataaacatactaggaaccactacaaaaggaatatgggcatttccacaccaaagaaaccagattcgtcatttggctccaagcaccaggagggaaaaagaaaaataagagaagcaattatgaaccctcacagaaaatcactcgataatcttgacttggagccaataaagaaataacatgagttgataaaataggcttttagtcccacaaaaggttgatcatcgagttggccaacccggcttctttgaaagttttatcactctcgtactccaggtttgtggatgccctaggaatgggctgtacgaaatggaaagccttcttatccccgtcctccacttgaggatagcagaatgaccacaggagctgcggcgagatggataaagcatcagcgaacaatgtaggagaagagacaaaactatggaaatttatttcagtgttctaaccttaataggatccgtgtgaaggaaattcctctggatcctcctaccatcaggtaggcgaattgcaactctgcacaaaagctcccgacttcctttgggttcttcagggagaggaggatagttcagcttagcactcaggctaggctcattttctacctcaggttcaatcttttcctcactagtgtcagagcctttactctcctcaagagaagccgctactgcccgtgctagttcttcgtcttcatcctctgtggctactacgggtacaggggttttacctacaaagaaatggaactgtgaacatgtgcttttggtcaaccttgaaatgcattgcacgtaaccagatcctaacataataataaaaaaaaacacacacacacacacacaatcaatgctgcgaaattaatccatcaaaatatccccttaagtagtggcatccatatgaccataccggtaatattgaaaattacaaattttctttgtgcatgtcatgccatgcatggagagcttacgctaacttttgttatgcctacccctcttgcaaataaatctgggtagttgcttatcacaagtcaaatttgaaataaccttaacttacaatcgacacacaaagaccatcgttgtcagagggtggcaaaaccagttgtgacttttgcctaaagataactgtgattagacatgatttaaattctaattcctaactacacaacaaataaattgttgttgacatatagactactgaaatattttttttccttgcgtctggtctatgttatgcattatcattgttcaagatgagtgttaatggaaagtgatatgtcagcgatgattcatatccaagtttgaaacatggctaagacaagtactgccagaaaccatacatttccaatgattttcctattataaaaaatgtccattgagtctcgtgtccatactatccaattattgtgttatctgggccattaagaatccttaatatctagaagtacctgccaaaaacaagttgaaataaaccactaaaacttattgccagctatcaccaacaggataaaatctggtgacagatgatgtatgaggatagaatgactcgtaaggccaatcctccgactcccataaaggtcagtgattatgccaggcacatccaccagataatcatcgttatatcataattcataacaagagtaaatttcacaaaactacaggtattttgaccaaattatcacaactacagatttaaggagttgtatcacaaaactacatatttagcaccaaatttatcacaaaactacagattttagattaagtatcataaaaatgcatatttaatattgaacttatcacaaaactacaacttttggagtttaaatccctagcaccattgttatggtggagctataaacatcattactttgtgatttaattgattctaaacctatagttttgtgataatttagttactaaatatgtagttttgtgacacttcatcttaaatgtgtagttttgtgataaatttggtgttaaatatgtagttttgtgatacaccgagttaaatctgtagtttggtgataatttggtcatagtatctgtagttttgtgaaatttactctcataacaattacaagcaacctcccaatgaccaactgctcctggaaatcacgcttatgtagtgtaagaacgacctaactgtagttggatgatacaaatgaacaccgctcccccttatccaattttgtaaagcatcaaatgctagtacagctagcctacccccaacttgattgggaacaaaggctgatgctgttatactaagtactagaaaacaaaacacaatgcacctagaggcaccctcacatgacaatcatccctgctactttttcaagaattggacatccactcacaaggtttgaaagttttgattgtatggaagccccatatctttaacagatgaagtttcgattgtcacgaacttagcattaactatgcatctattccacaaaaaagttatttcaccgtgttaaaagataaatccatataatgtgaagaaagattgcaacgaaaaaagataggctcaacatatggttatttatgtactaatgtgcttggttcatataatagttctgcagaaacaaactattcgagcttaaatgtttcaaagggaaaaaaaaacatcactgctagttaacatatctttggacacaagccataccttgtttgccgatagaagtttcctgatcaacttttcttggccgtttttgaggttgagctgcatggtgctcctttggacctttgtccaggtaaggcatcaaatcctgtggacagttcacatgcagacagtaacaaggaataccatgtcaaatcacagttaagattccagtattagaatgtggaagtaagaatgttatcactacagaagttagtaacatgagagatgaaagatagtaggtcgatagggttaccaaattacctccagcaaacggtccgggtgaatcattccattccacccacgcattttttgcccagtgatagggtcaatcagaagaatggcaggaacagagaccaaattgtagtaggtgcataccttcctcccctcactggtgtcatggtaaacctatatttaagatgatagaacatatcagtagacaactagagatgctaaaaatttgatccatcttggggtttgggaaaaaaagtgaacattagaaactctttctttccaatactattcctaatacatcaggaataaaaattggagatacagttatgtggctcaggtatagaaggcgaaacaaaggagtaaggaccaacctgccagaaaataaagttcgatcgaattgtctgagccacagcctcattagcccaagtgtcccgattaagcttcatgaaagaaacactcaagagtaaaaactttgccaatgcaggaaaaagaatgaagggttaacacaaggctgcatgacattaatggtaagatctgtaccatgtgagagctgaactcttcagtcgattgcaaattgatcaagagccacttgtccagaacagaagcctctaactttgcctacatttatgaaattcattgtttttagaaatctgaattaaattggtaggttatagaaaattaaaggataatcaaattagtattatgaagttcatcagctccaggctttcacatgaaaattagtagcagtttactagttctcgtgcactggtcattagacaacaaatgaatttgcaacaactaataaaaacatcaatgtactttcaatgataaatagtgtgaacaaagaacattaagaagcatgtttgaccatgcctcttgttgacaaaagggaggcaatgtttgcttgagtaataaactgaaccttagcagctaataaaccgaactaattatttgacaggtaggattgttagcagctgagataaatgaagagttcgtgggttacatggcgtgctgctccatgataacaattcagtatgtcactaatagaatattgcaattttcccaatgcataccaaatgcccacagacaaagcaggttattgaagtttgcaggcaaaggcagcacatggtcatgttagagataaaaaggtaacaccagacgttaaataagaaaaaaaggatagctgaccttgtcgaagggtccattgaacatcaaagcaaatggtggacgatacaatgccgccagattatcacgagaactagatgcagcattctgctcagaatcccaaacagcagattgccttgactcctcttcaaagttacgaaatgcaactgttgaattaggccgaacgctgaaaagaagtcataaaaccgtttcaaatttagaaaatgatagattttaaattagtagtccacgttccaggaaaatcatgcaaaaagtttggttctattagtgctatacttctctttggttactgtggctcaacttgagtttcatctctagcctattctaattttctttagagtaaaaggctgttgttttagaattttggttttagcaaagcaagacatagaagcctaacaaagcatgtcggcccaaaagaaaagagtacaacaaaatttgggccttattcatctccaaaagaaagagtagaacaaaaattgcatcacttcccacactttaggtcattaggtgtggctcagcgctattccttccagatttaacaaaagtggactataacaaagaaccatagtaataatgtcatatgtattcaagagatgttgcatctaccaaagaaatggctaaacatcagcaaaatcaaccccaattataataaatacttggcacagcgcatttaagtatatatatctaagtatacccccttaatttgcagtgccattggggcagtcccagatatgccatcggtatcatagagaataagggataaaataagagctgtgactgatatgttaatggtcattgtgttgtcctaatgggtagaaggataacaccccgaataaaaacattcctaactttatctttttcaggaggcaacaatctctcctgttttgaaaataattggcagcaaatgaaatgactagatgtttcttctgatcagtaaattctggttgagttcgagctagtgattgtcatcatatctgttggtgacaagtaaagatatctaacttgtagccatgaacgaaatttgttggtgaccaaccaaataccaataatctcattggttgcaaactatatgaaagagatgttagtccacttggcaggggaagagagggcaggaggcttgactgcaaattagtggtactagaaaatggtgctagctattaacatagccaaaggtgcaatttaggccaaaaggtttatatcccatcagcaagccaacaatgattaccaacaacacatgctaattccattggacgagaacaaaattactataggttagtgacatctattcatcaccaaccaaacacacacatgccttttatgaggacttaagcttcgatttgaagccatcaaaaacttaaagctcccctaaacagcatggccttaacattgtcggataagagtttttttagacaatcacatgccccatgtaacctatcccaatttctctttgaaccaaaccaatgattctaggcattactagtaccgattttgtgccaccgatacaccctatttggctatttacatgtatcagtacatcacataaaccacaatcaccacaggggcagcacagatattgcattgaactagaagttgtctcacacaaagtcttaacacttatactgaggaactcaatcccaggaacccaactatcataaagagtttgctaaccaagcactagacttacacgaccatgggggcatcgccgtagagagtctcccgctttgtgggcagcggtgcccgcacatcctcttcctccccaagtccctgcagcattccatcacccagtgcagcagctgggggcggagcgaacctgcccatcacagcacacggtaagcgtacacaaaccaacagaaaactcaaggacccaaaaaccaaagcccaaacccgagaaatctcgcgccgatccacctatgacctacctcatcgcgtcctccacctcagcagctgctgccaccgccgccgccgccgcttccgccgcagcagccggcgatggggccggatgcgccgcaagggcggcctcgccgtcgatgtagaacagctgcaacgcctcctccagatgccagctcgtcatctgggagagacgggatcgcatcaaacccttcgaatcgatcagaagctagactctagaggggggaggaacgagacgacggacctggaggaactgggtggccgtctcgggcgtctggccggcggcgatctcgaggaaggaggtgacgagggactccttctccgcctccgtcgggggagcgccggccatggcggcgaagtcggggatgggaccctctcgcgcgcggcggttagtagggtttggtgggacggcgaggagtgttggtgaggtgggggagaggggaagtggaaacgtgcggggtgagtaagacgagacgagtgcgaatgtgcgatgcgatgcgatggggaagtataggattggagatggtataagtgttggggggagtacggcttggaagggaagaaagggcccatcccgagcccagaaatgctcatgccgtgggcctcgtgattcgatcagttcgtggaccatgccacgtagtatatgggcctaggaagtataaaatgggtcgtttgtccagttggtcagattccagtaaacagtacaactgaggtccctcagcgaattacaaaattgtcaacttacagaaccgaattattcttggtctttaggtgatattgaccctggttttgttcaacaaagcagctgagtcagcacaggacccacgtaggctccgcatgtcatggtgaccaagtcattaccctgtcctcttctcctcgtctgagcaggccggcagatcgaggaggagggggaggagaccagcggggtgaggtaggaaagaagttgagccggagcatggcggtggacatgaatgcaaggtgggcgtcgttagagaaagtggcagaccagccgccgcagccactcttgtccacaggcggcttcacgatggagaggactaggaggatggctgcggaggtgagaagcgggagcagcagaagggagtaggcgacgtcgatgacgacttctatttctctcgtgcccttctcactgctgcaatgtcaagataatagacgtactattagccagatcgacgtagtagtattgtcttgccacgctaacccaaataacgttgttaaaatgtttagatcttatatataaataaattttttttttttttttttttaaaggggagaaaaaaaaatttgaaagaacccaccaaaaaaaaaaggggggggggttgtttaaaaaaaaaaaaaaaagggggaacttaaaaacccatacaananaatttgcaatctccggtgttgagcacgcgtgcagcgcatgggacacggtggcgctggcttaagcggtttccggcgagagagaagacgaggatttttttttgttttttcgcggcaaatggaccacggacacagtgaaaagcccggcccagttaagtatactagtttcaggcccacgaacgcatcgcacaagcagcagtgcggccatggcggctcctcctcctcctcccatccgaagcaagcagagcgagatctggaaggcggccatggcgcgcctcgcgctcctcgccgtccccgtcgcgctcctcctctccctctccttcctcctcctgcgccccgcctccccgccgctccccttctcgcggcagcaagcggcgtccggccccgaccgccgccgcctcctcagggtctacgttgcggagctcccccgcgcgctcaaccacggcctcctcgacctctactggtcgctccccgccgccgactcccgcatcccggcctcctccgaccccgaccacccgccgccgcggcctccgcgcgcgcactcgccgtacccggatagcccactgattaagcagtacagcgccgagtactggctcctcgcctccctccagccgggctcgtcgtccgcgcccgccgtcagggtggtcgcggactggagggacgcggatgtggtgttcgtccccttcttcgcgacgctgtccgcggagatggagctcgggtggggcgccaagggcgcgttccgcaggaaggaggggaacgaggactaccgccgccagcgggaggtcgtcgaccgcgtcaccgcccacccagcgtggcggcgctccggtggccgtgaccacgtcttcgtcttgacaggtactgtgattcagttggaaattggaaatgtgctttttattttttcctgagtgaacttaagtgatcaaaatggcataatggaacgggctgttgatcatattaaccctccattgctcccaattggtgtgggttatatgttaagcattcgataggttaagttatgcttgttgtccgtctattatatactcaatcccaactctcaactagtatatgattggaaactagttttttctcctccatactcaatcccactttctgactgatatctacagggtttagctactcaactctaaaaactgtgagctgatttaggcttgaaatcattttgtgtgttctgttagttaccggctatacatgtgatttgttgctcggcgcctcagtgtaagacttaccaagttcccttttccaaacagagggagtgtgcccagaacagtgagcacattgacatgtagatttaaccatgataggaacctcacaatgcactcataaatttgaaattagttatgtgcatacttggaataggggggtcaaggtagctggttttggtttcttaggcacgctttacatgttttcttgtgtaagggagtggcatacccttgaaatgccatcattaaagaaaaacaattttgaaccatgtgactttctgtacatttgtcatcaaggggatattggtaatcctcagtgtttcggagcaaaagacacaactgttttgcaagcaatgtaggaatacaagatatactgtttatgttttcgttgtaattgatctgcatagtagcttattattcttttgtatgctcaggttttgttaaatattgaggcattctttgacagaccctgtggcgatgtggcatgtccgtaaagagattgctcctgcaattcttttggtggttgattttggcggatggtacaaacttgattcaaactctgcaagcagcaatgtttctcatatgatacagcatacgcaagtgtcattgctcaaagatgtcattgtaccttacactcatttgctccctacaatgcacttatcagagaataaggaccgccccactcttctgtacttcaagggagccaaacacaggcatcgggttcgtaccatttatcatactaataagcatttaatgtatgcatggcaatatttatcttctttgtagtatctgaatctaagcaattggaaatgaaaatggaataaaagaacatgttagtatgatatgggctatcttaaaattttattttagaacctgttgagtctgaatccacagctctttgatattatttagagtaaagtccatcaccggtccctaaacttgtatcgttgtgtcatcccggtccctaaactcgcaaatcgaccgttcaggttctcaaacttgttcgactgtgtcatcccggtccctaaacttgtagatcactcgtataggtcctccaacttgttcagttgtgtcacctcagtccctaaacttggatttgaatatcatctgggtcaaataggacggtttaaagactttatatttaaaaataattcataactttttcatgtgaactctaatgaagacaaactttatatcaaacttgtagccctcgacgcgatctacaactttgtagttgatatttttttttattttaagtcattttttgtcccagaatgtaattttaattttaaaattacaaaatctataaacatgcaacaatattttgggaccctaaacagttttaattcaaaaaattttcaactacaaagttgtaggtcgcgtcgagcgctacaattttgatataaagtttgtctttattagagttcacatgaaaaagttatgaattattttttgatataaagtttttagaccgtcctgtttagagaccggcgtgacacaactgaacaagttggaggacctaaacgagtgatctgcaagtttagggaccgggatgatacagtcgaacaagtttaaggacctgaacggtcgatttgcgagtttagggaccgggatgacacagcggtacaagtttagggactggtgatggactttactctattatttatgtatctacaaggaaactattgccatttgaagcattatgctctcaacagaacttttatttacaaaccagctttgtttatgacttatgagattgttgttctgtactactgtgcatctctatacagctttatcttactataacttctgaaattttctttcagggtggtttggtacgggagaaactatgggacttgatggttaatgagcctgatgttgtcatggaagaaggttatcctaatgccacaggacgtgaacaatcaataaaagggatgcggacatcagagttttgcttgcacccagctggtgacaccccaacttcatgtcgtctctttgatgctgttgctagtctgtgcatacctgtcattgtcagcgatgagattgagctgccctttgaagggatgatagattacacagaattcgccatttttgtctcagtcaataattctatgagaccaaaatggctcacaaactacttaagaaatgtccccaggcagcagaaagatgaattccgaagaaacatggctcacgtccagcctatatttgagtatgatagtatttacccaggtaggatggcctctgctgcacaagatggtgctgtgaaccacatctggaaaaagattcaccagaagttgccgatgattcaagaagcggttacccgagagaagcgaaaacctgatggaacatcgatccctcttcggtgccattgtacatgactcgcgagacatgattgttagtattagcaatcaatcccccatgggaggagttagttagcattccctgccaatttatggattgtttgtagtgcaaatatgagagaaatttcaacagtaggtttatgctcttgttgtcaattgtatttcgtctggagtgattccccgcattgctccatgtgtgaggtttgttggttcactgccatgagaattcatatatgaatctgcccattcggcagacaattttccatattactcagagagaagcttgagacagtacgtagtcccttatatttgttgcttctaaatgatttggctagcgttcacccaaaatgcatgcatgatcatgagcaaaataccttttgattcaacagaaagagatccaatctatgatgtttggcagtaccaaattcaggacatgaaaagcaaaagggagaaattttatagtctcaacaacatgaactgtagccaaataacagataggctgccaacatggtggccaaaggaacggagatattgtcatccacaacatcattgacaggaatacactccactacagtagctgctaatgcaacaagagccagtttaccaagtgccagatcccagcagacagtgaagtaaccaaggcaagagaagtagaacagcatcctgtgatgcaaaagatccatgagttaacaataacaaggagtaacaatgcaaaagaaccagcaatgcattctgaagcaaaaacctacagtgcagatagaaggaagccagaaatgaacattgagatgcttcctatccagctcttgttctcattgaatggcagcttcgcggagccataccttctcccaacaatgtcagcaaagcctgaaaaaataagaaccaagaaggtggatatacttagcagaagcattcatttcatcaagtgaactggggtattacaaaaaaaaactgcagattttcctaaattcccaggagatccaacatcttaccatcaccaccactcatcatcgacaacgaaacaatcccaataggagactggcgccagaagaccaaaacactgaccagcagcacaatgacatagtacagaggacctctcagcaattccctgtaagcaaccaaagatcatgtcaaggaatactattttgatttttgaatgaaggagtatcagaaataaggatcatagcacgaactctggttttccttcacgggtcaccgattttactagagcttcatcagtggaaaggcggagcccgtaggtcagaagccttatgcagttcagcaacgggacaattgccgcgaagaaccgtgcttctgtcgaattactgcgaaaggggcatgattttcttaagatctctagtctgatttggttgtagaaaacatttcgatgctggaagaagcagtggcaagggagacctgaatagtggccaggaagacatgaacaggactccggagagcacatgcacaatttttctgctcaggttctgagattaattatgaaaagaatcagaagttaacaagatataattaagaaaggtataaattttatgcttgaataatctattttcctttgattgatcaataaagaaagacttctcttttatctatcctaactactgtattttttgaacagtagcagtccatctgaaccagtcagatcttcccagcaattgaaaataaattcaagatacagatcacatccactgaattgtatataccatattttactctccggataacagtcaacagagctaaagaattgatattttttgaagaatggcggagatcaaagcttcagctccacctcaaaaaaaaaagaaatacaaaaaaaaaggaaaaacgagatccgacacctgttcgatgagccgccgcgccgtgagcccgtcgaaggcgcgcaccagggagtacgcgcccgcggtgatgagcagcgtggcggcgcagtcccgcagcgccgcgggcgtcgccgaggccgcgagcgccgccacggccggggcggcggcggcgcccacgccgagcacaagccttcgccgcatggagctcgccgccgccgccgcaggagacgcgagcctggacttggagcgcgacagcagcaaggaggaggaggcggcgaccgaggaggagcacgggaagtggcggacgacgtcgacgggccgcgccgccgcggccattcggtagacggactgcagtgaagcgaaatcgctggtaggccaccgcgaatttttgtcggggcgcgcgcgggtttctcgttgagacggggcacttttgtagttttgtggaagcgattcgtcccacctatccacggtactgtgtactactgtatctttttccgaaaataggagggctcgtccaaccctcctagagtgtacgtaatatctttgttggaaataggattctcctgatatttatattttggaaactcatgctagcaggggtgtgtttagttcctgaaaaaaaataaaagttcaaagaaagttgagagtttagaaaaaaagtttgaagtttatatgtgtagaaaagtttttttttgatgtgatatgatgtgatggaaaattgggaataggaaggaaactaaacatggcagttttattccacaccatgaaacagagtaccaatgcaattagttgcgctgaaactatcgttcaaagcacaagcataacatgcactggatgatctctcgcgctttgctgcagaatatatacgttagatattgaagaaacgatgaaatgatttgaactgaaatattatgaaaatgattgaaggatgatggtttagcatgtatatatttagttttataatgaaataattgtaaatataattactatatgtttatatgttataagttttgcgtgtttaatgagtagaatctatatatatatatatatatatatatatatatatatatatatatatatatatatatatatatatatatatagatttattatatgaatgtggggaatgctagaaagtcttataaattgaaacagaggtagtatattttgatgttaagttttaggtgtttaataggtattagttttatagaaagaaggattattgggatgagccaaatacgagatggttctcctgatatttcaggacagggttctccatatggaggaagctgttcctgtcaactcagtcaaaagctacaatcccatttgtcagctgtaacgtttattaataatttagttcccaatttttttctctaaaaatattacatcgaatctttggacacatgcatcgggcgttaaatatagattaaaaaactaattgcacagtttacatggaaatcgtgagacgaatcttttgagcctaattagtccatgattagtcataaatgctacagtaaccaacatgtgctaatgacggattaattagacttaataaattcgtctcgcggtttccaagcgagttatgaaattagttttttcattcgtatccgaaaacccctttcaacgtcgatcaaacgttcgatgtgataccaatttttttttcgtaaactaaacacaccctaaaaaacaaacgatagagctgtaacaacacgtgatgctgtacttgggagaactcatatccaaagatagataataacttcagtaatagtaacagtaactgtttaggactttatacatcttgcgaaaaaaaaagagcgataataataaaggactcggtaacagtaacaaagataaggcttctatactagatcttccctattcaaaactacaaaagagattgaatcaggttgttccggaacacttcgtgccatcgccgccggagtcctgatattgtacgggctgttcttgctctgtcaaggaaaaaacatggcaacgtgtgagcacataacacacacagacataacacgtattagcggccaatgtaacttttacatatgttcttaacaacttaaaaaaaagtcaatgatgaaaaagaaattacttataaaaacgctaaaatcaactctaaaaattaaaagtaaacataaaatttaaatttaaaaccttggagcaagtgcgagccttggcgttgcagacgggatactccttggggcagcaggtggagtgatccttgcagcaggtggcgccctcgacggggcagcatccccacacgatgcagtggttcctgatcccgtagttgcagcagcaggtggtccccgccgggcacttgctgtaccggtcgcattgctgcggcggcgatggcgccggagacggcggcgacggcttcgggttgggccccttcttgatcgggtaggacgccatcatggcgatgccgcacttgccggtgcgcgcggtgacgttgcgctccatgcggatgtagccgttctcgccccagtcgggcccccacgagttgcgcaccgtccagtaggcggcgccggtggcggcgtccgtgccgtaccccaccgccaccacgccgtggtccaggttggtgccgcaccggccggtgaacacgccggagtcgtagagctggaactcgcggccgccggcgtcgatggcgacgctgacgggctggtgcgccacggccttctggagcgacagctcgtcgttctcgggcacgtcctcgaagccgtcgatggacaccaccttgcggctcctcttggcgaggttgcacttgccgtccatggccgtgtacgggtagtcctcctccgtgtcgaggccgccgttccgggcgatgaaggcgaacgcgtcgtccatgatcccaccgttgcagccgctgttctgcccgttcctcgcgcactccaccagctcctgctccgacagcgacaccagctcgccggtgacgatcttgttgatgccctccacggcggcgaccgccgagaacgcccagcagctaccgcactggccctggttcttgacgggggcgacgacggcgcccttgtccctccagtccacggagtccggcagcgcctcgacgccgtcgtggcggtacgcctccccgacgcggcgccccctgccggcgggcgtggtgccgaggtaggtggcgcggaactcgccgttggtgaggtcggcgaagcggttcatcccgaggcggaacccgccgcgctcgtcggcgcgggcgttgtgggcgtcgacgaacttgaggttgtcccagaacacgcggaaccggcgctcgtgctcgccgatgaacccgttgcgcgagccgccgccgccgccgcgccggtgccgcgccaaccacaggtcgtacgcggcgcgcgcctcggcctccgtccgctccagcccccgcaccccgtgctccgcgttgtacctgatgatcgacatgatgtccggcggcgccgccgccgccgggggagcgaaggcggcgaggatgaggaggaagcaggccatggccagcgccgccgctacggacttgccgccaccgcctgccatggttgtcgtcgacgtcacgtcacgccgcggcgcctcgagatcgtcgaaacgaaatcacgtagaagtatgtgtggatacgaaatcgtgcggtgtttggttggcttgtgctatgttctggagaggcttggcggtcgatgaatttatacaggttggtggcgtacggttcgtgaccgaattttacttggtcgctgacgacgtgtcggtctcgtattggatctgtatcgtgtagagtgtactcgtttctactcctaaatctgacgtgtcacgttcaggttcggtattcgattctaaataggatgacgtgtcacgttcacacacgggccgtagcagattggggattgaggtgttacggcccggcccatttggcccacgaaatatcacctgacgacttctcttctcttctcctcttccttttcccatccgatttcttctccgggcttctggtagagtacgatttgatactatctgcgattccgcctcccctccccctcgccgccgccgccgccgcggggaaatctaggcgagactccactactaccgcacgtgtcgtaatggctcggaacaagaagaaggtagccgtggcggcgcccaaagcccggaagccgaagcgtgatgcagtaataccccgcgcctcagtcagctggagattggatcgtttttggtggaaggggaattgagctttagctaatatattttctcgtttttttttccttttggtgattgatttgttaggaggagaagaagttcgcgaagaaggccgacatgacggagttccgggcgcagctggactcgctggggttgaagattatcgaagttagtgcggatggcaactgcttctttaggtcttcttttcgattccattactcaaattcttgccactttttacaagaagaggctaatcgatgttgtacgatatgttagagtactgttagtttatgaaaggaggaatagtatatgcattatgcagtcttgtgttatatggttactcatcgtagtctgcagggcaatgggcgaccagctcgaaggcaacgaggaagagcacatgaagtaccgtgcaatgattgtgcaatacattaaggtatgcatcagatgagatgaccaaaacaaacatcttgtaacactgtgacttaataactgtagttagggtgccattgaatcaataaggtattagaaatactgcaagctttggctatgaccaagaaacatcttgtaacactgtgacttaagaactgtaattagggtgccattgaatcaataaggtattgcacatgctgcaaactttggctgtgtacatctgatctgggcgtagagtacaggctgccaggctgggttgttcttttatctaaaagacatgctgcaagcaagcattggcctatttacacttcataatctttcttgtatgcatcttacaggagcaccgtgtggattttgagccattcattgaggacgaggaaccgtttgagaaatattgtgactctatgcttgaggatgggacttgggctggtcatatggagttgcaagcagcttctattctcaagagaaaaaacatatgcatccacatggtaattttcaatacaagctttgcagtatgatttcttcaacctatgaataacacgctaggcagttgagccttgcctagtctgtattttgaaacacatgggtgatatagatcaatgtgctgcttatatatcccctgatggttctctgttatttttcgtactcattttcatattatagcctttcttctatagaagagaacgtactgtaacatttgattgatgcctgtaccattactgaatgatttgcagcttaactcaccacgatggtacataagaaacttttctgatcgtgaagctaccagtatgattcatttgtaagttaatgtgtgttctgctgttttaaactaatatgctaatactggcagtaaaaggacatacattctcatgttcctttgttttgattccaatatagatcgtatcatcagggtgagcactacaatagtgtcagactgagggaagatccatgtcaaggtcctgcaatgccagttattatcaaggtttctcactgtccaaattgtaaactgttggttgttttgtgtccctggaaggacagtgagatcctgttgtagctcaacttgctctgttactaatcttaattttatccgttatgaaattacaggcagatgccaatgtagctagcacaagcaataatgctcaaacaaaagcaaaggacctgaagaaatcttcagacagatcaaagtatgatcatatatcggttaaattggtgatggctggaactggatgttctaatatcgctgcagttgaacaggtatgaattatacaacaaatcgactttcttgtattgcaactgcgagcctaggctgaccgtagcagccaatcagtcattatatattaatggtcaatgccacatcacataggttttgaaagacatggatggtgacattgatgctgctatagagtacatgttagctgagcaactaatactgggttctgatgatgcggatggagatccttatctggactatgcatgtgatggtaaacatttgattattctgaagtctaaagtggctgtccctatgaatgaatctcatccttatctttcttgaggacttcagcttatgacaattaatgaaatttatggtgaaatttggagtacttctgggattccatagattgagttttcattgtttaatcctattcatattcttgccaaacatgagctgcctcacctgagcaagcgtttcatgcacacccctcaattcagtagcataaatctagtaggtaaaacctatactgggtgttgtgctcatggcattttgggtttatgcctcactaatatgatatttaccatttactggttatttttaagatcatcaaaatatgataacagtaccaagaagcatgaacggtgttatagaaagctcaagtaagactacggccttgttggagagcttctagctactgcagcttctcccagaattttcagctctctcaaacaatccagattcttagctatagaatccagaaaatgaactagatgccggttaccaactagctgtttctcagaattttaagctcccaccaaacagcccataccagttgctgtgctgggtgttttccatgttcagttcctctgcaattgccaaaggtcaatatcataccctgtaggaggtatatctgtactaagagttagtgtgctatctaaccaccctgtaggaggtaacatttttgtttggctggttattgttggagaccactattttagaagcacaagtagttcattttgtaaactgagggcattaactgtttcaattaatatccaatttctcatacctgttcaagtaatatttgttttacattggccatgcactgaactcatttcctttattgtgtatattacctggatcagcagagtatgtacagaccatagaggatgagcttagcatgaagcaggatgagagtcaactggatgaacacaagaaagaagaaaaggactgttctagcaaagcgaaacagctcagaaacacaacagttcacattctaaaaaggtaactatcatgtggacgactcttaatagtttccaaacattgaattgccttgttaaaatactatgttggaaggaataaataggaattatccctttattcttttgcacagggaaagtcaaaaaccaaggaatgctcttgtggatctgctaggaagcacaagccttcttgtaatttagccacaactgtagcatcgagagaacctccaaaaacaactgcaccatcgagagaacctccaaagtatggctttataatggttttgctaaaaatatggcgccacatttttgacttgatttcagtcatttttttcccattcggattgctaccattcttttatactcctatgtaagtatgtttcgctctactatctcctctttcaagtaggtaattaattgttttcatcctaattctcttatatagtgtgtgctgcaaaaaatatggtgtaagtattgagatttggttttaatttttttttgttttttggtggaaaatgtggtgtcttaaatatagctaatcccctttataatgtttctgtccttttgtttgtcttttaccatattctattctacaactgaacttatgtcctgctgttcgcattgtaagcattctttcaaatggaatttttggggggtgaaatcaatatttccagcgtatttgcatagtgcattgctgctgttgtatctggcctatgaaaccttaacagtattgctgcaaaatatgcacttatcccatatgccttaaagtcaccgacctgattactatttcctttttcactagggaggttagttgcattgcatgtttaacacaatgctggaagtgttatgtactaatactatctgcttaatgtgctttactatcaggaccaaaggtggccaagggaaaggccagaaggggaagaagcaaaagaagaaagaacaagatgaaacaccagccatccgggatcacgattctaaagttgcaccagatctaggagctctttgcatatgaacatggtcgacgagggtgatgttctcctcagtgtgtagccgccaggaatgtgcggggcatcagttttgaagagagatgtctgcggtctaccttgcttggacgccatgatctagatggtgatttttctcttgcccagttgacggcttcacgtcactgccttctgctgactgactgttgttaagcctgtccaagtttcaggatgggatcatgggactgacggtgaggtggtgatctcagtgggcacagaaacatgaatgagctgttgatacatagcttcttttcttcatacatactttacctgtggatcaatgccatgtaaaacaatgatcagtcgtgcaaagcatattaattttgtgagaattatatcataatagagtattccctgtcctaacaaaacaaaaatacgctctattgtttgagatggagggatagtataatgggttcatcctggagtatatatagccagtcagtcacaattgccttcatgttctcgtgaaagtatctgttttaatataatactgttttctcgtgaagtatcttatctggtaagcagcttatctacttcaccagctacaagtccatacccccatgtgattacagaaaaagaaaatccataagacgaagctacagggttgttgcttagcaatcggtgaagctctcctgggtcagtcaggaagggaaagcatcttgcaatcagaaaaatggcaaaacgtggctcgcactaactcagagtcaaatgctttccttttgggactttgtgagagctccctttgggtcactgaaaaagcaatgtgcgagttgcgagataagaaagccattcgatgatgactcggataatcaaagtttaattgacatgtcattagtcgtgctggtgatagatattaaccccgtcagttgggtttggggttgtgcgttgcgtagggcaacaagctaatccttccaattaatcatagttgcactattcaaattattattgcgtgcatgaataattggtgcacgaggacggagcctactctaggatattgtcgataccatctgaattctcgtgggaaaaaaataataggagacgataagaggaatcgactggaatctgtgggagatgggctccggtcggcgcagtgtcctacagctattggatcacccatttttggctcttggctagctagtagacaccggccactagcaatgctcacaggcaaagatagattttttttaattgacatttagtaattctctttcaaaagaaaaagtagacaaatagacaatctgtagctgcctggacatatcttcggctcttcgatgagcaaaacgatgctactgtgcgttcattgggtcagcagggcacaccaggacaccggcgagactggaaggcgtgagatgtggccatcaaccaacaaggtggggagatagtacgcaacagacgcgtgttgcgcgagccgcgctgacgctgcacatacagcgcggacatgccacaggccacagcagcaagcggagcggagaagtggccgctcaagccaagcaactgcaggatcggaggcgaaatcgcggaagcaaacctcccccgagtgggcaaaagaaattcacgcggagttggccacactgccgactgcccgcgtctcgggcaaaatttgccgacctcgccgcccgccgcccggtaaacctcgcggcagattgcacgttggatttccctggtatccatcggtgaaaagcggcaactactacagtagcgcttcgtacaccagtgccgatgattctagtacggcactatcccgtcagtgtgtgcggccgattaacacgtgatctactcactggtccccggtggtgcacataaacaagcatggagtaatcaaccactgatctgcagcacgttgcgcatttcgggctgcgaagggaagggacggaccccagccacgttcccgtcatgttcagacgttgtgatgctcatgttcgcgcatggggctccggttcccaaggagatcggataggatttcagacacccggtcaccggccaccgctaacaccggccggcgagcggccgcgaacatgcatggcgtctcgtctgtcgtctcccgatcgaccgtgttcgtgtacgctaccgtggtgaccaaccagccgctctctgtgcagtgcatgggcgagttgtgtctcctcccaactctttttccttatcgggtaagcaaacggccgtgattgggggaccaactgccccggtgtcgtggtacgtatcaagtacacctccgtcttaaaatatactaattattttgtagcagagtagcaagtcaaaaaatttaaccaccgcaaaaaaagtcaaaaaatttaaactttaattattaatagtaaaaaaatttaaaaaagatcaatcatgtaaaattgatggtattagatttatcattaaacaaactattataatatgtaatttttttaccttaaaatactagttttacaatactagttttacagatattggtagtcaaactaatattttatattttagagaccttattatagtttaaaatcattatattttgggaggtagcgagtaccgcggtaggacgcgccaccacggagcgaaaggaacacgagattcgtccgaccgccgcctcgcgctcgccggcagttggccatcgttgacgcctcgctcgggcgcccggaaatggtgtctcgccacgtgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcataaggtgggcaggaagccctctagggggcatgagacaacctgatcgtcagattaatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcgacagttggcgcgccaggtaggggctgcgtcgagttttccgtcgagaagtgcgatggaactttgtgctggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttgtgtgcgccgctgccgttgctgatggcgatatcttctgcttcaccggcctgcctccgtcgccgccgactggtgtcctcgcctatacggtcggttggtcacaccaccgttgatgggcatcgtcatctacaccgccggcctgcctccgtcgccgccgagtggtgtccccgcctatacggtcggttggtcacaccaccgttgatgggcatcgtcatcttcaccgccggcctgcctccgtcgccgccgactggtgtccccgcctatacggtcggttggtcacaccgccgctgatgggcatcgtcatcttcaccgccggccagcctccgtcgccgccgattggtgcctccgcctacacggctggcctattatgccgacgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctgacctattatgccgccgttgttggacgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccactgccgactggtgtttccgcctgcacggctggcctttatgccgccgttgttgggcgtctacgtcttcaccgaccggccgcctcgaccgccgccgactggtgtttccgcctgcacggctggcctttatgctgccgttgttgggcgtctacgtcttcaccgaccggccgcctcgtccgctgccgactggtgtttccgcctgcacggctggcctttatgctgccgttgttgggcgtctacgtcttcaccgaccggccgcctcgtccgctgcccactggtgtttccgcctgcacgg

SEQ ID NO: 72358 - DNA, 11682 bp, Oryza sativa
tccagcttactcggcaatcagctgggagcaataaacaacaagcctgtaaagtggaacaagggcatggcaacatccacaggctatcacattctggaaacaaacatgaaagatgcctgcactcctggagagatggagcctagacattgcatggtcatggtgaggcttcaaatccatttccacctgatgaatcgtccattgcatgccctccagttttggaggttaaaatgggttgtcaatgatgcataaaacatggtcctcattgataatgatgaagatgagtcaaattacctttacaatctcatggtattgccttgcaattacatcaaagggtggatctacaccttggtactcgcgcaaccgtgaaacctggtgcaagataaaacgacactctagaatgtaaaaacaaattatgggaaagtcgactccttttcaggtaaaagaggatactgaaagatggcatacattgtttatagaaattcagttgaaatagataactacagagctctagttactagatttccattacagagttaaggactagatattcagtaaatgagtaataaccattgctattaaggatttaatgaccaaatattttgaagattacaaggggaaagtaagatgggtgtatcataccgcttcagtataagaattggatgcttctttcgtggcctctactagatatttcctgcaagaaacggtaaataagtaaaaaatgcattttcctgaaaagaaaagcactcaacatattggatctgttttgagaagatgtaccacttaactcaagatatcatgtcagttttttttaaatcaattaaactggctttacctgatcctatgtagtgccggtactgtttccttggtataggtgtcacgcaagagatgatgctcaagatagctagaaccatgttaagaaagaaatagttaattaactctgttttgtcccatcgctgactagcaaataactcaattagaagactaactatgtttaacaaagtacaaattaagatccgttattaggtgatgtatgatggacgtagatgcaggtaccaaccttaatttagcattcattgtccggcaccttttaataagccaagtcttcttcagatcatcctattagcccacaaagacaaagtaggaggattaactatatgaaactgaaaacactccatgttttcaaagaagcagcatcataataggaatatgagaaagcttacatattgatgctgatgttccaatttcttgtctttaacgaactgtataagtacagcaagaatttgctccaggaccttttgaaatttcaggagccatcagtaagtggatataatccagaatttctactagaataaagtgagctaactggctatgtggagtttgagcaatcacttaatatctacacacgtacattatagtgttcggcaaattttctatccatcgaagcaagatcgtctagtagaagggcctcttccttttcaatctcttcaataattaacttcaccctgccaaaagggaaaatcatattgtgagtaatgcgtctcatgaattccctgttattaatattttaagtccaaacaagtaaaggttgacaattggacattgccatcaagaactgagaatgcactgtgagtgatcagagtaaattattacagaagcaaacaaggagattttttttcactcaaaatgttatgcttgacctaagagagttttggcatatcaagcatttccgtataagtaaaaccattgcaagacaggcaaagatatgaaatttcacctttctggaagtctggcacttgaaatctgactaatggatgatgaatctgcagcacatttgaaatgttaagctaaaacaataatattgaatacaagatgtgtactgttgtctaaaactaagttgcccaagttgcattgcataaaatggacaggaacgcagggagtgaaattggtagtcatagcaagattcaaaaactgacccctttcatccattgcaaacagatcagctaaagcatcacacttggcttctaagcgggcctcaatctctcttgccagagttcgttgatagtcaaccatgtcctgcaacgggaaatcagaggtacatgctgtaaacgtttaaacagcccggttttgaaaagaaacaatgtatgtcctgattgctcttcagtaaatggtaaacaaagataggaagcagtgaagcagtaattgtctgattccccaagaaacatacgataatatatccaaaactaaaatgaaacttgaacccaccaacaactggttcacacgataaatttggttgcaaaagattatacataccacggtcatggctggctgctcttgctgcacctggtagagataatccgatgtgattccaagaaaacgatcaggaacaccgccaacaccaggctcaactggctccgaaccaccagtaccaggggccgcagcaacagtggctgcacttgcggtgctgctgtagttattgtaactagtcgagattgaactcgagctaggtgcggcacttgtcatggtgctatcgaatgagctcctagacaaggtgctcagcttctctatctcctcctcatgtacatctccatcctgcgagagcagtggaagccttaacctctgcgcagcctctgcaaccgccaaatggtgctccaatgactcgtacacctacatcagtccatacaatgctccattttcagtcagataatttctcaatttagcagcaaaagtttcatctgcaatcaaccagttgaattcacatttgcagctttatgtccaccattcactgaaagacgcaaaaatttaaaaatgcgggagagaagtggaacctgcggggagcagttgagcttcttcccagcgttggcgacgccagtggagatggcgtgctgatactcctccaccatagcaatggcctccgcgtacacagcctaaccacattacccccagatctgatcagaaccccaacgggaaaccctaaaatcccagatcccacgagaagggacgggcgcactcaccagtgcctccaggtatcgcgcgcgctccgacgcgacctcctcccgcgcctgcggcgaaggaaagcacagagacagcagcgggtgagatcgcggaggtaggacatcgagttcgcggaggtgagatagcgtacctggaggaggtcggagtgggcgcagctggagaggagggaggcgtcgggggcgaggtggtggcgctggagctgatccaccaggtgcgccacctccggcggcggcggagggagcgacgcggcggcggcggccttggacatcgtcgtcgccggcgaataagaggttcgttggtggtggtttgaatcgtgtcggggaatgtggggtttcgtttgtgtagccggatttgggggggctaccagccgttggatcgtgggatgacggatgagattacggctgattcattcggctatcagagacacggaaacaaaaatgcctctataatcttctgaaattatggatgtccactataatctccttcatcaaattcgtcatctctccggtctttcatttcatacgctgtttgttatttttatttgccgaggccaaattttaaaatttttaagaaaattagaattgagagttgatttttaggggtttttcatcgtggttcattttaagttgacttaaaaaaaacctgtgaacattattatttttatgcttagttcttttttccatggcttatgagccgtaaatcaaacaatgtgtacttcgattttaaaatgagatggtaaatcctagtactatattttagaaacagatttaatggctaggtttcgttatgctcgagcataccctcaaatgtttgcataaaaatttaaaatagatgatatctctttgtgattggtgttggagaaggattatagaaaagaagaacgggtgtttgctcgtcctggaagaagaacataagcaacacaatgatatgattagaactgaaacggtataaattaaacaacttactccctccgtcacaaattacttgtctctttaagatttaaactttgtctcaaaatggttatcataataaaatactatttgttccatcaatcgtttctaattcaaatttatcttttttcttgcccctaaccaacctcctacatccaaccatacaatatttagttaagggtattatagttttttttcttaaatcttaatctatgctttaaaaaaaaggtaaaattgtggcacatcaacgtgcatgagcttaataatttgattagatcaaaataccagcccatatccccatacacatgtggtcaggtagatggacgaccttcaagtttgttgttttcatgttcaggcttgcatgatacgattacgatctgccatgatgtctttttctcgagattatggtgtcgtagtcgtcttcaactacagtaaccagacttttatgacagaaaatggtgcgccaaagcagccataccatatgaggaaaggaaaaaaaagatagaaaataaaacacaatattgaataacttgcaaatattgtattgtataacaagatttgtccttggggaccttttattatgcgtataattagcgtgttttttttcgaaagtatttttatcccgaaaagagaagcactagaaaccaaatttcaaaggaatgcgacaagatttatgatgatagccttactggagaggagcatcatgaaatcatcgtgaatgcgacttgaattgaattattatgctcatcgctttcgcataacctctgtaggagtacaattctttactgtactaaccacttttgattaggagtaggagtactgattttatttcaggataaatcaaagcaaaaggaaatatatgcaccttgtcgggtcatcgtggctgctttgatgatgcactcatcaccttcacacgtcggatctaagagaaaaacggccactaaaatgcattatacaattctaataggaattctcccagtcgaatttaagagagaatttggtctcgaactctcaacgaatgaaaaaaaaactctgtttgaaacgacttcagttttatctttgaaccaagtagttgtctaaaatagcgacggataaaatgtttgtgcaacaaatgtattattactatctcttttctacacgataaagatttcgcatgaaaattgaatgtttttctagtattctcccgtttcatattataagacctttgctttttttttctaatctggctttgttaagtttgactaaatttataaaagaattaataatatctaaaataaaaaattagttttattgaatccaacattgaaatattttaataatgtgtctgttttattgaaaatattactatatcttttacaaatttaacttataatatttttaactaaaatgaaataatatgaaacatagtgagagaggtgagagagggagtagtaggtttggagtggataggtgagcctgaacatgaatgagtcagcgacgagtggaacaaacatgtggtgtgctgctgccttgtcgtcatagaacaaccttctcttcccttccctcacctttcgcgttcacctcagctcagctcgtctctctgactctgatctcgccgtcccgagttcgccggacacgcacgcacgcggccacgacggcggcgatggagggcgccctgctctgcgccgccaaccacgcgccgctcacgcccatcaccttcctcgaccgcgccgccctcgtctaccccgaccgccccgccatcgtcgcctcctcctccgggctcacccgcacctggcgggagacgcgtgaccgctgcctccgcctcaccgccgccctcgccgccctcggcgtccaccgccaccacgtggtaagattcacctccgctcgccaccgcaatttctacagtaacttgattctcaccattgattgattgggttttctccccaatctccccctctttttcaactgtttgttcatgctaaaacccccaaatcgcttcgaatttacttgtaatttgattcggaattagcggtcgagtgattcgcatttttctgtgtaggttgcggtattcgcgcagaatattccggcgatgtgcgagctccacttcggcatcccgatggccggcgccgtcatctgcacgctcaactcccgcctcgacgccgccatggcctccgtcctgctccgccactcggaggccaagctcatcttcgtcgactgcgcgctgctcgacgtcgcccacgacgccatccgccgcatctcccaatcgggcgccacgcctcccgtcctcgtcctcatcagcgagctcctcgacgacccatccgatgccaagctcccgtccggtcgtgtcgactacgagtacgagcacctcgtcggcaatgccgggtcgtcgccggagttcgcggtgcggtggcccgccgacgagaacgagccgatcgcgctcaactacacgtcgggcacgacgtcgaggcccaagggcgtgatctacagccaccgcggcgcgtacctgaacagcctcgccgccgtgctcctcaacgacatggcgtccacgccggtgtacctgtggacggtgcccatgttccactgcaacgggtggtgcatggcgtggggcgtcgcggcgcagggcggcaccaacgtgtgcgtccgcagggtcaccgcggccaccatcttcgacgccgtggcgcgccacggcgtcacccacatgggcggcgcgcccacggtgctgagcatgatcgtgaacgccacggcggaggagcagcggccggtggcgaggagggtgacggtgatgaccggcggcgcgccgccgccgccgaaggtgctgcaccggatggaggagcaggggttcctggtgatccactcgtacgggctgacggagacgtacggcccggcgacggtgtgcacgtggaggccggagtgggacgcgctgccggcggaggagcgggcgcggatcaagtcgcggcagggggtgcaccaccacggcctggaggtggacgtcaaggaccccgccacgatgcggagcgtgccgcgcgacgggaagacgatgggggaggtgatgctgcgggggaacacggtgatgagcggctactacaaggacggcgcggcgacggcggaggcgctcgccggtgggtggttccggtccggcgacctggcggtgcggcacgaggacgggtacgtgaaggtgctcgaccggtccaaggacatcataatctcgggcggggagaacatcagcacaatcgaggtggaggcggcgctgttcagccacccggcggtggaggaggcggcggtggtggggcggccggacgactactggggcgagacgccgtgcgcgttcgtgaagctgaggcccggcgcggcggcggcggcgaaggcgggggtggtggaggaggagctgatggcgtactgcagggcgaggctgccgaggtacatggcgccgcggacggtggtggtggtggaggaggggctgccgaagacggcgacggggaaggtgcagaagttcgagctgcgggcgcgcgccaaggccatgggcaccgtcccggcggcggcggcggcgaagtcgaagaggagcaagctctgaatgaatttgtttgcgtcagctgctgacgactgcaatgcaacttcgatgcagcatgcgtgtgtgtgcctgtggaatctcgagacaacaaccaaagaaaaaaaataaaaaaatcatgatttgttgtgatgattcgtgcgagaacaggttggtgtcctttggctgtcagtgtgccgtgcggttttgacagtatactgtcatcgtgtgggcttgccatatgatgtggtaacctcacacggtgatacattttcggtttttgtcggtaactatacaattagggccttcactgtgcgaatacgtggcgagttacttcgatacgccagctcggagattcgtagccacgtctatatcagtcggcccccttgtgaagagcggcggatctcaatgaagttctgtgttcctggtgctgtcaagattataatcgtgggccctgtgctgccaaagtctaattcaaggtcatactacctccgtccaaaaaaacaaaaaacgaatatggcatagtattttagcacagtgaatctggacagatgtatgtctagatttatattactagttttaggatatgtcacccagtactagttggttttttatgggacggagggagtactgcactatgactaatatgttgatcggttcttagattgaaaaggtggttcgacgcacgatgctttgactatggatggccttatcatgtattcgtattgaccgtgatagtgtttggtagtggttgtctgtactcaaccaaacttatcctatcaaccatttcattttgatttagacatggcatcagaacaacctgaatttcgcttatgtacatacgttgcttttaccactaaaaggccggtttgaacttaaacagagtagcttgtttatttgaaacatactctcttcttcctaaaacaatcaattttttatataattcgttcacgtataaagttgtctcttactcaaattcacgtataaaagttgaattttttttctgtaatagaggaagtatgattttatattagggttcttgtacagtttaagcaccgacaaccgctatctgtaactgcaaagggaggaaaatgagctagcttttatacatgcccagctcattgtttggcttatttaaaaaataaacccaacggtatatttgtaaacgaaaactaatttatgaataaaacttttatatacatgttcttaacaatctaaaagtaaagaccgaaaaataaactacgataaaaaaatctcaaaatcaactttaaatttaagattaagaatttaaaaaaaaattaaaatttgagttataagcataagcattagctaaggctgtcaatgtggctatgagagcgagacagtggttgagtgacccattgagctgggcaaacgatggtgcaccgcgaacgaaccaaacgcctagtacagccatagcccattttggtgttgtgtcgccaccaaaggcgattttttcctccttttttttttggtaaatctggagagcgactgacaaaggggggacgcggccccgactcggcgactccgaccgacgagatcgccgtcgctccatcccccatggctgcctcctccgccccacctccccctccccgccgcctcctcgctctcaccatggcgctcgccgccgccgtcgtatccgccgcctccgccgcgagggccccggcctccgtcaccccgatctcccgcaccctctaccactccaggtgcgcctccctcccacgaacgaacccctccctgccgtctactcttctcgggggggtttcgattcggaatttgggggtgatttcataccatttcgaacctaggtcgatgccctgcttcagtatactatacctcgtggttgacgaatcgagagagtgtccctgtttgcttaggtatcatttgctgctgcgcgtgatttcactgcgatttgttctcgttttccccctcattaagtgtagtctcagattggtgtggtggccattgctttgtataaacggcatcatacatcggtcctggcaccactaatgtggtggtttctaggaaaaaaaaagaatacgattctttttattttttttcagcaagtggtatactggcaccacaagcctgtatcttaatgcaaacgtttgcaggcctagttgtgagcatgtgagctgatctgaattttgtacgagtgtgttcaaccttgcattgcttgcttgcttgagccggtctgatgaggagcatatagatacaatgtatcggctttttgattctgtctcctgtgtgcagagcatcatgttaactgttccttttgtttttcctcttcagtgattcccttctgagtgatatcaaggccttggttgcccggcatccagacaagttgagtgtgagtggtttaactgccctatttcagtcattgttggccagtttgttttgttgcatactagtgtttcttatgaaattttgattgaatcgttgcagatggataccataacagcaagtaacaaagggtattccacagacctctttatcgttacttttaatcatgccaaggagagcacgtccaattcttcaaagatccatgtccttctggttagtttccaacagaaattaactcacgctggatcattctgtgcacactaagttatttcttaccactaatatttatccattgtcccaaagcaaatggtatttgtttcactgaaactgttgtcatttccaacctcaattaagagaaatcccaaagcaaagcaaaacaaaaccaactttttgataatttttacacattggcttgtaaattaaattattgatgtcttgcggttttgacagaaaggttcattgtcttccagagctttgggcagcatggcagagagcttatcacttctgaagttgcattaaacctcctctatattttgaccgagaagcggaaaattgctggtgtcgatctatcatcctttgagaagatactggagaatcttgtaatcaaagtacgtccttttgtaacttgttttgacattttcacctcctgacccacataatcattaggagatatatcaatacacatgctcttttctggtatgctctgcatggaattactagagcttaagggcagtctcatttattaggaataaagtataagatagaccaaagttagttatttcctttaagccttgtctgattccatctttgttctattttgacatattttttttactctctttgtttaaatatttagtgcagtgaacacgacaaaattatggtttaaacgtcattactaaatgtttcacctggcatatggtgtttttctcctaaattactctatgcgtatgtcattattctaatatatacaagcttggtttggcttgctaagtaaaatatttcatgacatgaagttcttagggttgttaacctgatccatgctctttagtcttcttaacttgttgcttcctcttcccctcttttcatttttgttattttttatatttctatattaacgaagaatcagatttcttaataatcagttatgattttttttaatgtggctttgatctttaggtggtgcccatggaaaatttaaatggtcgaaaacgtgttgaagaaggggagctttgtgataggagaaatggtgatcaatcttatcttgtaaattcatcacttgatgcagttctatgccaacttcctatattcatgtttttttcatttttcaggaagaggagttgatcttaatagaaattggagtgttgattggggaaagaaggaaaaggttgttttctcagcagtttattttatgcacagggaaaactgtttccttttgacttactgtagtgtgcatgttgattttactgaattgcgtcttaagctaattacctaaattcatatggacaagaccgtagcattccctaaacttgctcgcttgctaccattgattgacatccttactatcttagaactatttttaatttagatctatagagaatttagaaaatagacctctgcatatgctatggttcattaccatgtatcttagtttgtcatccttggctgttactacgcctgtatatggtatggttcagtggttcactatcatttatcatatgcgttaattgctgattgttggattacttaacctcagttatgcaaatgtagtgtacatcatatcaatattttgagctatatatgcattttacctgtattataggactacgacccatatgagga

SEQ ID NO: 72359 - DNA, 1475 bp, Oryza sativa
ctgcacccccgccttcttctctgatttcgttcttatccatcaagggcctttcatcatttccaacaatggtgataaatcggagagtgctcacaatcgaatctaatgagttgagtgagctcgatggcaggatctcaccattccataatctgaagggcataacatgggtaaacctacggcgttgtccaaacttgacccgcatttcgatagacggtttcagccaaccacatgtcatgtcaaagcctgttcatgataacagtatacctattacgagttaccctgtcctcccatctgtcaattctctcagcattcagtcgtgtggcatagctggtggatggctaactctaatgcttcctcatttgcagtctcttgagaacttggagttacgagactgcccacagataaaacttttatcaacaagtcaatgtacaaaaatagaagcaccgaacagtttggcttcagcagagacaacctctgccagggacaaataccttttgcaaattccatataatctcctccgttctctaaagtggttaattatttgggcatgccgagacctggaattttctggagtcaatgaaggatttggaggattcacctctcttgtggagctacaaattagggattgccccaggctggtcccatcattggtgagtgaaaccaaggataattggttactcccaacatcatttcaatatctcactatcagtcctctcccggcaaacatgcagctcttcgcccctgagggcctaacttgcctcagagtgttaagcgtattttgcagccaatatttgaagtctgtgcagctgagatcctgtacagcattggagtgtctgcagttattggagtgtcaacagctgagtgttttggagggcctccaacaccttagctcccttgtaagtttggacatcgagatgaatcatgaactgtcaatggcatgggatcacaaactgcaggagcaagaacaaggcagcaatcaggttggactatttcccctgtcacttgtacatcttggtatcacaaatcttgaaggcagtgtccattctcgctttctggcctcccttctattacgaaattagacttgtggaatagtccagatttgaagtctctacagttaggatactgcacagcgctggtagatttggcaattgacagctgcaagtcgcttgcatcaatcgagggtttccagtccattagaaaccttaggtccttgagagtaggtgactcccccagcgtatacccatgtctgcagcttatgtcgcagcagcaaggggcatctgacatcttttctcaactggaaactctaacggttgatgatgcctctgtcctttccgtgcccctttgcaaacatctcacgtctctacgagtcttaggattacaccgggatggatatagtggcaagtctatggttagtctgacagaggaacaagagcgagccctccagcttctcacctcactacgacaacttaatttttaca

SEQ ID NO: 72360 - DNA, 3305 bp, Oryza sativa
tcctgcaccccatcctgattgtttttagcacgagtacacattaatgatctttatataccgaacatcaagtcaccacaaacaagaatacactacaaatttccttcgtgaatgtatattaggatactatcgatacaacaaagtacataccaggacagtctactgaattactatgcctttgagtaaacaattaccacgataaatcaagaatttacgaagcaataactaatcaccacgccgattctccatgagtgtggaaatctaatggccccaaatctcacaatgtagcatctaattgcacacaattacaaggcaactgaatcccaattgcccgtacagtgaacaggatcaattaacagcggagacagatcaggaaaccgtaccacacacttgctgaagccgctctgcagcgcgcccagcgccgccaagtccgcatcggaaaccctagcgccgccatctgcacgcacgcacaaacgcatccatcccacctcagaatcgacacacgcaaagccaaaagcagaagaaaaaaggcgcgcgcattacatgaggagaggccggagaggtagacgaggatggcggtgacgccggagaagatggcggcggcgagcgcgagggggagcacccgcatggccggagcagccgaagccctagccgcgctctgccggctttggcccccgtgctctcgccggagtcgagtgtgagagagaggaagcgagcggcggggatcagttcgccatttgcgaagagttcgagggggcttttcgcatattgtgcatttagtgagactttttttcggttttagatttttttaaaaaaatatttacagaaataatctatcggcaaaaaaaaactacaaaaatagaccctgccgcccacctctggggtggcaagctgacgtggcaaacggggggaggaacgggcggtgacggagggagggttttttttgcatgaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagccccagccctcattcttctctcctcaattccagtgaaaaaaaaaagaagagaggggaggagaagataagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatttacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggactaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatatatatttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatg

SEQ ID NO: 72361 - DNA, 1282 bp, Oryza sativa
attctgttgcatcctagacattcaactgaaatgcgtaagaatagtctaccttgaaccacatgtacatttgtcttttacaagtaactagagtgttttcccacgcaatttcgtgcggagctagattttataagaaatggatttcacatacaactcttagattttgtttctatagatataattatattttgcatacaattgtaagtgatctataaccccacttctattactatacatacaattgtgttttgcatataatagattttaaaaagtagaattggattaatatatattttttatcttctattttcatagatataattatattttgtatagaactatatcaatcgatctacaccatcaaaacattgatataacataatctactggttaatattttttttctttttctccgtggtaatttataggcctccagagcaaatttcttgactggacagatgcaagtgtggactcgtgaagttggcctttctgaagaagtggagcttgagactgagatgaggagcatgtatgacgccgaggatgtcatggacgagcttgactactaccggctccagcaacacatcgaaggtggtgccgaatctcatcaaccttccattccatgattcttgcttcatgcttcttttgcatttgtgtactagtgagcttactgtgcagctaagagaagctgaataccatagtccataggctccagtcaccacccaatagtttatctcagttaattaagattaccttcccatcatttaaacttccgttgtttactatttttgagcttactatttttgatagccactaagatatatgtttctgtcaaacttttatgcttgggagatgttctagttgtttctttcttcttttttggctgtgtgcattttatgcagaggccgggggtgactcggtttgattgtatcatcttgatgtaattaactgagtttaaataaagcttccattatctaaaaaaattatttttaagaaaccttccttaattataacagtagattgcacaactggttctcttttgcttgtcccataacattgggttttaaagagaattgcagagaaacaatgaagatggattaatctctcgagtggatgtccacccatttattgcatgtcaactaaatggttgtgaatttttttaaaaaaatacaagatagattaatatgtattatatcacttcacaaacatacaagttcaaattcgacttctataagtcgtaacaaaaataaaaaattaaactctaactagtatacgcgggctgcaggaa

SEQ ID NO: 72362 - DNA, 11451 bp, Oryza sativa
ctgctgtcgttggttgcctggggcttaacctgaccagtggaggaggaaggaccaaggacaataacacattacacgtaggacagcgaggtggttgcttgaggaggagaaagctgcattgatggcttgttgctgctggtgttggtgttgcggggacctgcttgtctctgttggcagataagaagccagctccttttatccgtccttgtgtcctccctgttggtcgttacagatgagatattaactccatcttggaatgtttggtgttttttgaccagaaaaacaaagaaatacactctgaatgaaaatgccagaatgtatccatcagtggaaatatgttaacaagaaggaaacatcaaaggttaatgaaatggatggatgatatcactggagttcatatatgcatcattggacaggtcacgaacatatcccctccatcctagaaaaaagaagaacttctagctatgaacaaatgtgagcatatgatttggacaaaggaaaatgacaagcacagaagcacttgggagagaaattcctgatcaaatgtgccagtattttggcatctgaacatccgtcgccgtccaaactatgccacaagagggaacttaacatgtcttgcaagaaagcaaaagaagcctctcctgcctagtgtataccaaccctgcattcgacggcgacaggtataattctatacaaagccaaatccatccatcagaactcacattaaccaaacataagagctgtcactatcttaaaggacacaccatctcaatctcatcggtcccaagtgaggaaagtttggtcagctaactgaaaagaatccatagcacaagcatgaatcttgatcggattactgaagtaacaagagtgaaatttaccctagctaacgtatatgtcacaccatttaaacaaggaatagttagtttagtaggagattgagatacaaggaaccagagatcgatcgatcgagatattgcgatgataaccatctgatggggtaacaaacaagtggtcataaaattgggcaacctagagctaacactagaagaaacagcaagcaagaatgatgggtagatcgatgtgatgcctcgtcttatggtgatttgcccaccaaataatagatttacacacacacacaaacaccaatcatacactgaccaacaatggcacgaacttgcaagaaagggctagaggtggtccagatggatacagctttacaccaaccatcagattagattagtagtcagcttgcaagaatgcatgagacatgctgcctgcagctatcgagcgtactattagattaggtttatgttttagtatcatttgtaagtacaagaaacgaacaactgatcatgcaattaatgaattttgacgctatatacactgtgtgtgtattcagtattcttcatcagtgatctctagctaaatctctatgaaatttgtacaaaaatatgtatcagttaccactatccaacttgtattctcttctttctttctattccttttctgcctttggtttggtgttcctgagggaaaaaaatggtcaaatcaattttggttgggcttggcagtgacagtggcattggcagaagcggagcgagtggcgaggcggaggcggccggcgcggcagatctcggcgggggcgggcgcgtcccaccgctcggcgcgcgtcatgagcgccgccacctccgccacgcaatcgtccgcgcccatggtcgccaccctccgccgcaccgccgccgcctcctcgccggcgacctcgtcaaacagcgcctcccacccttgctcccacggcacgctcgcgtcgcacatctccagcgtcccgttccgccactccgtccagctccacccgcgcaccagccgcgccgccgacgcgcactcgccgccgcggcacgccggccggcacggccggcacttggcgccgctcagcgggccggggctccccagcgacgccacgggcacgccgtacggcgccggcgggaacgagtacctccggtcgctcagcacgcagaacggcagccgccgctccctcgccttgacgccggccaccttcagctgcgcctggaacgccgcctccgagttgagctcctggtagcccgcgacgtcgaggcgagggatcagcgagagcctggacagcgcgacgcgggacgcgtggcggccgccggcgccgaggcggtcgttgaggcccccgaaccgggaccccttggggacgacgtaggcgccgccggccgggaacgcgtcggcggcggcgagcgggccggtccagaagccgtcgacccgcgtacggaccacccaatcgtacgtgaagttgcctcgagattcgcgctcgcggatcaggtccaagcacccttccaccaaccgaaaatattgcagcaatccctgctcaatatagatacatacaaaaatgagaactctaattgcagattaacagcaacttcgtcccataaaaaccaactctcactttaaatttaaatttagacatttggtgtttttataggacagggaatatactctaatatatagttagacacataagtagatacagtaataagtattctaatagattgatttaatctacggattaggtagattagtcactgtcaataactttttttacgacaagatggagaacacatgacaagtttaaatctactttgtttttttctcttttccgagcattgacgtttgcggcatcggttgtttacatggggatgaggtatctatctacttgtagcttgtcaccttttctccaattctcccagagaaagcataatgccatcataatccgaagctttggaggtgaatacagaggatgcaaaagacgagcataaagcaaggcaaagaacaatatctatcaaacttttgtgatgtagatgacaatggcttttcaagagactttctcaaaagcgtcactacgtacccacattacctgccgtttttaatactacgtggaacatggattgtcatacacctttgcacgttattatattcgagcaaaacaaattatgttagaccaagatgatgtatccgtacattgatggtataagaacatcacgtttctacagtaatttcagaagatattttttttactgttccaaatggtcggtaccaaattttgtcttgtagaacctaaataaactctaatgatgaactgtcatcctctgttttggagggcacaaatttcattggaaaaaaagtccaaatgaaaccagcagtttatttgcagaaacgaggatatgtgccagcctagcctgatatgctttgtttacactagcaatcgcaaccttctggttactctactgtatgtatagaagcactcatgtggagccagccatgtgctcatctactaattgacatgccggtaatttgcctttaatttgcccccctcagtctctctccaaccaaccatggatcaacactgacacacacagcatctcatggataattcaggctgatcaataatactcaattactctccatttcacaatataagactttctagtattatccacatatatatatacttcctccgtttcacaatgtaagtcattctagcatttttcacattcatattgataataaatctaaatagatatatatgtctagattcattaacatcaatataaatgtgggaaatgatagaatggcttgtattgtgaaacggagggaatagatgttaataaatctaaacacatacacatgtctagattcattaacatttaaatgaatgtgtacaatgctaaaaagtcttgcattgtaacggagaaattactagactaattaatcgtggtagttaagcacacagacagttagaaactaccatcggattgggatcagtcatggtagtcgtggcacgtgctgacgtgcatgccttatacctacgtgtactggtagtcctatgggtgcacccgcgtaagatttgtcacagtactagccaagtacattgtgacaaatgtctcacagtgaaaatcaaatgtgcacacggcaatgtcctattcagttcgtagcttccgccgaacattcacaaggacacagtgcaaaaaacgaaaacacgacacaatttttttgttggtacacagtgcagagcgagtcagagacgggtcattgattgacacgtaccgaactgtctacgaaaggaacaatgactttgtgatcaatcatccgatcgacgacttggccaaccttgcttaccttgcttggaccaaagactgactcggatatttatttactgttaagcacatgatttctcttctgaattctgaatttgctttcttgtgctgattctactgtagtgttcgtccttatgaacaattgagagttatggtcccaacgcgttgatgccttttgagaaccaaccaactcggtgattgtgattgatatttttgctagctgtgggcaacgagctctcatttaaaaaaaataactagcagtagcgaatttggccgctgtctagctgacactttgactagatccgtgaatttggaatgacatgcatgcatggcccgatggctggccaatgggccattaacaaattgatgatggctctatacaattcccatgcgacttccgcggtagataataagatgcaaattgattaaactggtaccaattcaatcttgcttggtttcttttcctccatttgaagacgttatcaatcttaattatcttttggacctaattaagggcttaataaattaaaaggatatagagaaatgaaaccgcccctagattaaagagaagaacccaacaacctgcccctaccatgccattgccaccatcacctaccttcggtttaacttcaggtggttttactactttattaggtagttttttacttaaatgttttttttaatataagaagaaaggttgaaacaaattatctccaaattaagcaacgtggacagattagcagaggcgacaaacaagtcaagacgaacaaacagaacacccaacaaaaaatcgataaacaattagcaatgtgtagggaaaaaaattgcaatgaggagtatgcagcggcagcaagcaagtctaaggatgaagaaaacgacgcaacgtgcggggaagctatcgttcgatcggagtcggggaggtagctagcatgcgtgcgtgcgtggtttgatgcggaagcaaggaacaaaccaaaccaaatccaaccatggagtagtgggggtgatcggagattgaaacggcggcgggcgcgtacctggatgccgttgggcgagttgctggcggtgagcacgcgggcgcgctcgggcgtctcggcgatgcgctccggccggaacacccgcacggcggcgagcctggatcccggcggagcggcgcgggcgaggagggagagcttgtaggcgtcggcgtcgagcgggctgtggaggaacacgtcgacgacgggcgcgccgccttcgccttccttcttctcctgctgatgcgcgacgagcggggcgaggacgtggcgcgcgatggagggccccgtgagctcgaaccgccgcgcgccacccaccaaacacacggccacccgcggcggcggcggcggcgggggcggagacggagcgtgcctccgtcccagcgcgacgagcgacgggatgcggccgatggaggaggggaaggagagcgcggccgcgaggaagaggagcagcggcgcgatcacggcggcgatgcggccgcccctgcgcgcggcggggagtaccgacgacgccgcgcccccgggcttcatgctgcggtgaggaggcgagggcgagggcgagggcgagggcgtgggcggttgctagctcatggcggcggcggcggcggcaaatagtagtgggcgcgcgatgtgaggggggcgaggtggtgaagagggggaggttgtgccgcggcgcggtgcgttgcggaggagggaggatgggacgacccggcgacaactttgatgcggcctttaatgacccacgtctttactatttactgttcctactactatttacccttagagcaagttcaatagtatagccaactactagctccaattcatctatagccaatctaatagctcattcatacaatagttacatactacactattaatatctagtcccacctgtcatagacacactgcgttttagagtctgtgctacaactggctacaaatctatagcccgttgctcttctctctcctgatttatctctttaaaatatgtttgcagctggtttatagcctgctattgtacctgctcttatattacttatttagagcaggaaaagctataagccagctataatcacaacatatcgagaagaaaagagaagagagaaaagaaagcggctacagatttatagccagctggaacacagactctaaaatgttatgtgtgtatgagaggtgatattaatggtgtagaatatttctatggttaactattgtatgaataagctattggattagctatagatgatttggagccagtaattggctatcctattaaacttgctcttattgtgtaaattaagatatcaatttaaatcataccatttttttgaagttcctaaattgcatgcttttagttttttataaactttggtaagtacatgaagaatcgtgccaaaacttgataatattaccatcttacaaaatttggtaaggtttattttgactgccatctaaataaccccttaattaattactgctagttttaagttttaaccatatgaacctacaatcaaccatctctaaactcggcttcgcagtagaagtagctgctagtgtagtcatctgtaatagtagtggtttattgttttagatcaacaaagggaaatggcatgctgttcctagcatatgtcctgcaggcatgcatgtcctttggctgataaaccagtcgtgctatagtttgaataattttgatgagactaatggtggtggtgactggtgcttttttttttccgtcgagatcgcgtttgagtcgtcgtcgtttgactggcaaagcttggatggggatggaactgttatttagaggcaattaaagtttgaataatttgttactcccttcttttcaaaaataacttaaaaatctaggatatgatatgatttattctagtagtcctaggattgtccaagtgtaaatgtaaaatctctcatagtttaggacataaatagtattacatactccctctgtctaaaaaaaacttaacctcatactacgacgtgacacattaggatgaatctggacatactgtagagaatatccaaattcacatcttagtacaatgttgcctttttttggtgatagagggagtagattgtaatacaggacataaatagtattatggcagtgtatttatcttccttatttttattacacggtaaatgtgtacgcatatatatcactgcagacacaacatcacactgatagaatgtttccctcagagaaggtacaataggaaaaatttatcttgtgatagtgtgtttatggtggcaaaaatggtgaggtggcacagaaatgggaaccttcgtaggaaagtagtatgataagcggccatctatggtaagaaataattcttgaaagcaagttaattcaatttccagtatagtaatcaatcgtcgaatggtaaccttgtctatagcaaatggaacaactagtaaagtaagtacgcacagtttgtgtagacgggcattgcacatgcatgtttatcgcatcaagtgtttggactttagtcctgtcatatcagatgaatttagagtattaaacatagattatttataaaactaattatataaatatgagctaattcatgtgataaattttttaggcctaattaatctataattagctgataacaatctggtccaggtggggttggctaaggcccaataacttaagattgcccggaccccaacagtttataggccaataacttaaagttacccggaccccaacaatttagtttatagcccaataacttaaggttgcccggaccccaacagttcataggcacacccactggaggaaaggcccaatctccctaaaagactagtccaataggagaagggtagctctcccttttaaggtggcttccttctcccaagctaaataaagtaggattattcagaggctcacacggtcgccggcttcctcctaccaagctaagtaaggtgggattattcagaggctcacacggtcgccgtccgacttttgcgtctttgccagcgggtaatagtggaggatgtcctcatcattagcgcatgtttactgtagcatcacataggctaatcatggattaattaggctcaatagattcgtctcgcgaattagttcagggttatagaatgggtttttttaataatctacgtttaatatttataattaatgtccaaacatctaatatgatagagacttttttagtctcatttaaacagagttctctctggggctcaccccgccctgcagctgcttggcctaaataactgtacgaaagctgaagtggattcagaaaccgtggccgccacaatgtttgtggattttaattagaaaaggagcacggtggcacatgcacatgctgcggccccctctccctatcgtgatctcatcatcattcagatgaccactcctccatattattcttaacaacaatatcgtctctaaaataatattgaacttatgtttttttattataatacataataaatatattttaattttttattttagtattttataatataaatttatgtattctagcactattactttaaatacttttagagttattatggtcgaaaggcctttcactttgttattattttcaaccttatcaaattttagtaaaattgctaaaaaaaatggctacatttagtttgctgtcaaattttggtaactatataagaaatccattgccaaaatttggtaagtttttttttcatcaaagtgaacaggcccgaaattagaaaagtttgatcttaatcttattcaaaacgagactgaaaaaattattgatcgtacattgcaaatttagaccttcctaccagaccaacctacatatgggctatcatacggtttaattttatatatccaacatgtaagcaactaagcacacacatgcatgaatgtcagtttgcttgattttcatgtgcgagcggtcgatacaagttgaatatttttgaccatgctgctgagctgcacatttgtacactccaagtctccaatctggtgagtcatgggccaacaactgggttgatttataattgtttttgcatataatatcaacaagtatcgaaggttcggaaacacgcaataattagttcaatatttgttttctttttgtccttacaaaatcgaacgatcttattttttctgatgatactacaaaatcgaacgatcggttggtggttggtacgcgtatggttgtatgcatgataattagtacgactagaaggtcaatgcaagaaaatgtcaacacgttgatgagttgtagctaaaattcgaatttcatgacttaattttcgggttgttttttttagaatttttatttatcgtactctgttttttattcactggcttttaaacagctaataagatgcatatagaagtcttggtcacacattattatttgttactaatatgttcattttgaatggactatcaacgtatctcaggcgatcaagcccgccgccatgatgcgtgtatatatggatgcacgaacgaattagaaacatcatgcattgtgtcggcgtatgcagagttggtggtggtcaaaataggcagtagttagctggtctctgtttcttgcgtacatactgttacttgctatagcatgttgctaaatactttattcctcgagcataagactttatactttattcctcgagcataagactttatagcattacccatataacattcacattatatgcctaaattcattagcatctatatgtatgtgggcaatgctagaaagttttataaccttaaaaggatgcagtattatattattatacatggtttttgataagatttaggtggtgttcttttcttctgaagatgaagatgaagattaagttttttttacgtaaaatgatgtggtattaacgtataattgattgagttttaattattataaacttaaaaaatagattaatatgatattttagagcaactttcatatacaaagttttcgcacgaaacacaccgttcagcagtttaaaaagcgtgccacgaaaatcttaattttcgtccaactcttgttggagaaaagaacgggaccttactagtgttacatactccctcctaacacaccctccatcctaaaataaaataatctcggactaagatgtgatatatggactaactcatattcacaaagccctagattttttggccgagctggatttgaaccagcgtagacatatcgtcaacgaatttatagtctgtccccattaaccgctcgtgcatcgacgctggaaggatttattctagggtttttgataacctacaattaacatactttcataatactcctaccctcaaggaagttgaatcccagctgctccttgaaagagagatgtcctgaaccactatatgataggggtatccatgtatcacattttagtacgagattaatttattttgggattgctctatgtataaatttgttgtactaggatatgtacgatgttggtttattttgagatgaaagatgtacttctaaacatttctgtgatttcaagtgtacaactctgcattccatagtttccatctcttcataaaacaatgtacattcgacggcccatatttgagtcacaacaaaaggctagtttgggcccggcccacctatacaactcctacgtaattggcccacgtgtccgcacatgaatcaccgtaccaaccgcacacgtcatctcgctcttgaatccatctcagccatgaaaaatcccttttctcctctgccgaataaataaataaataaacaaacaaacaaacaaatcaaaaaagtattatttaatattattatcttcatcctgggtcccacacgcataggcagagagcaatcataacttgggtcaaagcgattaaccagccgaagcaaacaccaacaccaaaaaggggaaagcaagcaaatcgcaagcaatcgcgcggcgtcgccgactcgccggcggcgaatccaccgacgagcaatccagccccccaatcccgccgccgcaccaccgcgcatacgatccgccaggttctccgatccatcccccctccctctcccccgttcaattcgcgctctccgcctcccgatcggtaaccatttagggatagatatctattgggaatcgatgattctcgtgggtttggggggttgaattgaatcctcgatgaattttgtgaggtggtgacctgatggttttgagttgattgggtgggcaggaaggaaggaatggcgtcgtcttcggatccatgggtgagggagtacagcgaggcgtccaggctcgcggatgacgtcacc

SEQ ID NO: 72363 - DNA, 1017 bp, Oryza sativa
ctgcaccccagtttctcatgccgaagttttggtgtcagcattcagcaatcctgtgagtcatgcatagctgaaggttcatactgctgcctgtctcatcaaaagttcagattttgcaatgttgtttgggaaggtaaggtctacgcattgtccctaaaacacagcaatttttgtttctcacaggaaacacgtcagctgctgagaaggcaatactgaagacgaaatggtctgtcaactgaatcttgaccactgcagctatttgtaatagacaaaagccaagattgatcataaatcaaaatgaagtgcatggcaagagttgtaacgtgactaaagaagaatgcaaggatcatggaaaaaaagctgagagaaactggcggatgcattgccttcatgtcagtatcaacatatagctgcgatgtgcctctctggtcaagtgatggcctctgtgatggatgatcttgtagaacatccaggaacatggcaatcccgattaggcgattaaacaaggagatcaatctcgcgtgtcatccagcaaaatgatagccagctctgaaagtcaggtccaagttatcacacctcttgagctgacaagaagccaagttagattaacaggaagaggagcagaacaaacgcaccaaccagtctaccacaaacaggacaaatcaataattgaatatcatgcgcggattgctgctggaacaacaacaagagttgatagattcgagctttgccttatgcaacaggtgagagctcctttgcttttacacaatgcaaattccatccatggattgtctctgaagatagggttgtaacatccggcaagaaacatatggccaacatggagcgatctacacaggagatgccatacggtaattgcacatggagaggaataggattctgatgcaaaggctcaaacaattttcaaagagaaaaggaaaacggatcagctcctttaggtcgcaagtttgtcagtgcaattttgtctgaaatgacaggaaataatgtgttgcaccatgtttt

SEQ ID NO: 72364 - DNA, 9946 bp, Oryza sativa
ttgccgtttcacggagtgcctgaagcttcatgtttccttttttaccctctttctttttcccaatgtatcaactgaatgcataattctgaaaataacgttggaaccgcgatgtaactaaagttccactcatgtacactgcaaatgaaaaatcaaatacatggaggggaaatgtttcaaaggcctgtctgctgttaatcatcccatgcatgcaattttcttatattaaaagagaataatgtgacattttctgggacttacacgcacaaatagctgttcaatccgcacgcttcttgactagcgtcacatgcacaaaaagcaaatcactttttccccccaaaaaaaaagtgctgatcaatgttgagatgcataattttcatcatcagaaattaaaaggagtggtccttagatttgccctgccgtttgcaaacacggtgtccttctcctactcgcaagttcagatatattttaaagggatatgttacagatcttcaggaactacagatcacattcaccagccaacaacaagcaatgcaagactaacctaattgagtcatcacatgaatgaaaagattgggtttttttttcctgaagcttttgaggtgtcacagcatgttttccctgcataaaggtgtccctaagtgtgtaatttagggatgtgaggagttgtgtgtttgaccacaaggttaaataaatgcatatcctgcatctccagctaggtagttacagatgcaagacagaaaaggttgccaaatgttatgccaagagagacaaaatatgaaagctagatcaattgttgcgtatgtacctatactgtagtttaaactttcctagatctatgaagctaagggtgcaagcaaccagcttggtacaactgaaacatgaatccaattaattacaccaagaaagcacacataatttgattgacataaaggtatatgtagctaaagtgacctacatggcataaccaccttgacaggctaaccatttcagacagaacatagaatgaccagattagcatcagcatgacagatgagatggtggctgtcagggtcatgcattgcaatggcagggcacaagaaacatcagtgtgaaggcaaaggcagcagacagacatgctatgcgtgtataacagtatatgtaaccaccaaggattgagatactttactggtcagaattcagtaatggatggtgagtgaggaagctgtttatgcagtggattgctgtcctgtctccatggaagcctgcagggtgtccccatggaccatggtgcacatgtggaatgagcacaaaatgttgaaggatagtactcaatctgggttactactgatattctgtgtttgcatatgtttgtgcttgatctctgatttgtttgtttgtttcagtttccataatatgcagagcatgtcattgcatttaaatatagaaacatagattgagtaaatttatatttaccttcaaatgcaattttacaatggatttacctcaagctagtactatatacaagatggcagaggtaattaggaggataatcctgcaaaaatccatgtaggtgcaggtcttaaaaaagagagatgctgtacctgtgatgtctgtccttgaggaagatgagttgacaccatgtttgatgctctgtactccttggcagtgttctcttctcactgtgtttgtccccatggttcattcaaccactcttatgatgaacaggggcaactaaagctcaccttgatcagtacccttaaaagcatcctgtttggtgagatttcagtcatgattcatgaacatggactctacttgaacctgaaagatcggagtatcagtttctgtatgtggagatggcacaaaattgcaggcagtttactgagctgagatgacttagcctagcttagcagattcagagagttcagtctcttagctctattctgataaagcgtaaaaatatgaacgaagcaacggaaaaataatttatggataaaacttttatatccggattatttatgattttaaaagccaatgttaaaagtagaccactaaaaaggacccccaaaattaactatacaattattaagtttcgaaattcaagaggtttttcagacttttgagctgtggtagacggtagacagcaaagctgggtcaggtacagtattgtactgtactgatgatcaggttgtgatctccaactccagcagctagagagacaagaagacgacagaaaagtacacgagctcaactccatttgcagcagcagcagcagcagaagcacagctcaccacctgtctttttccgatccaatcgccgctataaattcagcagccaatgctgcccgccatgtgcagcagaactcactcacagtctcagtctcagtctcactgcttcagctcagctctcctctcgtagctcgacgagctagctagcccagctacgacaatcatgggggacgcggcggcgggcgggaggaaggcggcggcgtccggcggcggcgcgcggctgcacgtggcgatgctggcgctgcagctcgggtacgccgggttccacgtggtgtcgcggctggcgctggacatgggcgtcagcaagctcgtcttccccgtctaccgcaacctcatcgccctcttcctcctcgcccccttcgcctacttcctcgagaagtaattaatcgatgcctaatgccgctaatcctgaattcctgatacgaatgatgaactagttaatcaatcaatcaatcatggatgcttgcaggaaggagaggccggccatgacggcgagcttggcggtgcagttcttcttcctggcgctgtgcgggatcaccgccaaccagggcttctacctgctggggctcgagaacacctcgccgacgttcgcctccgccatccagaactccgtcccggccatcaccttcgccatggccgccgcgctccgcatcgagcgcgtccgcctctcctcccgcgacggcctcgccaaggtcgccggcacgctgctctgcgtcgccggcgcctccgtcatcacgctcttcaagggccccgccatcttcaacacccaccacaaccaccagccgcaaccgcaacagctcgccgtcgccgtcgccgccggcaacaagagctggacgctggggtgcgtgttcctgctggggcactgcgtgtcgtggtcggggtggctggtgctgcaggcgccggtgctgaagcgctacccggcgaggctgtcggtgacgtcatacacctgcttcttcggcctcatccagttcctcgccatcgccgcgttcctggagcgcgacgccgccgcctgggccgtccgctccggctccgagctcttcaccatcctctacgccggattcgtcgcctcgggcgtcgccttcgccgtgcagacgtggtgcatccaccgcggcggccccgtgttcgtggccgtctaccagcccgtgcaaaccctcctcgtcgccgtcatggcttccctcctcctcggcgagcaattccacctcggagggtataccgattaatctctcttgattaagattttttttatttttttagactttttatttttttaattttattaatagacctttctaaaaaaattccaaatctaaacttttcgactacgccgcccaaataaatttgtcacgccaagtacagctagcgtggcagcgttgtcctgccatgtcagtttggcgtggcaaaataacgctgccacgcctggttaagaggtttagttttcggaatttttttaaaaaagatctattaatagaatttaaaaaaattaaaaagtctaaaaaataaataaaaaaatccaggatccaagaactagtaaatgattagtgctaattggatggttaatctgttcatgcaggatcattggggcggtgctgatagtggcagggctgtacctggtgctgtgggggaagagccaggagagagccattgctgctgcaaaagaagcttctgctgctgccgccattgctgaccaccagcagcaaccagcttctgctgctgctgctgattcttgcctgaagcaaccactcctgccggcgtcgacggtggcctcagagaatgtgtgaccgaccaaccatttttttttttttgttgatgcagatgcatgctggcactacatgtggttaggctaattatgtatgattcattaatcaattaaatcaacttaatttccctgttcaagtacttgcaagttgcaacaacctgcagtatgttaaaagaatcaaagtcgttgtgctattactgtgctatacaacagtttgtccagaggatttttacagtccaacgggtaaaccttgcggtatcgaatcttgactgttggatccggacaaatctccaatggccacatggccacagagattggtatcgcggggtaccagttttgtccctgatgtggtaccgtgtgatgattgtaggtggaagggcagtaatgtaattttgcgtgccaatgcaagactgaacataaaccctagaatgagctttgcctctcccaccgccgctgtcctctaccgcggcgccgctggaattgttcctctcccgcgtcactgtcgttcccttgttcctctcccacgccgccagacgcggtggagaagtaggccaggggcggtaaggcatcggctccgacgatgtgcggtgaggcggacgagggagctgtgtatgagcacgaaagggaattgcgtgccctcccgcgcctcggcacacaagctctacacattctttttccctatactaccccttcggaaatggacggctagatctgttttggtacctacaggtacaacttgttggactataacaacgttatctcccccttcgaatacaaaagaactccccctttaaactttctatttccagttgtgaaagatgcattctaagttcgactactaaatctctcaccttctgcttggattgaatgaagagttggaaatatttggcttttctatcttaattacaacacattgatggctagcttcttatagccatcctaacttttttgtacggtacccttaacataggcatcattgggacttaagaatttttggaaaacttttatgcatgggaatttaactaatttctatgaaaataacataagatatatacgttccaaaagagcccagcttagagcaatattgatgcaacagagcaccgactgacagatgtagctcaactgttcctccaaatcgaatgtccaagcatatctcttccactctttttttttaattaccatatatccggaaagttctctgtggagtgtgtatgtataatatatcttggaacttgcaactaggcaattcttgacacacttactttcaaaattaattcagatacacctgaactacaggaagagaaatagtactaacacatatagcaaccatgtctgacgaaactgaataatacataatcaggttggagcaacaaaagataaaccccatgcatccacacaaatcagagaatatatatatttttgaagtgtatcagagaatatattaaacaaaagcagaaaaggcacaaggtacttatattcatatatctttttttttcaaaaaaggagaagcactagctaaccaatggtgttccactaaaaataaagcacgatcgagagagaggagcaggagagcatggggggaaaagcaaatcatttttctgatgttaataaaaaaaggagtcgagtggagtgaactgtgaagcatttgtggtgaggatatccatggaagatgccagtggcagctatagctgctgcctcgccaccgtttcattcctcgagtttatccccctgggtcgagccgcctcgccacaatcctttctttctctataaattcatcatgccatggctgctaatgctgcagaatggagctgagaagtaaattcagatcagattcagagagagcatgcagctgattgcaatgtagcttcttccatcagggggtgtgtactgctgattcctcatgcgtcgtcggagatcgagaggtgatgcatgctgcgaacggcgagcggcggcggcggcgacaggaggtcggcggcgagctccggcgtgctggctggcatccggcgatcgacgacggcgaccgagggagggaggaagctatagctaggatggtcatcatgtgattaattcagtgatgtgtcctaattaagtagcttcttgcttgctagcagggcaatttcaatcctttggcatctgtaacctttttctttctttctgaagtaaaccttaataacccagctatgttctcttatgatgttctgagcaaatacaacaaattaggcatacagattcagatacaatagcacttgagtttgtatctagtcgtttgtcaagagccaagacacatttcttgagctatttgttctccagctatcatgcaataaaaaggtactatgatcctatcattttcaaacttatgcttacacttataagtaaaaatttgtattttaaaattaatttcggggtttggttttatgttttttttctcatagttcattttatactagtatttgcttttaaattgctaaggacacgtatgtaaaaaaatacctacaaattactttttaattactaataagacgtacgaataagcataaccataaacaaaacgctgagtccagtagtatttcaaacatgacacaactgagaaatttggaggttttgtttgaggtggtttttcagattaagtccatcaaatcagatcgagttttcagtcaggtttgaagtagccgatcccaaagttcgttctttttcatccggtcacagaaaaacatcaagggaacgaacttgtttctgcactgactttcaggcaatatgtcattaatcacaaaaaaggaatactgacaaaataggagtactccagtaactgcatttctgatcccgaggatgaagagacagctactacagctgacaaaaataactgcacgcattcatcactctgctgcttgctgttgttttctgtggcagctaaacgctactgtagatttccgtgattctctccttgcagaaaatacaagtgcgaaattaggaatcggattataccggtcattgggggtcaagatactccatttcagaatttcagacagagacaagtgtgacaggtacttaacctccaacttccaaatgcgacaatttccgttaatcaccggatcaaagttccaaatgcgacaaacactggatcaagttccagctacatccaaatttttttgaaacgaccgagtgatctagagtagagatagagagatcagtttcagtatgggcatgtttgtgctccttaattgcttgctctatgtgagtcttcgccagtatcagtcctggtagttgtagcatcatcaacagcaatgagaaattgatgctagtatgacatatccacagttaaccatgtgtgtgacaaattgccatattccttgccaatctacagtctgttcttctattttctaaatttgtttcatgaccacgtcctatttttgctaatcaaatacggttgatattactcaattgttctagaatttttttcttcaaagcccatggttagatattccaatatatcacgatgcagaggtcggaagtgtgcttttgttatctagagaaaatgttccgatctgttcaatatgttcttgcttcctaccaaaccatatcttcgatcgaaagttaataatggaaaatggttaaattccagcttgaaatggagatttgggaatcacaattttacagccttgatttaattttaaccaaacaggatatattccaatttggggattacaattctatagccttgatttaattttaaccaaacatggatatattcctttcctgttgatacacaaacccgagttagtacactcatatcatgcaaatatcattaatataaggggcctaaacgaaaaaaatatccctacccgtttttagcttaaaagcccacctcctctttcaaatttaccattcttcctcacactccaacctcctcctgtctccttctctctctcttaaaaaaaaacgcgacgaatccgacggaaaaatcggagaggaaaatccgcgccgcgaaaccaaccgaggtggtggtggttagggtttgacactctcaccgcccccgcctcaaccgcgagcgtctccggcggcgatcccacgggccgccgcgcgtcggtggggggcacccgatcgacctagatctcgcatgagggagccccgaatcggccagatctagggagctcttcgcggacatgcagcccggcgaggcacccccctcctccgggggctcgccggcgacgtcgccgcggccgccgccggcggtggcgcaggggcagcagcagctagggtttaggaatcaggtgagtctgggctctctctggtctgccccaccatggcgttgggattcgaattttttttgtgtggtttgggggtttgaggttttctctactgcggcctgcgcgcgacgtgattggtggggaaccgtgggttgtggccgttgggatttgggaaaaaatcctgacgcgtgtggcgaaaaggcggcgcttttttacgcgcccttccctaaacagtaaaccgcgagcttcgtcctctcccactcactggactgcgaggtggtggctttgccttgcctcatgtgatttttgcctgccctgtttctgatgcttgtccggatggttctaatttccgtgtaattttgggtttggaaccgtctgtgtgtctgatttgggttgaggttttggggggcattttggtttcgttctgtctctctgtttgtatgggtttggtttggtgtgttgatggaatgctccaattgcgtggttggtctaaacgggttggcttgtgttgttgcaggcaatgatgcatcaccatgatcagcagcagcagcagcagcaagggtacccatcgggcgcgccgcatggtatgatgggaggtggtggcagcagtagtttccctccgtcctcaggcccaatgcccccgttccagggccagaggaacatgccgctacccggtggaccgcagggtctggctggaggccagcagcataacccgacggcgatgcagcaagcatacctgcagtacatgatgcagcagcagcagcagaaggcccatgggatgctcctccagcagcaacagcaggccaagatgaatatggcagggccatctacaagggaccaggatgtggctgccaacactgcaaaaatgcaggagcttatgtcccttcaggctcaggcccaggcccagatgttcaagagacaacaatctgagcatcttcaacaggcagagaagcaggcggagcaagggcagccgagcaatagcgagcaaaggagtggtgatatgaggccaccttcgatgccaccacaaggggtccctgggcagcagttgtcatcggcgggtatggtgaggccgatgcagccaatgcaagggcaagctggcatgagcaatgctggagctaacccgatggcaatggcccaacttcaagctatccaggcctgggccaaagagcacaatgttgacctgtccaatcctgcaaatgtgactctcatttctcaaatcctaccaatgttgcagtcaaacagaatggctgccatgcagaagcagaatgaggtaggcatggcgtcacagcagcagtctgtaccctcacagatgaacaatgatgcaccaggacatagtaattttcctagtcagggtgccccatcgaagccccgacagcctcttccaccaagcacctctgtttctggtggggcagagcctaagatgatgaatatgagcaacatgcagatgcaacaacagttagcagctcataacagagatagctcgaatgacagggctgcgaggccagccatgtcaatgggcaatggtggacaaatgatgcatatgccccaaagttctggacatgcaaacaagattcctgagcagcccaatccaaaaaatgcaaattccgaagcaatgcagatgcaatatgcaagacagttgcagcaggctaaccgagctactgccccttcagcaaattctggtg

SEQ ID NO: 72365 - DNA, 9267 bp, Oryza sativa
tcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggatcggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttttaaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagataatgacaatgatgatgcaacagatgcagcaacagtaccatcaggtgatgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccggctggggcagaggttacttggacagagtttcgtcatagtttcaataaagcacaggttcccgagggaattgtgggacaaaagaagagagagttccgttccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtgtaacaaaatgaaccgtaagaggaaggcagcccagttcaggactccccaggggaagtgtcagaagcctcgttacacgatgggacgtcacggtggaccttccaccatgattatccgacagcaccgtccctaccacccgggtagcttcaataagacccaccatagtgatagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaaactagaggatattcctatagtcagagagtatccagaggtttttccggatgatctgacaacaatgccaccaaaaagggatatcgagttccggatagacttggtaactggaactgcaccgatccacaagaggccttacagaatgggagccagcgagttggcggaagtcaagaagcaagtcgatgaacagttatagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgttgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtccccatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatccccgacagcgaagatggttggagctaattaaagattatgatatgggaatacactatcatcccggcaaggctaatgtggtagcagatgccttgagcaggaagagttactgcaacgtcgcatgggtagaggaactatgctgtgaggtacaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggcagtaccaaaatgtaccaagaactcaaagaaaagttctggtgggtcagcatgagaagggaaatagctgaattcgtagcactctgtgacgtctgtcaacgagtaaaggcagaacaccaaaggccagcaggattgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattaggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcagtctcggcagaaaagctatgcagacaaccgccgaagggagctcgctttcgaaacaggggattatgtgtatcttcgtgtcactccgctcagaggagtacaccgtttccaaaccaaagggaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcaaatcaaaatccaggaagacttgacgtatatggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttcttgggccgtcggcccagtccacccgtcgcccgcgctcggcctccccttgtgggccggcccgttcccctttcccctccccgaagttctccctccctccctctctccttcgggcgccgacaggtggggcccacctgtcggtcgtcttcctcctctagccggttggagccgagccccaaccgccggggccccaccttcccacgccggcccgctttttccgtccctttccgcgcccgcacctcgcgcccacgttggcgctctccccccccccccacattttccgcgcgcgcgcgcccgcaagtggtgggggatttgaatccctctctctctctctcttcctccccactcccccacatcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccacgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgcctcggcatcaccggtcgtcgccgccgttttcttccttcgcgccggccgccgtgttcgccggtgaggaatcccctctcctcctccttccttccctccctcccatgagcgccgccgccctccgcgcgtgtgccgtcatcttcggccgccgccgccgccttcgcactggccgccgccgtctcccgcgccgccggtcaccgccggtgaccgcgcgtgtcgccgccggtcgccatggccgccggtcggctttgaggccgagccgagcccggccggcgcctccctcgcctcccctttgagccaccgcctggtggggcccacctgccagccgccccctccctctccccttgtgccgctgccagtggggcccgcatgtcgggccgcccccccccccccttggatgacgtcagccctggggcaatattgcgcaataattaattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcat

SEQ ID NO: 72366 - DNA, 680 bp, Oryza sativa
caatgcactgtagtacaggtgggttggttgggcctgttcaacgtggtgtagcgttgatcagtggagatctaatttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgagctgaagacgaagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaaagtggtatcagagccaacttgactgtaggttgagccaaacggtcaaaccctaaggacaagctttctgaaaaccctatttgaaaaatgtctcctctcgcccttcggcatttctttgtcaaacggtttttcaaaattctcctcccaatct

SEQ ID NO: 72367 - DNA, 750 bp, Oryza sativa
gttgatcatgagcagggttcatttggcgttgggcccccttgcagctttcaattaaaccattgatctgtggctttaattgatcttatctctgacactgaccatttgctgctaggacgaaagagaggtgaaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttgacaaagaaatgccgaagggcgagaggagacatttttcaaatagggttttcagaaagcttgtccttagggtttgaccgtttggctcaacctacagtcaagttggctctgataccactttgtcacgcccagaaatttagcccaaatttccagactattttgtgtattaaatccctgtccaggaccagccagggtacacaaaacgacaagtaataaacagttccaaa

SEQ ID NO: 72368 - DNA, 694 bp, Oryza sativa
attatccccagacatcaacatgacaaaacagttgttggctgtgtacacccccaaggtgtaaaggccgggttaatataatcctttatcttaacaaaagaacatgacaaaacagaggattttaatcaggcggccactgttatacagtagcttgcgagttgttgtctatgaaaacgagacgtaggtacgtccaaacttaaaagaggccgagacagtgagacataagtaaaataggcgaagttggtaatgtcttctgtttgagcaatactctcacatcactgtatcacaaaataaattcattttttatctattctatacataccaatagaaaaaaagaactataatattctcactttatcaaattgtaatagaattattctatactctagctatctgtttccaatgtgtttataaatttattttagaataaataggaagagaaaaaaaataatctttttttttctgagatactatagtagacatgaacgtgagctcagcttcagtggtcacaactcacaacctgcaacgacgtaaaagccacggagaaagcaacaaatctacctctgaatcgtcgaaatacggaaccataaacacatgtttggcatatagagttaatgtaacctcgtacaactgcagcacaagtggccaggctccattacttcatcggggtattatacggtgggtaatttcttcacct

SEQ ID NO: 72369 - DNA, 1622 bp, Oryza sativa
cctcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacacgggctccgaaactacacgcgaaacgggacaactcaacaaactgcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaatgggccggccggcccaagcggcccaagtgcgcgcgtgctgaagggaaggagagaaagggccggtggacagggctcaccgtgcgcggtcccgggtgggacccgcttgtcagcggctcggctcaccgtgcggagggagcactcggcgcacgcgcgcgggcgggggaggaacgtggtgcacgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggctggcgggaggtagacgacgacgccggccggaacggacggcggacaacagcggcgagcggcggagcgaaccacggcgataccggcgaaagcgagcacgccgggtggttgcacgagacgaggggagacgagccaacggctcggattcgccggaggaagcttgacggcggcgaatcgcggcggcgacaaccggcggggagggaagagggaaacggcgacgaggccacgaggggccgattcccggcggtgagagcatccacgcggccacgggaatccgatgctagcgtcggattgggcggagctacgccgatcgaggctggcgacgtgcgggtgctacggagctcgagcggcgacggtggcgagcacacggcgagcgacggcaatggttggggcggcgccggctagctacggggagtctactcgtgctaccaccgaagactaaggggggagatggagcgaggaggaagaacggagaggggcactaccgtgcgggtcggggcgctgtgacgagaggccgatggcgcgggagtaatctctccggcctcgggc

SEQ ID NO: 72370 - DNA, 686 bp, Oryza sativa
acatatttcatccagccagattatgatttaggcattgggtcttgtaatgatcaggtcgtggactaaatcaaagagataaacgccttaagtctaaccatatagcgtccctaatcatatttattcagtagtcattatcgtttagagttgggttttgctaagttatttctgtcatcgtagtttcgtcgctagttcagtttgtgcaaccccaacttcgaatgcttaatcataatatgctaattcagttgttgtctaccttgttttttattgtgttcatcgattcgcatgcagggattaaccttcttggtgagattaaccgggcagcgcacggtttataacatgaggagacggttgcctggttgataacctgagtaaacgtggtgttgcgattgcaggattcagattgtgtcaatcggaaaccggatcatgtctctcaagtttccaccaaagcgagagctatcagtacctatcaaatcatatgacctagttgctctcatcagacggtccaaggatctgtttgatttggtgccaaatttttacctatgtgttaaaatctttacaagttttaacattatcaaatttaattcagtatagagactagtgtggataaaagtgggtaccagatcaaatatttactttatactataaaattcatcaccatttaatatgataaaaataaaaaataattt

SEQ ID NO: 72371 - DNA, 8650 bp, Oryza sativa
tgatttgagtaaattatttttgtgttcagggccctggcaggtcatgcttaagcaagccgatggttcttatgcatgtgttgcagagagtgcagctcggttcactttgggacaggtcatacaaaattttgcttgcatgaattagttatgtcattttggagttgtggtgtatgatgttccgtgtttttcattcaggctaaggaagaactgttaagagttcttggtttgcaagaagaacaaggaagctcactagaatttctcagaagaggatacaaggtttgcatctttgtctcactttaattgtaaaatgcaaaaatgattagcataatcagcttcatatcatcatgctgatttcaaatgattcgttcgatgtacttctatccctgccacctcatgtgcaaactccaaattcaatatgaaagtttaaacttcattatcgtagcaggctagcagcctgtctcaaaataaaactttaagctctattatggttgcacctccaaagtaccttttgcaaatctgcatttcgtcaagagctagcattgttttaccatctaaagagttaacctgtaataatgcagaatgctacttggtgggaagagaatgttgatcaggagaaatcgtcagcatggcgaacttgaggttgaggccctgctgctgccttgtctgggtgctgatctgattggcggcgagtgcagacaggaacagaagaaaaaaatggttgtctgaaattgcagagcccaggcgacaaggatgcaaattgcctgtgctgcaattgtacattttgtgattgtaacatgttactgtgtgagtaacaggcattagagttttgagaggattttcctttctttttcgatgattatatatgtgttggactctgcttctttgaagcatgaagcaacttcacattttaaatggaaattcgtgttcatccaattgtactttctccccctccctaaaaagcaatatgaatggaaattatccttacaaaaaattgtttcggccactctggagattattctttttcatgctaaaatatgattatgattatttttattttttatcaagacaacattttttttcctttgtgatgttctcaaacacgataagccgtaggaaaataaacaaagcaataagaatagttcattaataaaagtgaatgctggaaaatagaactatcataaaaaaatcccctaaaattaccttgaaaataaagttttaaaattcgaattttgactttaactggtaagctaatatggtaaatatggtaaggttatgctcgttaagtattttagctttaaaaacttgaaaaattgattaatatgatctttttacaacgaaaaattcgcaaaaatgcactatttaatattttgggaaatttatgcgtcaaaaatgaggaattagaagttcgaatctagtaataagtattggcaataactctcagaactccagaagcttctattagtagggacctgtataaagatgcgtgagagctcaaggtcccatctgcaaaaacaccaccgcgacgaacgagcgaagaagtgggaacaagacttcaagagagagaggagagagatcgcggccggggacggagacgatggagacgcgacgagcaacctacagatccgccgcgctcctactcctcgccgccatcctcgcctccgccgcctccgcctcctccatcggcgacaagtgcgccgcctgcaaggccgttgccgtcagttcccgtattcttttctttctttttttttttgcccctctcgtcagttcatacgcgcacaattcactcatcctttggagcaccttgaagcaatttagttcgtattaaaatcgttttataccaggatgggaagaaattagcattccatattttccactccttgtgaaggagatcgaggcgtactgtcctagatctccaaacatttcctcggacattgtagaatttccaaagcgcatcgtttcactgatatggagtgcgcattgtagagatctgatgtatctgttgatcttgtttgcaggcagagctagagattggaatttcaagtgtgagtgaactctttttctgtctgcttttatttaactattctgtcataatttaaaatgctgatttggagtttatgtgtattggaaaatagctctgcaagtttcaaaatgattcaatatatttctttctgtaaaacagcagttcccataaacataatagcataggttcttctactgtccttgttattgtcactattggcaaattattaacttccaagagttctctaatgcaggagaaaccaagaaatcacttggacttgcgcaaccgcttaaattcaaaaggtcagcgtgaagggaaggtcattgattacaggtatgctaaccagcatgatcccttctctgctcaatcatcaggggcaacattcctatgtgttacaacattgttatcatttcatgtttcaacctatttgaatcctaattgtttggaaaccctttgccgcatcctttgttctatttacttgagggagagcgacgtcgtgtctgtcgtcccctatctctcattcgcacgagatttttctcaagggtgagcgtcacgagcgcatgtgagcgccaggagcacgtgtgagagggaggaaaacgggaaaatctggtgttagtttaacagaagtgcccacttttagttttgggatattttaggctttctcttggagagatcaattttttcgctacctattttcacttcaataagccaaaaaagaaatctttgggggaagattatacataatctcctagtgatgttcttagggactctttgaaatacagggttccaataatctaggtgattttagtgccacattttccggaatttgggttatcccaggatcggatcctatatcccttattaacactcccgataatctgggtgattttagtgccacattttccggaatttgggttatcccaggatccgatcctatatccctaattaacactcccggcgattctacccaactaggattaaaaaaacgcgaatattagggaaggacctaatatcaaataattagaaggggtgaggcttcgaacccaggtcgtctattccaccaccttgtggagctagtcggaagactacttgagtgtttctcaaaagagggatgcaacaaaggactttctaggaggtcacctatcctagtactctaggattacttatgattcttgaaaatccaactaattaacattctttgaactaaatacaccctataagtgtacatatataaataaaaaacaaatctataaattaaatgttgtgtcgtttaaattccaattatatcttgaaccacatgaaaaactcacgttacctcttgggtcacttgatgacatgcaaaaagaacaaattttaagacaataaggcctggtttagttcctaactttttctttaaatttttaacttttccatcacatcaaagctttcctacacatacaaatttccaatttttccgtttcatcgttccaatttcaatcaaactttcaattttgtcgtgaactaaacacatcctaattggaaataaatgatgtgaaacccaatgcgtatttcttagtatttattgggaaaagaaaatacttcctccgtcctctaatataagggattttgatattttgtttttaccattcatcttattaaaaatttgttcaaatataaaaaaatgaaaagttgtacttaaaatactttggttaataaagtaagtcacaaataaaataattaatatttttttaaaaaaattattaagacgaatagttaaaccgtacgaatagttaagaggacagagcctacttttgtcaacgagttggagttcgacgtggagcagcaatgaatagccacaaagtacggtagcttttcccatccacgtcacacttcacgctgtcacgtcgcgatctgctctctcttcccactgcagtgctgccgcgtgagcgtgaccgcgtcgtcgtccacggcgagctcgacaccatggccgccgccacggagcagccgcagcagatcaccgagatcgagcacgcccacctccccgtgcgtgggctcagacatctgcttctatttttcaattgcagtatgggcataagctcatgataatctgccatatttacatatgcatacatgttttttggggagaaatttgtattgatcattgttacttaacactaaatgtagagtctctttgtcattttaagtttcatttggtttcacacatacttgcttaatagatgtacaaaacttaccatatattttgtattggtatgtctttaactctgtttatgtggtgcagagtaagtgagcttcgagttgttgagcttctggatggcctatgtgataagatgcaagattataccctgcagaaggtagaaattccatccaattgttttagcattttttttactgcatactatgtccgcatttttgaattttgagactgaccttttcagttcactttttatattaagttgtaatataggtatctgaacttgttgatctggtgctattgtatatgatgcctgcatctgtccaagcattttagccatctaacaaattttgctgtatgcagttggaatcaggagaaaaaggatgggtgaaagtagcagattggaacagttttaaaactggtaatcttggacatttttatcactcgtaaccgcaaaataaatctggagccctgatctgtacattcttgtactcaatatgttaattcgcttatcctgtttaatagcactcttacacgaccatctcaggcaatggtgcaagcacttgatttagactgtacatccggagactatagcctgctttgttattttgagcattgttaatatgctcaccatgataatacaatatacaaacaagttttgcatacattattgagacggtattcatcccatacgtggaaatgaactcaatggaatatatttatgctaaatgagaagcaaacaacaggtgctgtggtttttgcaatgaacttatcacaatagaatcactgaaatagtatccaaaattgctagctacctgtgtttctgtattgcatttgtctcagtgaaagtaataaaacagtatttccaaatactaactgtggactactcacttcattgttcttttgtagaaaagaaggccgcagcacgagcacactccaaaaatttatcctcattctgtggaaggtatgacaaacaatatctatttcctccctaacccttcttgattttttatttgttttttggatttaaaagttgttttattgcatatctgacctcttattacaattttttaatagcacttcttgttgcaaacactttggaacggtgtagtttctggcaggtgtcattttccatagataaaagggcctctattctcacaaataaatttcattatgttgaacttaaattagattatttatttttaggtgcatcgtacacaaacataatttcataaaaaaaatgagtacatatctgtccacataggccttttctggttactaatattttttttccttactggctaatgttttttttattgttgacctgatttatccaggatgaataaactcttaataatctatatgctttgaaagtgagaagttattgcttgtctaaaaataaccttttacacctttacttcttttggtttctaatttagactgttgtgtactgaggggatgaactgacaaagttcactcatggtgcaggttactggaggaaactgaggatgaggtaggctgcttctcttggatgacatttatacattactttttttatactagcaaatatcgtctgaattttcccgtttcttgacagctgtgttttgttatgaactatacagatctatcataatttagttaaaaatagggcctcatctagagctttttttggttgcagctttctgagtggataaaaacgagctccgcagaatcaggaaatgtcagcagagcactttgtgaagatattagcaaacactgtcagtctacaaggtatgtgctatgaatatgaatcgaacattttgtcatcatgaaataagagattgctgtactcgcagaattttctttgcagacctctagttcactaacaatcctttccctctgtttccagtgctaccatcgagatcgacgacgaactataacaccaaagcattctggtgccatctttatctcacaaagcaaagcaggcgaagacctggaaagcgtagaggaacaaactcaaatagtttctgatttcatatgttgtatcactgcaattcatgtccttaaaatgggagaattgcaattcgttccatatagtgtctgtctatctggactaatctgttgagaacattcgaacatgagacaaattttgcatactaaaattacggttgaaagcaacacagttaactgattcagggggacttttgcaaaacgcctatttctgatgcaatcatggtttgcaataacgattggttttttgcgaaaatcacttggttttcgtgaagttgctggggataggtttgtaaaaactgagttttttttagccaattattttattatgggcttgaccgaaagtcattggtttttatcgggtttcattcggtttgcggcacaccgacagaagtataactagatcttgttctgttttcagatatagtttacacgaaggtttcccagtgtttaagaaatcattcaagttctgcactgaagaatttccacattccaaatgggctccatgaaccaaaattgtttttcattggaggtgtagtgtataactacgacgcattcctttcgcatgtacccatgcatactatcttgtgaaatgctcgttgaatcaccaaattatcctccattaattaaaaacccaaacgatctcgtagtaattcctattaaattcatgtaatattccaacagagcccatagtaattttgagtgcaaatgcagcaatactttgttatgtactaccaataaaaattccaacttgcaaaaaaggaaaaaaaaacagagaaaagttacaactttgaaatccgagaccaagagcacgcggaagttgactttgaaattcatcaatttgagtcctccgatttttccgaggggcaatatgcaaatcgcacaaaaaaaatgaaatttatcaactcgatttcccctcatttattgactgctactagtagtaccactatagaaaaagatcaggtcagaattattattacagtaaataaaaaagaaaataaatgcaaagatagaagagaatagtagtagtatagtgagtctcgtcgcagtgagagagagagaggagtcgagtagatagatagatagatcggcgtgggagaagacgacatcgccggcgacgagaccagatcgatcgccgaggtatcgcctccctccccgaccgagcagggtcgccgccgttcgttcctcttgctgcttccgccgcatccatcctggtgagcacatcctcccgccaccgccgccgatccccatccatcgcgcgagcgagtcagggtcgccgtcgttcgcccttctgcttccgccgcatccgttttgcgttagcccacgcacttttttttcctcagatttgcgttaaccctagctctagctgctcctgttctagaaatttgccttggccataatactaatagcagtttgtttgttcccaaaaaggcccatgtcccatgttagatccgccgccactgtgctactgatcttctccgaattgtataatttaacgcatatgctcttttgtatctcagcggggactaaaccttgaagcatctgggctgttgtttcaccattgtagtggattccacttcggaactgaacttttctagttgtttccgtgacaatgaaaactcacgagagagctgctaatttggcccttgcaggtatacatttgtattcggctgagtcatcacagcattggttctgtttattaccattttctagtcctttgaacaaactgggtatttgctgagctgcagttctatgtattctaacattgtacgcaggtttgagcttggcaccccttgtggttaaagtagagccaaatgtgaacgtcatattgacagcatgtcttgctgtctatgtgggctgttaccgttctgtcaagccgactccaccctctgtaagcaatatgcttcagtttgttttgttatctaccgagccatctgctgggtgctaatgtgataggttgttcacaaaattttctgcatatggctagaataacttgattcctgcatttgttcttatgtaggagacaatgtccaaggagcatgctatgcggtttcctttggtgggaagtgctatgcttctctctctgttccttctattcaagtttctctcgaaagacttggtcaatgctgttctcactgcctactttttcatccttggcattgccgctctctggtaagtccaaactctccttggaagagctttttcattcatgtaactacttaatactgtatctgtgcaattaagattgttcatgtgcttattttttttctgatgcagtgcaacattgctgccttccataaaacgattccttccaaaagaatggaatgataatgccatcgtttggtgtgctccatttttccactgtatgtctgtaggacccaaacctcttcttttttttttttttgctcaactcattggttcaattgtgtatcatatgccagattgttgcatct

SEQ ID NO: 72372 - DNA, 19466 bp, Oryza sativa
gtaaaaagaagatagatcagcaccttcctccttcagaaaaaagcttcaagatgttttctccacttgaggcctgtctactacatacacacactagacagatggatgctgctccacttaaggcctggcattcattcatttcattcatgcatggcattcagattcagtcattcagggccatcagaagcaacagcaagtgctgcaatttcttttctacctctcctttatgccccttccacaaagcaatggatggattccatttccattccattccattcctttttatcaccaccaacaacaaaaatagtgcatgggtttgcaaacacctggaaatgtgccatcctctagtttattgttttttgccatttgtatatatttgtgtgctagctagctagctgatccaccactacggcctcattgcatctctgatcactaccagaaggaaaaaaggtattgaaattggacattatagtgtggttcaatattatgtgtcaaactaggagtgctctgtgggaagcttaggcttcaagtgtggctatcagtaggtgctagacactctagtcacttattgggggtaaaatgatgattcttggaaggtgattaattgacatttgtgcgaactagctagctgtcatgtctgtcaatggattttatgcatcctatcttttctgaaaataagagactgtcaacttcaaggctaacaaagtggcatgtttgctcatctagtagattaacaaactggatattgctgaagacataattcgcattatctttcttgtgataggcagagaattcgttggtcctcaagtttttgtattattacatactagttacatgcccgtactttgcaacgggattgggtgatagaaatatgattaaatttccttctatgccgggttttcacgatgcattatgttttgaggtctttttggagtgtttttttaagggaaaggaatggttttttagaggaaggaagttttttttttggaggggaggaaggaggacgacgaagtagttaagagatatgggtatacattatatgtgtaaaatcctagagttacatttgtgtacaaatgtaagttcttttttttcgccgggaataagttctttttttttgtaaaatgtatcaactagaagtaaaaaatatatataggtgtggaaaggagactatatatgaagtggcaaagaagatttccaacaccctttgatatctctgcctctcaacatgtggattccaccatcctccacaccaacatattttatacctgaacaaaatagttgacatgctgtgagccgttccttccgatccaatgctcatcatgagattaaagaaagttaattccagatgcaaagcaaaaggcagcaccataacatctcctaatatgcccaaaaaggaagaattagagatatattagcacactaaaaaaacatccatttgatttgcctcagctctaccctggcaatagtagtgttgtctctctgaccataaaaatcatgctgttagtttatcatatcctcaaggaacatctttcggtgtcttgcactctggcatttgtcatttgatgatgctgactttgcaaatgcacatctattactagaatactagaaaggtgagtggaaaaattgtgttagtggaaaagaaagctggtgttgatgtgtgtaattgaaaatacagtgcttaattaaagattgcaactatatgcaaccatcttgtgaccaaatggtaagtaacaggccactttgcatctgatcaggtggtcagctgcaaagtatgccttttcttcagagtagtcatgaagcatgccttttggtcttgtgatccaagagaacactgaaatcagagtttttctttaaattgacttatactagcagctggtaaagaaagccattggagtatacccgaaggctgttcatttgatttagcattttttgcttttatataattagcaaagttgatcttgaaattttacattttggaacaatccgtcgcagattcgtcgcaaaaaggggcctgcccaatggtcaccaagtattgtatgagcctgaaaaacctacatgagttagtatggtttacattgtaatgttgcaatttactgttgatcatggataaatagctcattcaggtaatcatatatcacaagtaatgcgtgtcaatccagccaagttaagacgttgaaatccttttttattttaatgttggaatgattgcagtaatccaacaactgttctttttgttatcaacaaccttatttttttatcatgaatgcactcggttgcttcctcctgaaattctctttaagcagagtcagaagcattacgtaatctgtgactgattatattttaatcaagtaaatgatagtaataataattattttcatgggtgaaggtacttgtggtgaaactgttctaagggctcaatcactatgtgaacattacatcatttattctttcatatagggacatgattaaccaataatccaggatatatagtccacagcaaaatgcaacaaataaattacccccattagtttgctaatttttttaagcagacaagataactacctagtatattaattaacaaacaaggggatttatttatagtacataaactgaaccccattaaattcattgtagtacatttgtacctatatatatgtttccttgctgttcagaggtcaaccatatcctaaactaatctcgggttgttacctgaaccagaagtgcttggcttaaatctcacataagtactcgtaggtttggatgacaaatcaaggtactagtagaccaaagagacttctgactttgcagatagatgcgtgtatgaacagacaaaggaagctgataatcctatgtaggagtaatctttaagccatcagtgtcggctgttttctgcaaaagacagagaaaactgatttcttaggaatgcacaggacgtagacttgaattatttgccagtagatttttgctgttttttatgctacttgtcttttcttttttccttcacttgaacagagtgttatgacagggagagcactgttataatgctctgtttacttttgacagtgaaagagtttgataactccgagctaggttcgatcactgatcaatatgtgttaacttctttattttgttgaaaaatagagtttgtcaccggttacccttacccatggcatgatccactcccattccttcgaccattattaagacaaattttacagtagtgcctactagtattagaattaatcgctgtgtatctgcctgtctagaagttagtaatgaattgaaatccaacctcatctgttgtatctgcacttctcagttattacttattacgtattaccgtctctgaaatgtgtaactctcgtctctgtttaaatcaagcagagacaaatattcctttttagcaaggcgaactgatttttttttgttatttcacttaatctgttgcaacacactgtattttgctagcactaagaaatgtacagagtaactccactgacggattaagcgataaaaaattcagtaattctacatgtattcctgttttatctagaacatttgactagactgattctaaaacagctgaataaaggaagaaattgccacgaagaacaagttacaaacaacttgccactagtatgttttgctactaattaacaactttattgatttcttcttgacaccggaacgtacgggagattgggcgacttactaccatctgatcatcttatgttgacctgtgctaatccctccagtgcaatcgccaaatggaggccatccatttcacagattaattatagctgttaattaatctctgctactgacactagtgtcatccactcacatccgctgacttattccctaaatcaccgcctgctaaaaggtctcctctcctccatctctattgcccactaaactaagctccatcatgatgtactataacattagcaggaaaatgacatgaaacaaaatgtatatccttgttgtgcttcctaatggatccaagaaaataagccaaacttactaacaaaataacttaatccctggtttcataattcttgatattttgaataagattaagatcaagacaataagaactttgactatcaacaaattttaaattatttaatttaaaaacactaaaacacgatgtatagattattctcgaaaagaaatttaacaaaatcaaacatttttacttattttttatgtgttataatagaaaatcatagttaaagatatattttagaaaccatgtagatatccaaaacctgaagaactatggaaatggagagagtactctgatacagagactacgtctgaacgcaacaatttcacatgaaacaaagagttagatttactccatcatcttaaaatataaaaagaaatagtttggtccctcttcctagttcatttggtctatagagttacatgacctagaaaatgaaaagacacgtcagtaagcaaacaggctttgaaaacaattaacctggagaaataggagtttaggacagctcatgaagctagtatcaaacttaaccaaagagtcaaaccccagacatgctagtagtcagttagttaaccaaccttctccctcctctcttccacttcgtgcaagcatgaagcttagcaagctcaagctggatcggatcatctgatgtgaattctctctcacaccaattcaccatggatggatgcccatgaccatccttagctccaggaagaagaagaagaagtgaacagtagctatagccatgggaagcagaggaggagctttacctgttgctgtactggtgctgttgctactgctggtgctcaagaacggcgccgcccagtcgcggtgcagctccggcgacctcgccgcgctgcgtggcttctcggccggtctcgacggcggcgtcgacgggtggccggcgggggtcggcaacgcgtcgtcgtcgtcgacatcggacggtggcgactgctgcgcgtggcgcggcgtggcgtgcgacgaggcgggggaggtcgtcggcgtggtcctgcccaacgcgacgctccggggagtggtggccgagtcgctcgccggcctcgccgcgctccgggtgttgaacctgtcgagtaacgcgctccgtggcgcgctcccggcggggctcctccggctgcgggcgctccaggtgctcgacgtcagcgtcaacgcgctggagggggcggtggcggcggcggccgtcgtcgacctcccggcgatgcgcgagttcaatgtctcgtacaacgcgttcaacggcagccaccccgtgctcgccggcgccggcaggctcacgtcgtacgacgtctccgggaacagcttcgccggccacgtcgacgccgccgccctgtgcggcgcgtcgccggggttgcggacactacggctctcgatgaacggcttctccggcgatttccccgtggggttcgggcaatgccggtcgctcgtggagctctcgctcgacggcaacgccatcgccggggctctccccgacgacgtgttcggcctgacgtcgctgcaggtcctcagcctccacaccaactcgctctccggccacctgccgcccagcctgcgcaacctcagcagcctcgtccgcctcgacgtctccttcaacaacttcaccggcgacctccccgatgtgttcgacgcggtccccggtctccaggagctctcggcgccgtccaacctgctcaccggcgtactccccgccacgctgtcgcgatgctcccgcctccgcatcctcaacctgcggaacaactcgctcgccggagacatcggcctcgacttccgcgccctccagagcctcgtgtacctcgacctcggcgtcaaccgcttcacggggccaatcccggcgagcctcccggagtgcagggccatgacggcgctaaacctcggccggaacaacctcaccggcgagataccggcgacgttcgccgcgttcacgtcgctgtccttcctctccctcaccgggaacagcttctccaacgtctcgtcggcgctgcggactctgcagggtttacccaacctgacgagcctggtgctcactaagaacttccacggcggcgaggcgatgccgaccgacatcgccgggttcgccggcatcgaggtgctcgtcatcgccaacggcgagctgcatggcgccataccggcgtggctcgcaggcctcagcaagctcaaggtgctcgacctgtcgtggaaccacctcgccggcccgatcccgccatggctcggcgagctcgaccgcctcttctacctcgacgtatcgaacaactccctccacggcgagatacctctcaagctggcgtggatgccggcgctcatggccggcggcgatggcagcgacgaggcgcacgtgcagaacttccccttcttcatacgccccaactcgtcggcgagggggaggcagtacaaccaggtgagccggttcccgccgtcgctggtgctggcgcggaacaacctcaccggcggcgtcccggcggcgctcggggcgttgaccagggtgcacgtcgttgacctgagctggaacgcgctgtcggggccgatcccgccggagctgtcgggcatgtcgagcgtcgagtcgctcgacgtgtcgcacaacgcgctctccggcgccatcccgccgtcgctggcgcggctcagcttcctctcccacttcgacgtcgcgtacaacaacctctccggcgaggtccccgtcggcgggcagttctccacgttctcccgcgccgacttcgacggcaaccccttgctctgcggcatccacgcggcgcggtgcgcgccgcaggccgtggacggcggcggcggcggcgggcgcaaggaccggagcgccaatgccggcgtcgtggcggcgataatcgtcggcacggtgctgctgctcgcggtggccgcggtcgcgacgtggcgggcgtggtcgaggtggcaggaggacaacgccagggtggcggccgacgacgagagcggcagcctcgagtcggcggcgaggtcaacgctggtgctcctcttcgccaacgacgacgacaatggcaatggcgacgacggcgagaggacgatgacgctggacgacgtgctgaaggcgacgggcaacttcgacgagacccgcatcgtggggtgcggcgggttcgggatggtgtaccgcgcgactctcgccgacgggcgggaggtggcggtgaagcggctctccggcgacttctggcagatggagcgcgagttccgcgccgaggtggagaccctctcccgcgtccgccaccgcaacctcgtcacgctgcagggctactgccgcgtcggcaaggaccgcctcctcatctacccctacatggagaacggcagcctcgaccactggctgcacgagcgcgccgatgtcgagggcggcggcgcgctgccatggccggcgcggctgagcatcgcgcgcggcgcggcgcgcgggctggcgcacctgcacgcgacgtcggagccgcgcgtcctccaccgcgacatcaagtcgagcaacatcctcctcgacgcccgcctggagccgcgcctcgccgacttcggcctcgcgcggctggtgcgcgcgcacgacgacacgcacgtcaccaccgacctcgtcggcacgctgggctacatcccgccggagtacggccactcgtcggtggccacctaccgcggcgacgtctacagcctcggcgtcgtgctgctcgagctggtgaccgggcggcggcccgtcgacatggcgaggcccgccggcggcggccgcgacgtgacgtcgtgggcgctccgcatgcggcgggaggcgcggggcgacgaggtggtcgacgccagcgtcggcgagaggcggcaccgcgacgaggcctgcagggtgctcgacgtcgcgtgcgcctgcgtcagcgacaaccccaagtcacggccgacggcgcagcagctggtggagtggctggacgccatcgccgccgccgccgccgactgacacgaagcagcacggcgttagtatatgaacaaaaaaaaaagaaaaaaaaaagacgagctgatgattccagtgttctgcattgctgaaagttttgcagtaaacagagtagattattgtgcagtcgcaaaggcacggtacagtaaacacatggtaattactactagtaattgacagtgtaacagtatacatgtatagtgagtggtgtgttgttagtttacacttgtgacttgtgtgtgtgtgtgaataatagcatctgcagttctgcactgcaagctcaaagttgggctgtgcagcgttcgagtgaatcagaactgctaatttttaaccatgtacttcttcttcatttcgaggatctgatctgggattactgctgatttggcagtaacaacatgaaacaagaatgcacgtatcatgtcaccatctgttgctgactaggagtaattttctctgttttgtttcgggttggtgatatggtcagttagctaccttgtctgtactgaatttgcaagtagatataccgtgctgatgttctatctagagcactattggttggcccaataagccaaagtaaaaaaaaatcaatatttgaattttggagttgatcttaatatattttcaatgtaattctttttagcattagtttttaagttgatatgaacaaatatataaaagttttacgtataaaatattttttattctccaataaactgttttgacttattagaaaatatggacatgacgaatgagattctcagtttttagtgaactttgactggcttgtttgggaaagagggacttattccaaatccctgtcacatcgaatgtttggacactaatttagagtattaaacatacacaaattacaaaatccatttcataaccttagactaattcgcaagacaaaacttttgagtctaattacgccatgatttgacaatgtgatgctacaataaacttttcataattataaattaattaggcttaaaaaattcgtctagcagattagctctcatttataaaattagtttttttattagtctatatttaatactttaaattagcttacatccattggatgtgtactaaaaagattctcgacggcacattggcatggcgctgaatcttcatggcagtggatgccatgcagctgaatccatgttattactgcggttaagtttctgtcctggatggctgcattgcagatatggattaacacgtgcgagattagcagtaaactaacatcggaatcgacaggagtattcctattcctatcttgttaatctgctagattttagtactatactctgatgctttaatttcactacgtagtatagtactcccttcatccttgaatgtttgacaccattaacttttttaaatatatttaattattcgtcttgttaaaaaaatataagtaattattaattcttttcctatcatttgattcattgttaaatatacttttatgtatatatatatagttttagggcctgttcactatgatgccaaaaaaaaccttagcaaattttgacattgttaaaattttggcaacttgccaaaactttggaaggatttcttatatagttatcaaaatttggcatcaaactaaacgtggctacttttttagcaactttaccaaaatttggtaaggttgaaaatgacatcaaagtgaacaggcccttacatatttcataaaatttttagaataagtcaaacggccaaacatgtttagaaaagtcagggtgtgaaacatttagagaactagggagtagtgcactagtactccactatcaggttttgtctgaacatcatcaattcctcatccattgccatggcggcatggcgccgctgccgctgcccccaggctttgatgatccatggtccacatgagcaagaacaaaacaacactcattctgctcttaattaatgtgcaaacagtttgctctgctctaattaatcacagaatcccgagccgacgtgcactccccaacagtaattaccatttacccatgctcatgccggacccgagcaccgggcccacctgtcatcgacgccatgccctttctgagcccaccccactcacatgctggggggctcgggagtcgggaggaggaggaagaaggacacggcatgattgggacgtgggccccacctgcagcgactgttagtccaacgtggcactattcatacgcacccctcggatcgcggcaggggaggtgggacccaccggtacaacctggcatggaggtctacccacaccccaccgacatgtgggccctgagtgaggggggccggggtgtacagtggcgtggggtagaactgagatgggtgagaatgtgatttttaacatacgtgactcggcgcaaggaccaatggggtactcgagggtgagaaaaaaaagagagagagaaagtgccgttgccggtgaggtaatcccacatcatcctcccgcggatttaccattttgtccagttttccgatgggtggacctacatgtcggtgacacagatatcagtggcatagaacgtaattgtttgtaaatggagggggtaaaggggtaatttggtgtccgtcaaagtgcagtcaaagcgcacacactcccgagcttagcttagcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccaggtacgtgagtggccaccctccgccggcgccgccgctgcccccatttttgcctctccgggcggggcgtgttgccactgctcggtacctgtttggagtaatgcgtggtcggctgctgtgctgttcttttggatttagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagtgagtactcttgcccccccgctgcccaaccattctgacttttgcattttggggttctggtggcttcgttggtaatgcttcaatcttgggagggtttggtcgcctgcattgcacgatttggaccagctgctctaatatggagatgaccaatcctcttctgttcaagtgggttaatgacatgagaaaaagggagatatatctgtatttggcttgctggcaatggttggtgaattgtggttctatagacattgaaatgttttcctttttgtcttttgtcatcatgggggaatttgaagggcaccgaagtccaacctccttctaagtcttgtaccttcgcattgaataatttcaggtagaaagtgcgatggtattgtttttagtgggcagctgaactgaaagtgacagaccatgattgctttgaatcttcagatgatttcagtgtcctcaaactgtgactgatttattttctttgatgtaggaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctggtaaggagtgctgcagtctttatgtcatcatgcctcaggttcttcggtttttctactttccataaagtagtttgtggtacaatatatagtgttattaatccttccactaagagtctgattgatcttctgttgccattagttgagtggagcattatgccatggagggctccgcacattatgaatcactaactcaccatcaccgctgtctcattcacaatggcaatactctgcatttgacaatgtgcagagctttatttccctttcaacagtttagttacaacagttgcatagatgaatttatacagtttgcatgtttgttcctttagatagctgatagtcaacaggagaaccactaatgcaggcaagatttccttttccaaaactttatgtaacacggtttcatcagttttccatgatccactctgttaatacgtcctgcgtgtaaagtatttatccttatttttaaaagtgaacagtaatatttgcatcattttctaatgttccttcaaagaaatggcacaaattttgccttttctaattagaaaatgaacaaaatcatatatggctaaaattttgaatttgtggctttgggcagttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaaggttcttcactaaactctatttctcttgttgcaaaaaaaaaggattgtctttgtatgtttttgctaaattgtcccattgatcggtgagtcactctattgcattccagatttaaacgagaagagattaagatccaagcatgggaagatcatcagagagcaaaaatcgaagctgaaatgagaaaaattgaggtaagctttctgtcatccaatagaagcattgtaataatgcattgtagtatcatcttaactgagatgtttttgattctattttgactttatttccatgtttacatgcacattaaataatatgggatttgttcttctgattatgggcttatggctgttggctgatgatcttgtggacttttggtactgttaagaatgcacatcatgccattgacataggaagctaaatatattactgctgttgggagtttagtagctgatcaccttttacagtgttatctgaattcactgtccttccctcttacaattatgtttcaatctgcttatcacagatttgttccacacacagccaataagtatcatatggttacggttgtgaggctgtactgtttattaagatattatattgccttaagagaagagtagtagaacaatgccttcgtctcagactaaaacatagcttgggattatacctagcatcacttgatcaatttttcctgtcacatcggcatgatgcttggtgttttaccataaacttccatcaatttggatattgcatagcaatttaagtatcaattcttctttttttttttgaaacaacctgcaccagtgggacgtttcaagtatcaattcttccattcagatgcatcatactttgttaagagtgaacaatccgatttgctttacttgtccatctctgtacaagtacaattgttcttgtacgatcaatttgggaaactacactgcccgtggctaatggatgtttccatggcttctgtttctccaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgctgtgtgcttgttatcttgtacttggatgtcaatctgtcacagtgagctacaagcagctccaccatgctgaggaggtgttgaggctcaattcggattcccggatcaccagtgcagtacagagtatatgtgtgccgatgttcatcactgatgtgagatagaagaacaaagtttttacggaaattcttacccctttagtcctttttactcgtagcgattacagtggaatcatgtttggtcttcacatgtcaataaaactacacaaaaattagtacaccattcaattgttgcaaatacgtggtaaggtaacctctttttaaaccaaacagaacaaagaaaatctggctgggttgtttcctggacaattttttcttcatcctgtgcaacggtttcaatcaataacatactggtaaaatcctttttttaaaatcacacatgaataactgatagtaaaatggaaacatcactcccagagatcatacataacagaaagacaaacataagataaaaggagtgattatatgaatcagtactccaattcacctcctttttcttttcaaaagtcactagatagatattgacttaatctcggttttcatgatctcactacattcctcctgaaggtgatacactgatacacagcagaactttggatcgatttgatatcgaacaaacctcaacgagcattcaaatcaaatgagccctaattatgattcaccttctctcaagaagataacacagatattaattagacagttcaccagcaaatctgataagctacagtcctactactcgaacttcttgataagggagaggtcgttgagcatcttgtcgatcttctcgctgccggggtcgccgacgaacctgccgccggagcggagggaggggacgagggcggaggcctcgtcgctggtgtcggggcagaggttgccgagggtgcagagctcgaactcggcgaggccgtagcggctcagcgtctccctcacctgcctcaccgcgtccgggttcttgtaccggctgaaccgcttcacgtactgcagcgatttctcgaacacctgcgacacctgcgacgacgggtccccgtccgacatgtgctggatctgctcgtacttgtgctccaggattatcgccacctcgcagttcatcaggcacttggccttcaagaactctgcaacccatcaaaccctaggtatcaaatcaaatcaaaccgatacctctactcgattccgattcggacggactcaccttccccgatcttgagctccgccgcgttctcctcctcctcgccggacatctcggcgcgctctctctcccctctcggtggctcacctcaacctcggcggctatggcgttggcgatgcggctgcgggcggagtctggactcgggaggggaaaagaaaccaaggcggcgagaggcgcctcttaacgggctggactcacgatccgattcgctaacaggctaggcccattaacgcattgggccggctcgatctgcacgagcgtgttcctttcggggtgatctggaccgtccatccgtttactactcgacggcggcggcgagtggtcggcgacaaggacggcgggcgtgtcgtcttccccggcgacggcggggatatgaaggggctcgattcccgaggagatcagcatcgggggtgtagctcatatggtagagcgctcgcttcgcatgcgagaggcacggggttcgattccccgcacctccacctcacttctctcttttttttaatttatttttggtggatttatccggtgcggtggtgcgggctccacgtggcagtgaggcaggtggtggcctcgaggcgcccgcgtggattgcagtggcgctgctcgtcacttcgtctcctcctctccaccactcgtcgtcgtcggcggcgtggccatggcgacacccgcgccgctctccggcctccgcccgcgcgctcccgctcccgctcccgcggcgcgcagtcgcctgtgcggccagtcgccgccggtcgtggccccgcggctcggggcgttcccgcggcggcgtggtggggcggcacggtgctcgccgcgcgccgaggccggggacgtggaggcgcttagggcgggggtgtcggtgtacaagccgcggtcctacgacgtgctcgtctccgacgccgcccgctccctcgcctgcgccatggacgagggcaagacccgcctcgagatcgagttcccgtacgcccgcgacctattcattccctttcctccatagattcgcgccaccatctcgcctaatcttttacttagttggttattaataatgcttgcattatctcatcctccttgtctcatttttttttttggtggtggtgcttgtgaaaaggcctctgccgagcaacatctcttcttacaaggtatactttgcatttctatctcaagctcgtctcataactcacactcattgttctagtttcttgctttgttatgagtgaattctgtaacaatgcaaagactaatcttgatgtatattatatagactgctctagtttcagtttgaatgctgctgctacctctgtataatgttgtttcaaagcagaatctctctttttccttggcttcaagttaaaaagggtttagcttttgttgccacatacgtgtgatgaacgcttgtttctaaccatcctaccctgctttgcttcgttttcaagggttcctcggacgagttcatcgacgccaacatccagcttgctcttgctgttgccagaaaacttaaggaactcaaggggactagatcttgtattgtaagttcaagtttcatgccttgtcctgctccagaatcattctggcatttgtgggcatatgcaaatcttttctcataaattatcttctagttgattccaggtgtttcctgacctaccagaaaagcgcagggcatcccagttgttcgggactgctctagactcggtaaataatgcctcatgaaacaaaatatcttaagaggatgcaaaaaattgttttttcccctcatgacggtaggagcttatttggttacatttctctgttttctttttccacctcttgtagattgagactgcaactatcagttccctggatgaggtatctaccggacctgttaataccttcttcagatcaatgagagataccctggattttgactttgctgacgatgttgaaggtgaattgaccaatagctttgtctagtatggtaggagtactacattaaactattaagaaaacagaatttatatttatatgactccaagaggctgtcacgtccaagctagatgaatcctttatcgctagcattttatcagaattttcttatgtctgacctcacttcaatgttcaagccttctctatagaggagataccttggagaaccattagcctgtgatacatgataaataaaattgatttggtaaaaacatctttgtaaatttcctaaaaatgtacaagtatctcttttcgtacaaatggcaaagtctttaagttgctacttggcacagttcaaaattttaaaatagagtggaaggacatggttgatcagtgggtaattattcatatataagcattatggataattattcggtggtatattattgtgtcagattttcagcagatatttcaagtaacaaccatcagtaaaagttgaacattatcaatatgagacagatttcttataagcatccttggaaaagaaaatcataactacctggctactgtgggtacagatcgatggaaatctgatgaaccaccatcgctatatatcttcatcaattgcagcacacgtgacctttcaactatagagaagtatgtggtatgtctaaaatgatgctttgtttcttgccaacatgtatgcaaatgtactttttggaatgcttggtttgcattgttgtgttttggccatcatttggccagttaggtatttattattctactgttaataaacgatcatgttctgagcttgatggatatcactatgaatagaaactgaagaaagaaagttgaggaaggcatgcacagctgcaaataagccttatatgattgccacacgatttactattctactatctctatcccataatataaggcgtgcacacattccaagattcaactttaaaaacatttgaccaacaattattataatataaattaaattttatttgttaaaattaatatcattggattgacatttaaatttactttaagatgattataattttgttgcaataaaccttataatatatgagaaattttaagtcaaagattacttttgaagactgcaccaagtttgaccatgccttatattatgggatggagggagtatatcaagtgcctgatatctaagaaaatgcaaggaattttgaatcaacaccacaacctacagagtttctctttcattttccattcacttgtatattgtagttctttttccctggaacaagaatgaaaattttcaaccttcgatggtggaaaatgtagaatattctttgtagtttgtcacacgtaacgtaaggaaatagcatgcaacacaaggttttgaggaataatgcattaattgtttgtttagcagttgtgttagtttgtgcatttgtttgattcattacccatcactttgctattgttcaggaacaatttgcctcatctgtcccagcccttctctttaatcttgaactagataccttgcggtatgtgtcttatatcccacctgatggcttgttccttctaaactctattgatcgccttaggataacttatgatctttatcctccagctctgacttggggcttctgggattcccaccaaaagatttgcattacagatttctttctcagtttaccccagtattttatatcaggcagcgtgactactctaaggtatccatttgttttacttttacaaacttaaccattccttttgtgtatctgaaccatctatgattagtatttctccctatactttgtag

SEQ ID NO: 72373 - DNA, 687 bp, Oryza sativa
ccataaataaatcataacattgcagatgtaaactagcataatcgcattatacgatctacacatataaattggacagtaaaccttgaacagatcgaatatgcgaaacataacgaatacgtattgagggttttcgaagctcagctgcacagcgggaaggactcgcggtaccgggcgttgacaacagcgtgcagcacccgagcgaagagaaagacgagctattgtggatgaacagcaagcagtcgcgcaaagcgcttcccaaaaaccttattgtcaccttctcccgatgcagtacgtcgaaggcgagggttccggagacctgctctcccaatcactggtgcacgctggcgagcaggatggaataaactatgtgcgacaacactgtatagaggaggaggcaaaccctaaattgatttcgcgtgtgtgttgactgaaaacacggcggcttaggagatttgcttcactccagtgcaggtccaaggcttgtctcaagtgtcaagagcatgtaggctgattttatcctgcaccagcaagaaagacaaaaacgtaattagatgaacgatagccaatcggccgatagggccgatgacttattgtcaggaccaaccgatacgggtaaacctaattggctgtggctttatgatagtcaattagagccaaaaccataaatatgccctattggttgtagga

SEQ ID NO: 72374 - DNA, 2198 bp, Oryza sativa
attcctgcagcccgtatgcatgtgtgagtgcattcatcttttctacatggagggatggcgaagaggcacgttgttaattcccacacctgtcattcagtctatccctccgaattttctcacggcaagctttggactttggaccagatgatgatgattcatctctacctctgcacaaaatcagaaccattacaaatgaaaatcaaatatggtcccagcaataaaatgaataatatgtctaaatactgtgttaaatttgttcatggtaataccgtaatggttgaaaagttataactatcagtaacagttcaaggtatgtaagcaaagatacttagaaaatcataagaaagtaagattcagaaactagtgacagaccttttccctaaaacagattggtcaaggcaacaagtatctccactgacatcatcaatcccaagtctgcaataattacaaagtaagcgccaagtgaataacagttgatgggaacaaaaattattcaagcaaggtatagctgctcaggtaggcaacaaaagattctgccatacatatttccattagcaagtgcttcaaagctaacattttacattcagaatcatacttgtgtagatatttcagagagcaaagaacaatgtaacatatcctatggcaagtagttggcaactaggtgtttatcacgcaggcgcccacttttccaataagggcgcaatcaaattgctaattgatttcaataagctcgattggaatggtaccaacagcaccagaactactagtacacgctattgtaatttacggtttttgccctccaatcgatgggtactgtagcagcatttgctgaacccgcctataaatcagctagcaatcacaattcttcgttcatatactactataacctaatcgatcaatcaatcaaccaactagacggtgtacatgtgaaaatccccctctttttctcaagaaaaaaaatactcctaagtagtatcaaacatcaccgcaatttttttaagcaacaaacctgcagcgacaaggacagcaaacactacaaaacgcatgcaacaaaccccaattcgagctcaatttactcctcaaaaagaaacagaagcggatcaagcgtaccctccatcgcagggcagcgtcggcacaccgtcgcagaagacgccgaggtcgccgtcctcgccgccgccgccgatgaggaactcgtcaacggggtctccgcctccgtccatcgcccgcggcgggtgcgggagatcgggcctagggttcggggattctcgctcctcctccgcgagcgagaggtcggggaagaattggggatttggggatgagacttttgcagattgcaccctggatataactgtaatgtctaacgagtcctcgcttagtagtttttagctgtggtggagaggggtgatgttgtgattttatacttttttggaggggttgggtgtaaaagtgagaataggttggtggctgaggaagatgctgggaaaaaaggggagataagatgatgagcgtgtatagcacaggatgtggtcctgttcatcatgtttttttgtgttttttttatttttggatttgtgtttcatgtgatcaacttgatcagtgtcatctactggctactgcatctgttctcgatttgtttactctgattaggtttagaaaagtttgtttcatgtcaattagcctaacataaagagagtggtgtgactcgtgatttaataatataaacatagagttgactagttgagtatgcgttttgtagagttgttagcacaattcttttttgtgtgagtgtgtagaccatatacctcaagttttttttttaaaataaaacaaatgctcccaagctcgtcgtttgctctataactgataagatgtgaaaaaagattgaagtatggaaaaaattatgagtaaaatttttatatatgtataaacttagtcatttaaaagtcgatgcaaaagataactataaaactaaaactaagtttcaaaatttaaattttactcgcggctgataatcctcaagcaaatgatggcagtgttatacttcaaatttcaaggttggtgtacctggagcaatgttactgaagagaagatccaatccaagtacaaatccagccacagatgctcagcccactgggctcctttcgtatgcctgagcccatgatcccctctggtgtttcaagcctggccttataaccaat

SEQ ID NO: 72375 - DNA, 742 bp, Oryza sativa
attttttttctatatagccctttaaattaaaggaattgatcctataaaatcctatgaaattcctatggattatctttttccatacaagttttgcaagttttggaggaaatttgacatgagatagaacctcatggaaagaatcctttgagtctttatttctcctcaaattcctatgtttttcctgcggcccaatcaaacagtcatttctatgtctttcctgtgttttgcaatcctctataaaaccagttaccactagctttaccaccagtggccgcacctttcactctgcttgatctcttcgtcgatctcctccattgttcgttggtctccacgcgcgcgatctggaattacaaacttgtagtgccgatggttgcggcgccgtcgatgatcgctgccgtggccgtgggcgtcgggtcgaccgccttcttgtacttgctgtggccggcctcggcgccggcggcggcgatgatatgatgaaggcgccgggcgccgccggctacgtcatctcccgcgcggcgttcctggcgaacccgcaggtctacttccacctcctgcgcacggtgggcgctgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgca

SEQ ID NO: 72376 - DNA, 2008 bp, Oryza sativa
tttctttctgcattcaggtatgcttttgtgttattgtgagatataaggttaatatgcattattgaaataactatggttcaagagcttcacaaatatgttctgttttcctcccaaactttacttggagagaaacctacttgattctctttatcttacagggaattgagatgctatcacttggatcattcaaaactggtgctattctcttggtatgggctgtttgtactgaactgaaacttatattttctggcagaaatcttattactttttttcaccattcttccattaaagccattacttagtagagcatgtcaatacaatttgaattatctgacactgtagaatttatgtttgtctttcatttgcctatgaaattaaaatcctgttatatttgtagaaactattgcactgcttgctgtactttgtaaatcactattaagttgtaacgcttatgtatcacgggatttcctttttgattcaggctggcctctttttctatgatattttctgggttttcttcactcctgttatggtcagtgttgcaaaatcatttgatgcaccgataaaggttagtgttctttataagtgattttgactcttgttttgatacaaaatgtctttttctttttacaaaaaaaggctaatctggttatccccttttttctgcatagcttctatttccaacaggagatgctgcacgcccattctctatgcttgggcttggtgacattgtgatacctggttagtaatgaaatctttagaatgtttagtgctattttttttctggtctatgatttctgattggataccgatgactgatgaatgccatatgagagtgacaacttgtttgaagtcatgatccatagcaagttgttagaactggattatttgataaaaaaatatccaatttaaaaattgtatatgtttaccatatcatttgagtacctttttctgtggttctaaatgtagatatagttagggttctttttgctgatacaaggagtgtaggttcaagtcttgcagaaaataattttaacttaaactactttgttatccagatgagtgcaacaagattagcttcaaagttcgaactacttggttgttgtataatgagggtatatgttgatattacttggttatagttgactttgaagccctggcaatgattcgtcatttttattccagtgataatttatgttagttgggaggtgtgtgtgcatgccttttttgaatgatgcgttgaactcattgttatctttagtagcactgaagtgggagtaacatttgatgctagtcgccacagataattcatcttctcttagcattctctgcaattcttcatccttcatgattgaagatcatgaaattctcacatatttctgcaagcagcaactcttctattaacaaataatactcacttctacttttgtttccaggtatatttgttgcgctagcactgcggtttgatgtctcaagaggaattaagaaccgctacttcaatagtgcatttttgggttatacggtgggtttgaccgtgacgataattgtgatgaactggtttcaagccgcacaggtgagtcatgttacttgggattcttgccatcatgtttcctccactcattttcaaggcacatcataagagtgagtttagttcgtagattatttaaacaaaatgaattgttatacatacattaattaaacaaaggtaattgtggtggtgaatttgcaaccatgtaacctccacacattttttacgaatcatccccaatatttcatcaggaacatgcttgaggaccttttttttttcatttttgtctgtagcaaattcatgcattttgtgagtagcacaaagaaaactataaacctataaaccttatgaagggaaaaataaaaaaaaaagaaaacaagaaaattacatcaggatccaactgttactcttgttactccaattataaaaaggagaaagttgcatctgatttgtgtcatctctgaaatattaacgcactct

SEQ ID NO: 72377 - DNA, 25604 bp, Oryza sativa
aatacttgcatgaagctatggtgtgacaataagtcagctatcaatattgccaacaatcctgttcaacatgatcgaacaaaacatatagagatagatcgtttctttataaaggaaaaactagatgagggaatgttgaagctagactttgtaatatctggagaacaaatagcggattgtctaacaaagggctttaggtgttgcagagtgtttgtctatgtgtaacaagatgggcatgatagatatctatcgcccatcttgagggggagtgttgggctgtaaatgtagaagtatgtctatctaggcccaagaggcacatatatccatatgtacatgtatatgttcagttgatagagtaatgaaaaagaagtgaagcttccagagaaaacaaacacaaaaaacttcaaaatatactcctagacaagttgagaatttatcctagaggatgctaattgataagattcgcaagagtacgagttgtactatatgcaaaatcaataaagcaaccacaagtattactactccatccgttctattttaagtgcaatcataagtttagttttcgtgtccaactttaattgtccgtcttatttaaatttttttaataattagtattttgttgttatgagataataaaacatgaatattactttacatgtgacttatgtttttattttttaaaaaaattaaataagacgaacggtcaaaatcatgcacggaaaatcatgaccgcacttaaaatggaacagagggagtacaaagtaaagccatttgttcagaggaaaatatgtaaaatctgtcattcagaaaagatcgaatactagtactgtgctcttcccgactcacatccttctttttccgcgacgtacgctatttaaattgctaaaaagtatttttctaaaaaaagtttctatatcaaagttgttttaaaaattcatattaattaaaattttaagtttttttggctaatatttgatcaatcacgtgttaataaacaacattgtttccgtgcgttaatgaactccacctcgggaactcagccttagcattaacctgctatggaacaatactccctccgtcccataaaaagagcattcttagcatcccaatgcaaatttagtgaggagtaaagacaactaaaatgtcccttattatttaaaaaaaaatagtaatgatgatagatatgtaaacggtatttaagggataaaacttctcgttttacgtgctgaaaataggcaggacagtagaagttgattttttttgacaaaatttaaacttcagaaattgagttttttttaagatggagtatatgagaagagattttttttccttgagattcggacaagatgacagtgatacagtttgaaacagagctgacaaacctcttccctttcagttaagggtttaaggcatctgacatcagatttcagataaccacttccctttcagtcaagggtttaaggcatctgacatcagatttcagataaccaggaagcgttttgattctcctctctaaaaaaaaagttctgaatcctactcttttaatccttgaaaaggcggtggcgctgttcgttttcttacatctgaagaacagatgaaaggaaatcacagcaggtgagacaagttaaaccacatctccgtcgattgcatacagagcacaacgacgagaggaaacatacacggctctacaatctcggaccaaggactactcatcgatcagagagaaaaaaaaatgcagcagatatgcaaagatcgttacaagacagatatagaacagagaagctcaaggcgtcattaaccctatgaagctttgacaagatacattacattaatatatattggctatgccgaatgccgatatatcaatatcgctggaagatggattgcacaacagtggctgccttagttggaagaaacatgttgatgttggccattgagtggagtgacgtttgagatcaacagatgccttcatgtgtgacttgtccggagcatccatggcggaagcttgctgttgcctgcttgtgccggagacggttgagcttctgactcccctgatcctcttggttggctttgactgaattaagatgaggaaaaacagcataactaaaacagacaatggagttgatgaaatagtagtaacatgctagatcattcctaacgtcaagttattgttcagacatgatatatcaagctgagaccaaaccatttggaggctttttcactgtttggttcaggcgctttcaggcctgggcttatttgttccaaacttccaatagccatatgaaatagaccggcagcatttgattgaacaaatttcaccggattaagtttcctaggcatagaccatcaaaaactactgaactgtgatagataatggaagtctgataaaagaaaaaatatagaataaaaatttgctgaagaacaaaacagagttttgttttatttatggtgagtgcaggggcaaaatatatggaagtaaaagcggtacctgttatttgttgtcgggatgggatctggagccgtcactggtgttggtgatgatgtgcttggtgttgctccattttgctcctcccggttagtgtttattatagcattgtttttctccttttctgtctccatgagctgctccgaagaatgtagacaaaagggtttgacctccaatacagcttttgtagtgatctgatataaaacattgttgtaaacaagaatgaaatttaccttttgcagaacattattctggtttttaagtgacttttcctgcagacaggaagatagcagattgtaagaatattcatcagcacgaacctatatcaacttcgtccatttctcagcacaatattaacatggctctgttgccacttgccagatcagatacagtaacaatcagtagtgcaggtccttttttttccctatgtttatgcatacattattgcgtaaaaggctaacggtcaagtccttgccatatgcatcgaagatttattttcccgtagaatgttcaattttacaacgtagtctgacttagtctgttctctctcccctagaatatatacattgatggcgactttcctgttatacccatttgacaacattgtgcatttcccacaatatgaccaagacaagtggcttctcgttagttccttaggtgattcaaattgactaatgatttcttcttataatggaatttctagaattgccaaaagacatgttttacatgaatatattctggtagaaggcaagaagagttagttgtctgaaaattgtttgaatgcaactttaatactccaaaacaatatggtataaacagactgctacattgctatttaaggagccacattgagggtaacctaccttcttctgaagctcagaaattgattcaaacagaagctgattctgcaaaagaaaaacaaaaaggaaagtaatgatgttttcaaagattagttggaaataattaaatcaagcaaatttgatccctcagtcaacagtgcataatggacacaaatttcaccttttttgatcttatatgcttcagagaatattccagttgatgttccaattgctggagttcttttattgttagtgtgtccaattgttcacctaagagttgccttgagcagtagatagaccaactcaagttagcataatcttgttaccaaagtgaaaatttcttaagaaagtttgcagtacctttggctcttctgaagtgcatccagtttggacttcaaaattccatattcatcaccccagttttcctaggagaaaatgaatatcaagatcagataactaaccagctagttaaataaacagccggagatagttctccaacagtcagggatgtttttttacctggtcctcagtatttggctccagtacggctctttcatcaaacgagtaacgctggtagcgttcaaggatcccttccatactacagaagaagtatcacatgattatgctttggtttgaccaatgcatcaaaagatgatgccaagcatagtcttagagcaatatcaaacaaatgcacagttataatttttgtaccctcaataattcttaaggcttgtcaggtgacaactacaaaagtaggatccattattcaaattatccatgtataaatttaaatcataactgctacaaaaattatgcatcagaaatagcactttgaaaaacatttgtatttgttggctgaaactttatccattcatgttcttcgtcgtaagtttatatctaattagaatgattaaaaaaaggattatctggccttaataacattagtacatatggtgaatccacattactcccttcgttaacaaataaaagtcgttttgaaatgtgtaatcaaatctcaacatcaactcactggagaatggattctaaactctcaagggaacatcccctcgttttttgcatgtcatctaaatggttatgatttttttaaaaaaaaatcgacaagatagattaatatgtgatagattacttcacaaacatgcaagttcaaattcaacttctacaagttacaacaaaaaaaaattaaactatggctagttaatgtatattcacggtcaaatttaattttttcattgcaacttgtagaatttgaatttgtccttgcatgtttgtggagtgatttatcacatattaatctatcttgtttattttttttcaatttttttcacaaccgtttggataacatgcagataatgaggggatgtcccctcgagagtttagaatagttcccaactcggtgtataaaaataacattcatagattcataattgaataatgtagttatattttaactattttatgagtagatgatcatacaaagaaagatgtgtgttagggataatgtcaatatcctagacaagaaataaaaaaaggaacagaaggagtatttggtagcatagaagtagcttgaccttaatactaacacaataatgagagagtattgttgcctatccaaaaattttgcaaatttgaaattatatttatcacaaaaggcatcatttaggtcccttttttcccttacgagctactgatattatgctccctccatttcataatacttggtgattttaagttcgcattgttttagtttggccattccaattttataaataaacttttagtattagattatgtaacatattattaaagtatgttacatggtaatggtaaatatagagatataaatcccatccatcataatcataaattttaaaagatattaatggttaaactgaagcaatcaccggtcaaaattgccaaatattatgaaataatagagtataggaataccaataatgaaatatttaaattcctcccattaaacaaaagatattagcataaacataagcagtttgcttaattgaaaaccataaacatggttatacttgaacagtatagctatgtcaatcagtttattgttgtcctaaaaaatccatttcaagaaataaacaccccaatttgtgagagcaagttaatagcaatgggcaatggcaacttgcaccatgtatagctaacttggtgacagtacacactaaagggacaaaagaaagttgtagtttcagttaaagcaaggccgggtattaatttacttcccattatcttaaaaaaaaaaagggaaatgaaaccgaatgcatcaaatgaacaagttaagtaagctggtcaccttatattccacctcgaaattaactaaacaaaagtatcaaaccatatgtcatgtaaagctggccgcgccatttataccagtccaggagttgtcagtaacttaagaccttactggcctggttagaggagccgcttaattagcaaggcgtccgtgcatatttcaactgaagtgctgctctaatgatttccagaaataacgagacaaataatacaagtttaccggcctagctaggctttggtaataagcatcacttgtatatgctacagtacacaagagtataagcatatgataaacctagataagcacactaattaaaatttaaacatatctttctttccgcccgtactgatgaagcacatgaattttttttcacctattattccattcctttttatacaaaaaaaaatggaagtgaacgtgttcaccaatgctacgatgattgatgagtccccaagaacaaaactgagcagcatataaagctaaatcagcaacagtgcatgtaccaccactgtatattactagcttctgatatgcatggcagcagcagcagcagcatgccagcatcacatagagagctgtaatccaggggacacaagcaacctacaactagctagacttcgcgagcaactccatcccgagctaagcagcaatcgcacgaacgaacacgtacaaagccatgaaccgtatgtgcaatcagagagcacatgagagaaatcaatcagcacgaaataatagcaatcgtacacgcaccaacaccaccagccccctcgcattccgcagcggaaacgatcgaacacaaggcaggaacccgtacgaaacgaaatcgaacgcatcaacaagccgcccaggaacggggagctccgcgagctcgcccatggcgcgcgcgcggcgaggaaaggcgacgggcatgggccgtactacgtaggtaggcgggaggtcgcgcagaggaggagaaggaggaggaggagctaagcgcgtgcgtacctggagtggctggagaactcgtagagcttgcccttggtggagaagacgatgagcgcgacgtcggcgtcacagagcacggagatctcgtgcgccttcttcagcagcccgttcctccgcttggagaaggtcacctgcctgtttatcttgttctcgatccgccgcagctgcaccggccctctccccatcgtcgtcggcggcggcggcggcggcgaagccggcggtggcggtggcgggtggagggtgaaaagctcggggaagatggaaatggggggaggaagagagaggaagggggagggaaggcggttttagatgggggtggaatgcggtgtggccataccagggcggtttcgagtgcctcgttgtcgatttccgattggccgaggcggtttcggggcggcgtggagggatcccggccgtcggatcaggagagaggtcgttaccgcggccctggcccggtggggcccacgggccacgcggcgcgcgcgaacccgtgcacccgcgggctcgcgctcgggattggtcggtgggtcggatggggcccgcttgtctgtgactgcgggtgcggtgggctcgcgtgagggatgggtttttctttttccacaacgtaggggggtgtcgggtacaaggaaacgagacgccggatgacacgtggcgagcccacgtgtggtcgtcgaagcgggcgggtggggcccacctgccagtacaggtttttcttttattttatttttttctttttagaaattccgatacgatacgagtatttctgtttgtactactcaactccgtatagccgccaaactgtttggcaccgagtactacctagtagtacaatacacgtactgggagtaccagcgtttgtttgttggtgttgaaagatttttttttcttttttttaagagagttcgtgttgcaacaatagaaggagcggacaacaagaccgtagaaaaaggctagactttttttttttaagatactccctccggtttcattttaattgacgctttggacaatgacacgctctacaagatataccttggatcttatttttctattataatatatacaataaataaatacatgtttacttttattacagtgttttgaaagacaaatctatatatgtttttctagtttctttaaactaaatatttttaaagttattgatggtcaaagttataaaagtttaaccttaaccttgtctaaaacattaattaatatagaaccaaagggagtaatagattaactggtctccacagcccaagaaaaatgaactaccttgtggctttgtattgctatgctaccgtggttgattgcaaaattgcagataggtaaatgacctttggctacacacaggggcggagctaccatgattcctgggtattcccgggaatacccaacttttttatcaaaaaacaagtatacttttagtatatacacatgtacacatattagtgcacctaaatcctcaattcttcgatccaaacacagtccaactggcctcttgcaacgcctcctaccaacccgacccactccgtcatgacccatcagacatcagctgacccacttagccaccactcttccatacggccccctctccctctccctccgtgacccatccctccctagctcggttccctcgcgccgctccccatttccaaaccccaggtggcggcgcggcgaggcggcaaccggcggcggaagctggaccgtgctaccgcggaggggtggcgcccgccactccgccaagctcaggcggtcaggccgattgggtggccggtggccgcgaggggcaggggcagctagcggctcagcgcttagacggaaatacccaactttaaaatcctggctccgccactggctacacaaacgaatgttagccatgtctaaaaggattaccatgttaaattcatgttgaaatatttttttaaagataatggaaaataatcatggcctttaacaaacaagcgatggagccatttcaacgaaaaatatgtataaattagagcaacctttgataaacaaactatgaaaatatacatattggtttgctctcaccttccttttgttttggattatactcctctatcccaaaaataaatcaaactccagagatcaatctggacacatgtgtatccagatttttatttttattttttttgtgaggggggagggggggctacggagtgagtacacgaaagacgcgtgggcatgcagaccacactcccacatccatgaatacctcccactcccaatgctcacacacccacaaatgtgcctctcactcgcaaaccagaagcacatccctggtcccactataatgttattgaaagtacatccgtgtgtgtggaatgtttattggaaccagaatttgaaccatattagctatttctgaagtcacgtacccacgacttcaccaccacacagacgatgttttcccactactgtttgtattttccttagatcttgtgcaaaggttgcatcttgcatgagatctaggcgatttatcatctctccccttgcatatatcctccaccttatcattcaatgttacaagcaacgtggaaagattcaaggtgttttatgacatggtaggctatctcatggataaaagttatcgggactatcacttaagatgatgtggtaggagtaaaaaacaatagcgatgtcttcacacatgcagctagcatgaaaaaaatagagtaaatataatggcaccaaacgcatatacttgattagcatacttaggggtgaaaacaagtcgggccgagctaggctctgctgaaattagcatcacaagctaaaagagtagctcggcttggctcaacttcttcttgacctctagttggctcgtgagcctatgaacaaaaaatactttcagagatgaagaggagtgagaggatattggaggagccgacgagaagagtggcaactaggagtcgagaccaacaaggcgcgcgacaggtcattgggcaccagccgcaccaactttgcgagaggtgagtggcaactcgcacattgtgcttgttagcacaagctagcgacaccaaggagcagcgactttctatagtttggtcaagcagagaggcaacacgacgagttggtggaggctagagatgccttcaattggtggagtcgacatgcctacgtgcagcctcaagtatgacatgtgttgaaccgaagaaagcagtgttgtgggtaggagcatggctgagatagggaataggagacagggtgcgaggaaaggttgggaacttcggctttctttaactagattgaccactagactaataatgtgctatgagttaaatgagtgggctcgccagctagcttgggctatactcattctcgaaacgtgttgtcttatgagtgaaaccaagccatgtgagactaaatggagctcacaagttcgagatctttgtccacctctcacacaaaaactgatgagtagttgtattagtatgtgctttctgttgaaatgaaaaatgtataaggtgaattagtttgagttcttttcagcaataatgacaattttcttattttccgttatcatactttccaaatagttaaacattgtgttttgtgaaaaaaaaatatttacatattttttaaaaaaaatcaaagaactctactttttaagtttataatggctaataatcatgctctaatggttgttctagttatacgagaacatgcaacctgccttctcaaacgaagccttactcactactaaaaaatggtttttctgtcggccaaaatcagtctttgatttttgccagccttactcactactaaaaaatggttttttctgtcggccaaaatcagtctttgctgatttttgctggcagttaggttaaccgcctgaaaccaaagggtagagaaaataaacgttttcacattcggaacttaaccgccagccaaaaaacatattttcgttggcggttctgttacatgggctgctggcaacagtccatttttgcttacgtagtgttaagacgaccgccagcgaagctcttttttggttaaaaaaattgaaaatatgttaatgcatctgttctctgaccaccagcaaagaaaattaaagaaaaattgaaaattgccagatacaacaaccctgcattcccattccacattgcaaatcaaatccaagaacatgccacaaatacaagcacaaattccacaaaatataagcaaatctcaactattgaacatgcacaatcgccgatgctagatctgccctcccgatgcacgctgcacatggtcttgggcctcgccaatgaccggcttgcggcggcctcctcctcctcgcggtcactgccaccatcgaggtcgtcgtctcctccttgcccttgtcatccccgcacagatctggcaagaacgaggccggatccgcgccgatagaggtggcggcggctcgatctcgccggtggagaggggagagagctcgacaccgccaatctcgtcaccctctgtgggaaggagctcgtcacggcggtggggagggagcccgtcacggcggccggatatgatgcccacggcgcctcccgctgtctgcgctgtcgaagaaaaggaaggcaagacggggacggagttggatccggcccccgccaccgccaaactggatccagccgttgccttcttcggcacctccatgcccacatgcttcacaggctccaggcccaccgccgttgtcccctcaagcgcgccgctggccccatgcaggatccccctcaccgtggacgaaccgcagccgccacccaccggtcgtctcccctccgcccagatctgggcctcctatcgcagcgcgcgggggagggggagggggaggggggaggcccggcttttgcgcgcgtcgatttcacagtcgccgcagtcgcggtccgctatcgccgtcatcttatccgccgtgtcagctgagagccgagaggtggggtgagatgaatctggagggaggtggtgaggagaagaggataagatggagtgactagtcagtggataaaatggagtccgcacttggtgttttaatatagcgaataacttcttgcggtcggcgctccttggcaaccaccagcgaaattttgattttatctagtggtcacttaagaggcccgctttaaaaagacctctatttttacaagcggttctcttatcccggccgctaacgaaaatgaattttttcgctggcagttcttagcacctcatccctcgttaaattttcgctggcggttttcgcttatagacgtcagagaaaaaaaatagataaacgccatgaaaaatcgattttctagcggtgactccctcccatcaaacaaaaagcaattctgacatagtcttaaaaatactgtttccgctaatacttcgtattgcattttttttagaaacctaataaaatcacaatttgtaaaagtactttctgagataaatctacacacgtgattttcatgtataccatctaaatatctttaagaagaaatttatgtgtaaggttgttttcgcgattgaagggtacggtgggtaattacagtcctccttccgatggaaatgccggggaacggcaacactctatattcttttatgtccttttgaatggatccatattcttggacaggtacattggatggcacatcaatattcacttggtcaaggataatacgaggtacacgatcaacatcatgatacgtactagtaccagctaaccactgcaccataattgaccgaggaaggcaccgatgagttgaagttttcaaattcctccatttcatattatatgatgatctggcttattttttcgaatcaaacatttctaatataaaacaaacatattataaatatacatttaatgctagatataataaagctattttcatgttgtttaattattctataaatttaattaaatttgaacatagttgacttataaatcaaagcgacttaatatgaaaacgaaggtagtcactccgtttcaggttacaagacgttttaactttagtcaaagtcaaactattttaagtttaactaagtttatagacaaatataataatatttataatactaaattagttccatcaaatcaataattgaatatatttccataataaatttgtcttgggttgaaaatgttactagctacttttttctacaaacctgatccaacttaaagtaaaaacgtcttttaactcgaaatgaagggagtagaacttaaaaacatgaaaaggtcggggggagaaacggccaccggcacgtgggaagaacggacgtcttccttcctcggccacacatatgcacgcacggacgccaccttgagatcacatttggagcaaagattctatacaaaagttgctacaaaagttttttacgaaaagtttctatacaaaagttgcttaaaaaatcatattaatctattatttttttaaaaaaatagctaatacttaattaatcacgcgttaatgcgaacattgtgttacgtgccgcctcctcctgaacagatcctaatccatcatcctcactccactctctctctctctttctcccgtcgacgcggaggcgccaacgccactgaccacccccatccatcaattcaatcaccaatcaatcgacggcgacgacgacaacgacgacgatggcgacgacggagacgaggacgacgacgacgtgctcgatcgcaagctagcggcggcgaatcatgagacgcccgcaatgaagtcgtcgtcgtcgtacgtcctcgtcggcgaatcatcggtcggcgaagcagctgcagctgcagcgatcgatcgatcgatcgatgtggccgtaacaacaagcggctgggagaaggacacatcgctagtccgaggctagtacttcctccgtattattttaatatatgacgccgttgacttttcgaccaacatttgaccattcgtttaattcaaattttttatgcaaatatgaaaatatttatatcatgcttaaagaacatttgatgatgaatcaaatcataataaaataaataataattacataatttttttattaagacgaatggtcaaacgttataaaaaagttaacgacgttgtacattaaaattaaaatatggaggtagtattaagctccgagctagctgctgaatgcagtgcgtgcagagagtctctgcactccgatccactgaactcatcacatgaaactgtttcacgtgtgtggctcggtttggaattattgaaccgattattaccgtatactatgcccctccatactataaaaaaaaccagcttagaattagatggggtttactccctctctattcatgctgagtaattttacagttgttgagaaggtaccatggggtactaaaaatttcgtgtaaaattcggtaccttatacgagataccaaattcataatagaaaaggtgatatctcatattagcttttaaaggacggtaaaattggtcattcatatgcatgccataaagcccggaaaaggaacggtgtcttttcttctcctctttggtcttgctgccatgcacaaatgcattgatcaaacgcatgaaaggagaaagtaacataggccttatttagttgggaaaaatttttaggtttggttatcacatcggatatacggacacacatttgaagaattaaacgtagtctaataacaaaacaaattgcaattctgccaagaaactgcgagacgaatttattaagtctaattttattaatccatcattagcaaatgtttactgtagcacaatattatcaaatcatggcgcaattaggcttaaaagattcgtctcacaatttacacgcaatctgtgtaattgttttttttccctacatttaatactccatacatgcgtccaaacattcgatgtgacagtgtgaaaatttttattttgagaactaaacagggccatagtataacaaatctgaataagaggttatctagatttattatactagctaggttatgtcttattcacatttagtttgattttctgtgaaacggactatgctttatcgtaatgataaattagatatttatagagagaaacttaatgaatgtcaacatttaatacatggtccaaaaaactgtctaaacattcatgtatttttaaagaggtgaagaaattacccaccgtataataccccgatgaagtaatggagcctggccacttgtgctgcagttgtacgaggttacattaactctatatgccaaacatgtgtttatggttccgtatttcgacgattcagaggtagatttgttgctttctccgtggcttttacgtcgttgcaggttgtgagttgtgaccactgaagctgagctcacgttcatgtctactatagtatctcagaaaaaaaaagattattttttttctcttcctatttattctaaaataaatttataaacacattggaaacagatagctagagtatagaataattctattacaatttgataaagtgagaatattatagttctttttttctattggtatgtatagaatagataaaaaatgaatttattttgtgatacagtgatgtgagagtattgctcaaacagaagacattaccaacttcgcctattttacttatgtctcactgtctcggcctcttttaagtttggacgtacctacgtctcgttttcatagacaacaactcgcaagctactgtataacagtggccgcctgattaaaatcctctgttttgtcatgttcttttgttaagataaaggattatattaacccggcctttacaccttgggggtgtacacagccaacaactgttttgtcatgttgatgtctggggataatctgctgagtttctgctgtcatagctgaaaaaagttcaggcataatgacaaatatgcacataatcgagtaaaatgagcacagtgccacagtgtaaaaactgcgtaaactcagactattcgcccaaactgtggcaaattgatagtattgtccgttcgttgctaatccgatgctaaaaaaatctcctaaatccgcggcattgtttagtggactttatgcctctacttcctctcaagtgttgaaatgatgcctctactacgtaaaatttgcgtatctttgtatcaggattcaggactggtgggtgtttggggttatatggccttgagcccttgacaagctcatggcatatgtgtgtgtgtgtgatcgagagatggagcaaatgtagcggtggaacttgtggtttgaaaattactatctccgtcctaaaatataaaaagttatcggtttggacatatgtattaaaaaaaatgtaggtgaaataaatggaaggagattatgattggttgagaaaaaaagtaagtggtgaatttgaatgatgtgtttggtttagaaagaaattattatatttttgaataagttctaaatgtaaaaaaatgttatattttgggacggaacgtgtactactcctaccacttattattattattattattattattattattattattattattattattattattattattattattattattattggcaaaaagatttacatttcttctttcttcttatggattgggatcaggtgcagtcacgactgcaactttggcagtagccactgatccaccatccaataggtaaggaacgtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattgataacttttaaagaaaatgttccattcaggaaaaaaagaaactgtaaagaaaaaacaataggattaatgcttcttagttgaacagagcatgagtcacataaaaaaaaggttaaaggagttacatcaaaatatgagctctacttcaagcccttaaaataaatgccaagcttcttttaaacatctaaataagtagtactaaatttcttgtcaaatgaaaaataattgtgctagtatttcatgttcaaatgctaaatgaggaaggaggcaattaagtctgaacgttccttactagttggatggttggattagttgctactgccaaagttagtgactgcacctgatcccaatcctcttcttatgggttactcactgttcaccataggatgctggagtaccctgcctcatgattcggcgaaaacagccaaactgtccttgtaaacgttggattgacaggctttattggtgattctcccaggcccctacctcttgcatttctgtccattcaatcaatgtatggaaaacttttcagatggggtagtactgaagtggatacctcagccagtaaattccacagccgtgagccaattggctctgattggttgagataaaggtagaaaaatgaacaaaacaatcaaaataatttacggtttaaacctttatatctatatcatgtggtttaaaagtaaacggtagtagaaaatagactaggtaaaaaaaagctaaaactgactctaaaattaaaattaagttccactccctccgtttcacaatgtaagtcattctagcattttccacattcatattgatgttaataaatttagatagatatgcatgtctagattcattaacatcaatataaatgtaggaaatgttagaatgacttacattgtaaaacgaaggaagtaaaacttaaattttagccgtgaccaccaacaaggaattaataagagccttccaagtcaataattgagagacagagtgagtgagctattggtttcgaagagtagaagtaaaagtaagttggacattatatagggcgtaatctctcaatttcaatgtataagtatttagtaatggaggtcatatcataatacttggatgatttatatccagtactaggattttatatattggcatagagggaatagaaagagaaggtgccatccaatatatatatatatatatatatatatatatagtaaatttgtttggtgctccatggtgcccgggcaccattgttgaaattgagtatatacccaattcaaatgagaatgaaactttttcaattacttaggtattaacattaactactttactaactagtttaaagcaagtttgaactgaatttgaacttgtttttgttagattttgattctaggtatatagcatccatacatataatttgttaggtatgtaatcatggattgtgaaataaagttaaatttgagttgttttgttgataagtataggtataaatcaaattattataactaggtatatactcacaatttgaaaattttgaaaaatttgagtgattttgtgcattagataccatggtgcccgggcaccatggtgccccatatgagtgtcctatatatatatatatatatatatatatgtggaagagtccatcttctattatatatattcatatgtgtactgcacattcatgggaagttctctacttctcttccttttaaacactggaagtaaataaataaaaaataatttcctagaactgccaacaacaaagtcgttgtagtatagtggtgagtattcccgcctgtcacgcgggtgacccgggttcgatccccggcaacggcgaattagtttttaatttttttggcacttgaaatgcaagatgcatttgtgttttaaatgacgaaatagccgataatttccaaattggaaaaggtactcctccgcaactttacagtacaggaggtgattttgaacttcaagcttcaaaataatgtgttttctttgctgtttgttcagataagcaaaaacttcagaaatgcagtcgtaggtgaaggcagttctttcttctttttacaatggggccatgtatgtgtaagtgtaaatcctatgatttctttgataaaatgattactatcgtattattatcaattccaagcaggttgcttgtgcactggagagacaaaatttaggaacagataatttaaactgacataaaattggtgcatccagggatggtttaatttttttttaatgcaagtcttatcaaggcactacaaaaaggaagcataactgcacaacaccaacaaaacacatgatgcgatatgtaaacataaccaatatctttattctaatttgaaggtgattcgatcctgacattacaactgtttcatcacaccaaaaagaaaaaaaaaattgtaaataccatagaacagccaggacggttgtccagggaggtgacacatttgaagttacaacgctgaagcgatctcagttcaatcagcactaacaaaaccaaaagtatttcggtatttcagtataagcagttcacatgaacaaacgaagtttttatactaccgccctctcacttgctcttggcagtgccgtttgcggtggcaacagctccctttggtgggttcagctgatcccaggcctcaatccatgtgaccatggagtcggcgagcttgttgaagtagccatcgaccttcccgagcttcgccctcacttgcttggccagctcaaggtaacacttttggacagtgtcggcctccttcgggagggacgcagactggaagaaggggatcagctcctcctgccagaatatgccgttgtattccttcttgaggttcacaaaggggttgctcgctttgctgtgccagatgtagggaaggccagtcttaacacccaaacccaagtgatcggtaatcacctgtttttatgacagatattagcatggattgtgattggtgagtggtgaacaatagttagcttgcacaatgcacaaattatttctgaagggggagaaagaacaaaccttggtgcaccatcctgcccacatatcgtcgtaacgaccaataggctggccatcacccataagaccaaagtacatcgcaggaccgatgaggtcacggtcaaaagcaaggttcattccacacatcgggaataaagtgcccttcgggattgtcataacagcatccacatacctgatttcatcatcaataaacaaaaacatcagattggcaagaagagaacgataaaggatgagaaatgccaaaaatgtaacatcaatacctgctgttcctctcaagaggcttgacaagctgggtaggggcatcatagtctggaatgttgagccaaagcccatgagaaacggcagtcggggcaccctcacggaggctgaaggggtacccacggacaaaatcagcgccatcacggtacgggtcatacaaagtgttgaagaaaaatggagtggaagggttcagaaggttcttgatgtgctgctcaagtgcattgatatcctttcctgatgggtctttagcaacctgagattttgcaagaggaataggtcagcaatgaaccaaaaacaaatgatagggcggaatcagagaagtattagcattacccaaaagtaacaaaacagaggactaaaataatggcatcacactccaatgctcaacttttatagtgcaaggcatgtggaagtactcagtcaactgtaagctaatcaagaaaactattgtgaagatcatactagaatgcaactaaaggacatgaaagagaacatgactatattcttatgctgtaaacaactgaggaccattcatatagttaaggttgattctacagtacatccatgcatccataagccagcctaataaaacatataaatcaaataatttaacaagcaggtgggacccttgtggctcatgtgccccatgtgaatacacatggcatttgctttgggggaagaagctacaacacaaccgctgaatacatccaacagtattttttttccttgtagaagtaaaacaaaaataggaatacagtcgagataaccttcatgtacctttatgttaattcctacaaaatttgtgttccactggctcttaactgataactagtgaccgaggcttaatgatgtcatagtccatcacatgtgatttagatggattgtttggtcctgtctaacttcagattaacgtttttgtataaaggaatcaatcataattaaatacaaatctggaaaatgatgtgtagccaataacaaagccaagatgaccccaaaccaaagtggacataccattcagtccaaaagacaccattaacttgaccctttctctactgtttctacattgatatgttctgaagaaaagactactgataacggcctcgagcataaacaaagtaatataagcgtacatatgcattaacacaaccgacaaagcacagcggcaggacgatatatccgagccacattgtcgcgtactaacaatttctgaatactacaaacctgtggggcaccacagatatacatataacctattccagctcacatcccctccaaccgcaaccgcaacctatacatgaccaccaagcaagtgtagctagatccaatgcttgatgcttccaagcagtgggccaagtcaaacgttcaatccaagacaaagcaaacactgtcagatctgataatggcagactacatgcatgattccaaggattaaggagttactaccttttcaactaggcagatcaatcagtcatccgcaacatgtgaaattcacattcaacctacccacatcacagcactatgcagtagtaatagtagtagtatgatgtaatgcaaaaattaaagggtttttttatcactactaaactaaactgtcctaacaaaaagaactactaatctcgcaaaactgaagctaaactcaaaaatctaactacggggcaatgccgattgctgacgaagaaacagcccagagatctcgcctttcccccactaaaactacacatccagatccgatccccaccaaaccaagatctaaaatccccgcacacagatcacgccatggcagtggagaaagatcgcccaagatccagcggccatcaaccagcagatcaaaccttaacagagacagatctcactgaggcgaagttaatcgaggggtggaagggggaaagaagctcacgaagcagtcgtcgtcgatggtgtagatgtacttcttcttggagaccatgtagccgaagcagcggcaggcggagtccttgaaggagatgcaggaggccctggggccgaggatccgggtgatgtcgtcgcggttgtagagctcgtagtcgaagccctcgggcacccggatcgtcttcttggggtcgccgtcctggacgatgatgaggtggtacggctggaagaagggcctccacatctccaggaagtccaggttgcggatcgtcgggatcacgatgtccagctcgtccttcagcagcggcgtcgccgcctgcgcggccgcggcgtcggaggaaagccattgccggtggcggagtagaaggtaaaggtgaaggtgaaggtgcaggtcggggggagtgaggcgagacgaggcgggtataaaagggagggagacgagggggtgggccggatggcccgtggtgggcctcttttttgttgggctttgcgtgtacaggaaggaaaggaacctgtgtgagtgtgagtgtgagtgtgggtggtccgttgttggagttggtgctttgcttgacttattatcactactactggggcatggactgatttgcatggccatggacatggtgcctaccaacaacatctgggatggttggctcaagaggggaagatatggtaacggctacgggtaaaaagggtcgaaatcggtagaatctcttcggaaacgatgctcgatcagccggtaattgaccatatctatcatttaaactactcagtatcgacattaatacgatgtagaaagaaattagaaaaaacaaaatttaaaaatagccaaaaacggtacagtcggaaactgtaccccttaaacggaaacggcgcccggtcgatcgggaatttccgtccgttttcatccctagtaacggcgatgttcttttcaacttatttatttatcggattaatggaatagattatttgtttcatgttttcaaaaagagtaaattaatacgtagtgtaggaacttggcaggtggatgtgatttagtgtaacaaattgaaaaatatgcagaccggtacatgaacttggcaattaagtgcattttggtcaataacattgttgcgtacgtatgattcaacatttcaacttattttgtttgttctcattataagcataattgctaggttattggtcataagtacgttttgcgttgttcatcaccgcagacaatcaaatatgtttgattagtccgatcactcgggaaactatgttacaacagtttttatgcagttagtttttacaatcattatatttttcggtttcaaatcaagaggttattttattattataaacaaacaaatacaatacatctaggctattattttgagagtcattatacttgttagattgcaatgacaactgcttgcttttacgtggcttaaaaagttagccacgatatatggtcgcatgatcaaatgttagccaagaaaaaaatgctgcaaatttgtgatatactcttccttcaatttttatatcatttcgtttaccctcttggacggacagccagtcgttctaagttctaagttctaacggcccttttgccactctagaatgcgtgctagagacaccaaaaccagtcagaaaaacgtctttgagtacgagctgcgcgcgattacttgaagattacacacgcaaatacgcctttccacatcgtacgccatggaccttagctacagctacacgcacatcaccatactattatttacttaattgtaaagatgaattgaatattttgaaaataaaattaaaatcaatggtctaaataatatacagtagaataaagttttttttaaaaaaaaaagaacataaagtgtgaagcactgaagcaaacaatttgtttcaattaaagctagtgaattttgatgcctgcaatataggagtagatggtgtgatcatctgtcacgctcgtacgaaagaaaggacgtacgtttcagcttatatggatggtctcctctctccatgtgagctgcaaggaaaacaaaaccggtaacatatcaatgcctaacagaaaatgatggctgctagaacgtacgcattagtactagtacatcaactaatcgccttttttgaaaataaagaaagaaaaagatcaatgctgacagagtacttacctgatcaaatcggtaattttagttagtttatatccagggtgagcaatgagcgtctttcattttcagtactacttcttccgtccataaaaaaaaatcaagggcttcatcttttctcgcttatgcttatacttatcagctaaaatttgaattttcaattttaaatttagaggtgattttgaggtttttttatcgaagtttatttttcagactttgcttttatatcgctaagaacacgtatataaaattttattcacaaattacttttcgtttgtaaatatgccatttctcttattccgcgaataagccaaatgatggctccgcaaatcttgactataaatctagataaatgtttgtccagatgcatagtcaggatttaaccctttttgacgaaagtagtggaatattccctctgtctcaaaaaaaagcacaacctagataaggatgcgacatctcctaatacaatgaatctggatatgttatagctgccatttcttcatcccaaggaatgaaaatgaaactttttagagatccaaggtatacagaggagacttttgagtgtttatacagatacaataatgagttgacgagacacacgacattgtgattctctcgagatgctcgtctctttgcctgcctcgcacgtcggccggtgatcgatcgccggtgctctgcctcttgcagtccgcactgtacttacaccgacaaagtattttcttttcacgaacacacaaaagctttaccttttgatgtaagatgatgaataattcaagtagaagaaacgttgaaatggaaattagcattgtgatttggtgatctgtatatactgacctagtaacagcttacatcaaggacttgtcgggagtaatggcaatcatctactgatctagtacctacaatgctacataattgagaatcttcagtttacatagcaacagtgattgtactgactaagcttctgtttgtggttctgacgacgaatgcacgatgactgtcctctcctacttgaaatcatggagaaatggcagtgattgtacacaaatgctgcacagttttcacaagaatgaacagccagcttgatatagtgatctcacctcacgctgcaagcacgtagtgctatgtcgtcgcggcagcaaatcagcatttatctgaaactgaacaaccaaacagactgaacctcgtcgtcactcgtcagtactcaggtgatgagaatttttacatcacttctccgaaactgaactgcccctaaatcatccgacagtgctacgaccaacgccatctctaggtggattttcaggcccagatttgtaccagacaacgcctgatttaagcttgttcatgttttcagttgtaggtgagcatctgcatacatagtttttgtcccagttggaatgcaatcgagttgatttatttctttcgaatttacagcggaaatggctctccaattgtgatcctggaattttgcacagttcagaatgtagactggatgaagcaagttcagactccaattgtaatttagatacttcatagagtgttctaaaaaaaacttcatagagtcgttggacccaaaaataggccaaggcccagccccgctgaagttttggcccaacatatgttcacacggcgaaaattaaagtcattaatgggccttgcatcccagggctcgggccatggtccaggttgcctgggcctgggtccgagaaggtttcccagcttcttctttttttttttttgagaatttcccagctattgg

SEQ ID NO: 72378 - DNA, 2300 bp, Oryza sativa
tttcaatttttttccatgtacgagaatagtcgttggagatgttatagtaattaattaagattagttgttattgattagtaactattaggagataactacacgttgggtacttgatccggagtgggaaaattgggcccccacgtcatgctgatgtcatcatgcaaaaactactttaaattattttttctcttaaattatttatccaaatcatgattcgattgtaacattaaattcgttgcaattaaatctttgaaacaagaccacatatagatatattctgacgaaattttttttttgcttattattgaattatttttaaatgttgcacgttgttctaccaagtatatcggaattgtttcactaagtggatcgaaaatgtttcaatcgtttaaatcggacgctgtttcaccttatataaaaacaatgtttcagcaaatagcgaaagaatatttcagttcactacaacatttgatccatatgtagtgaaacattataagtacactaggtgaaacatttttggtgaaacaaaaaaatgaaacgaattcctttaatagagggtttccaaaatatatgggtgatttgttgcaacggagtatgtgtgtggagacacgtggcaggtgggcagggagacgtggtggggccagggggcacgtgcgtctcgtgaggggagcacccgattttactcccccgccggtcgccagcccataaagaatttcgtactctctctgtttcatattgtaaaactgtctagtattgctcatatttatttagaagttatgcctaaatttttattaacatctatataaatataggtaatgctaaaaagtcttacattgtgaaacagagaaagtaattattaggtactccagttccgtataagacttacctggccttcttgaaaggcagcattataagtaactgtagccgcagaaatttcgtacttgaccgaacgaaagccgtagaatttaatcccaagtataataacaaatccgagcgctggcgcctataaaaggtggctcgctcattataccatccacggtcagtctcgcccatcttaattagcttgttgcataggccggcctgcttcaatcaaggtagaaacaagtgtaactctctctctcccccccccccccccttctctctcctctctctctcacattttatacctgacacacattctagttcggtaatactactacgggaagtgtatgctaaccatcaagccatgtacgtaggctgttaatattttgattttaggcaggaacgtttttattgacaggactgaaaatatatacagaatcagatcggagaatgatgcatgattctatcaaatttaaaataatgcatagtctctttgattattgaaatactctcgccattccaaaatgtataacgctgttgacttttcacataacatttgacaattcgcattattcaaaaaaattatataaatatcatttattttattatgacttgttttatcatcaaagaaattataatcttaacttatacttttagatgtttatattaaattctttaaataaaacgaagggtcaaatattatgagaaaagtcaaccgcgtcatatatatatatatatatatatatatatatagggatggaactgcagtatgttcttataaatggaaatctatatatattattgatttttaaaactctatgtaaagttaataaattttagtaataaattccatcatttaaaagggcacattcatgaataattgaattatgacattcatttgtatataacgtggataataaagtaattaatcatagatattaacatactcatctgaaatgttaataaagaagtccttaagaaaatacctgaaggtaccaagattttacactaaaaattttggtacctcaaggtatataacaaatacttgaaggtaccaaattttataaaatgtgatacttccggtactttttcaataatggcccgttaatataggtgttgtcagatcataatccattgagaatccatgcctttgtacttgaccctacattattaagaacacacaattctatgacattttggtcagcacgatccatgtcatgctagctccctgtaacaataagatcctaacatacgtcttggaatatcctatcaacctttcttgcataggctagcagtacatttctttcaactacttaaccatcacttgtttccatttagaaatagataataacctataggcaaacatgaatttagctccattgtattttcttgactctttctaacaaaggaatatagatcataaagataatgcaagtatg

SEQ ID NO: 72379 - DNA, 4274 bp, Oryza sativa
  unsure (1)..(4274): unsure at all n locations
atcggctatatttgagaatactttgcattgactagatttagattgaatataataaaaaagaaattctttaatagaatcaatcctgatagatcgaacctaatcgatacagtataagattattgacaatactaaagttaattatcatatgattataagatctaaataactagccggtgtacaaatatgtgagcagggcttaaaataactgtgatcggctcagaggtgatgcgacatgcaattaatgacctaatctttcgctttaatataagcaactataatacttcctccgtttcacaatatcaatatatgaatgtgagaaatactagaatgacttatattgtgatatctagattcattaacatcgatatgaatatgaaaaatgctagaatggcttacattatgaaacggaggaagtagatcagaacctaccgaggcattattaattgttggtaacaaagatcatatagattaataattatatgagttcagacaatagccgatgaggttacttaagctacatatggataatgtatcggctagaactctgatacaatcttatatgaaaatgtcatatttagttaaatatattaaacaagtcacgttcttagcagatcgaacctaacggtgaggtcaaagataacatgcaatcttaaacaaaagagttacatatcaggcaagcacactgaaaccctgataaaatcccaatcggcaattatagagcatgatatttcttatagctttaattacaacttagtagattcaaacctaaatgatgcaacaccaagttataattgaaattgatggatctaaacaagtccgcttacgcaagatacacagattaatctataacaacaaaacagtttacacgataacggcttaagcaagatgaatcagctgatagcagtaaacaataatattgtctaagattaaataatatatatgataaatgacgcttatatcgactggatcatagtgtcggttccaaccgatggaaaccctagccctgtcgatacatgcgtgttgacggaactcatcttgtcatcgaaaaccaaaaccgatgcagcccaactcaagaaaaaaaaagaactcgtcgaaaagaaaagctagggtggcgatgcaccgaaagttatattattgatgaattgtcctttacaatgatcccgggtgtacatatttatacacatgggttgatactacataattcttgttggatatggcacaaacttttctaaaaataaagtaaaaatatactacaagttctgatcgggctccaaacaatcttttctaaaaataaaatgaaaactaacttactttgtctaattaatagataaattatcatgccacttacttcttgaactcgatcggcctcttctagataaacttcctttaattgattaacttacttaaccaaatccactgatattaatccgactgctggcaactgataattcccatcaatcaattctaggactttgaaaccatactgactttaggccgatgaagattccaaatactttagaccgatgacgattccggagcttgtcaaattttaccgttacaagtaaatcagaggatactcttccgagcatcagcatagccacggcgttaaagcccggacctgttgtcgcgtacccacgacctgctgagtcccacagcgcccgcgccgccgatcgacgtgcgttcgctgcgctgaaccatatcgcgagcccaggggagaggagaactaacgctagctgcacacacacatggcacacggcagtacggcacaccgcacaagggcacctatagctagctgtgcttcttgggcacccgtccgaacattcagccaaccaaaacatactgcgccccggcggtatatttgtaaacaaaaaataatttatgaataaaaactgaaaaataaacttcgatagaaaaacttcaaaatcaactttaaatttaaggctaaaaatttaaattttagctgataaatataaacataagtaaaaaagatgaggctgctactccctccatttcatattaccggtctttctagaatttaaaattttgtatcaaaatatttgctctcacattccgaaacactttcttnnnctgtgtactcttctaatgcagtcatacattaaagtactgtgataacttctattatatatattatatacttagaaaaataattgagatattttcttttaagatagaatggatataaacccggctgaagctacagtgatttttacgaggaaagataaggttacatgtattaattacaatcttcttctacaagtagctccaaaaaatgtatcaccgcagcaaacggtggatgaaatctccttcaatgtgagagccaatatatcttgaccggttttcagtagtgaatacaaattgtgaatacaataccggttttcagtataattcacggctgaacaaattgtgaatacaatccgtttccaaaaatattgatgaagccaacaccggcatttttacccatattttctcgcgcgcaagtggagatgttggcctagtttagctttttatgagattggattagcgcgataggagatgggaggacgattgtgtctttaaaggactccctccatttcaaaatataaagaaaaacctaaaactagattcagatatataatattaggtgatgtcatatcttangttggtacactactacacaaagagttataggtgccggttcgtaaagggccatagatgcggattttcatccggcgccaattggtcggtaccaatacaaacaattgacacctatgaggaaaatagaactagcacctttagttttgctcgagccaaaaaaacagagagcccgctcgaatcgagccgaaatcaccaagcgtcgttacctcgccatgcgcccatgcgagttactccaaaatcaaattgaaatcccaaaatccccaaatcatccacaaatcatcaccaaaatcgattgacatcacataatgaacatactcaacaacaaaatcatccacaaattcacaaaaacatttacaaagaatccacaattgagactggggagaggaggagaggggatgacaaggggctggccaccgggcttcttcatgctccaccttctacttcgtcgccggtggggagaggagggcgttgccgtcgcctgccgcctgtcgtccgccacctcctctcttgcgccaccgcatgccgcctcccctcctgccagatccggcaaaggggaaggcgcagacgccgccgctgccgtcgccgaggtgcgccgcctcccctcctgctagatatggcagaggagagggtgctggcgccgccgcccccatcaccggaggccgctgcggcctcccatcccgccgcctcccctctcgctagatctggcggaggggaggtcgcagccgccgctgcgcgtgacaaagagaagtgagagaggcaagagagatagcgataatgccgatgctcactcattcgtatggataaggtcgacgacagatctgctcaacaaatctataattatttgtagatgtcgattttaattaactaacatttataatatattattataaagatgtcgggttttctaaaaaaaatcaatatctatagtataggtgacggtttttctttagaattaacccctaaagttaattaaaggtaccggttttatgtattttcaatccacggaagagagggaaaaatattataggtgatggttttagctgtttcgataactatagtcacaatcgctaacatgatgtcctcgtggttgtgccaagcatgtccttttcgtaccttgcgtggacgagttgaattcctctataaatgtgaccaaataaacctgaaccgagaccgttaatttgcttccttggtctttcgttgactctagtatagcttatcatcccagaagttttcctttgatcgaaagtggccgcccaggcatctggggagtcaaaataccacatgtgatcagtaaatgcacacgtacgtacgtggacaaatttctaatatggtaccgtaggctggtagcatcgtccatggtttaaacatgtactcccccgacctaaaatatacttcctcttttctaaaatgttgctagctaagttgttgtccagattcgttgtcataggataagtcaaatatcccattctagctagatagcaatattttagagcggagaaagtaagaaattaatttgtgtggatgtgacatatcctatgactatgaatctagatatgtcacgtccacctaaaatctcttatattttgagacggagagagtacaatattattgattactcc

SEQ ID NO: 72380 - DNA, 958 bp, Oryza sativa
tagagcgtccttttttaaggaaaatcaaattcaataacttttgactaataatcatactaaccatatatatgctaaatattatgcaagttatatcaataaattcatattttaaagtactttcatataatggtaattttatatttgttgggattgtaacatgaaattaattaatgatcaaactatgtttttgaagaccgtataaaaaatataaatcttataatttactcccttcgtttcataaaaaaccaaactagtaccagatgtgacacgtcctagtactaagaatctggacatacatctgttcagattcatcgtactagaatatgtcacatccgaatccgattctagatttgttttttacgggatggatggagcaggacttatggagcagctagcatcaacgtgcacggcaggttggcaccccgacctctgcaggtatcgcacgtacgtgccgtcgaatctctgcaggtatcgatcgtactcctgtatatcaacgtgcacggcatcccgacctcttcttatcgttgaccaacttgtagctagcagcgttacgtgcagccaccgcccgccgccgatcttatcttgttgttccaatccacatcgtccagctcggccgtcgccggtacatccggcttgtcaagtgcaccgcttcttcatttttcttattattatctacaccttcaccagctagccgtcgtctttaattattcatcaatttacatatctgatatcgtattaaagtttaaacctgtactacaactgaagctaagggtatgttatgtttagttcacattaaaattaaaaagtttggttaaaattaaaacgatgtaacgaaaaagttaaaagtttataagtgtagaaaagttttgatataatagaaaagttaaaaacttaaagaaaaagtttaaaactaaactcggtctaaacagatctcccaaacctttttttttcgcgtcaa

SEQ ID NO: 72381 - DNA, 10504 bp, Oryza sativa
attctggagcccattggcctggttttgacacccatttcttcgtcgccattcctgccatccttcaaagaagttatcacgaccgtctgggactgacttgtgttgtcatggacattgtgggaaatgtgggtaggagtaatcgttcttgtatgttggtattttctgtaaagggcaaacacatttaatcttgttctctgttgactgttaagtagcgctccatccaactggagatgtgatggcgatctcatgtcatgatgatgtagtttagtagccatggaatgaaatgaaatgaagctgagccggttataatagttgtatatctccatctctttcttgacttgcatcatgctgtctgctatgttacagatggctctgtctgctacattacaaaacgagactacgtttgcttgcattgtgtgaccaaaattattattcttgtacttatcatctaataataacgagctggcccttaacggcagaggcatttgtatgcatacatatacatggactaatatagacatgctgcttccttcgtcttaccaaggaagtaggaaacataaaaggaagaaatgactcaggtggtatttggttggggggactaaagtggggctaaactttagtccctctcacaaaaacataagtccctaccatagggatttgtacttttgtgagaggcactaaatttagttcctagtttccaaacactcccttaggattgatatgtaaaaaccaaatccattacagaaagtagcaggtcttgaacataacatattagccattaggcaggtaaatcatccagcagaatatcactgataaaaaaaaattaagcggctcgtgaatcgcccaatctctgcagcttgtttcatctctttccccctggcagcctacgtgatttcttcttcttttttcttttcttattagactccatggcgccagttcttaccagagttcctgtctcacctacatcaaacacacaacagaaagggttacaccttttcttgctccctaataactagggcaacatagggggtgtttagatccataggtgtaaagttttagcgtgacatatcgaatatacggatacatatttaaagtattaaaagtagatgaatttattaagcctaatcaatctgccattagcaaatgtttactgtagcaccacattgttaaatcatgaagcaattaggtttaaaatattcgtctcacgatttacacacaatctgtgtaattagtaattttatgtgtctaaacattcgatatgacaaggtgaaaaattttacgaggggatctaaacaagcccatacagtaccggatcattaaacagaaactagtacattctgacagtaatagaattatctttttacctagaaaaaaaataccgttcgtatgcttttcaaatactgtttcacttcaggttacttttggtcagcatctactaattacataaagcctagaggaaactgttaatcctaggggtgctccctgaaaaacagtcatggatgaactctctcccctccccccacccccaaaaaaaaaaaaaacaagagtcatgaatcaaagtttgtaacatgtcaacttctaacagtagtcaaaatgaacccttctccaaatgaacaagtcatgaactattgaacttaactcgagtataataaatacagcaataccccatcaacacaggtcaactagaaattacctgtagcgttgatgagatatttggagatctcactggtaatgtagtagcgcatgaagctggaattcttcctgtgatcaagctcagtcacaccttgcagtgtcttatccctcagatcaacagaaataacccatctcttatcatcactgtagccgatcttggacaggaaagagatgacattgccatccatgcccaatgtggggtgacctgtgagcaacctcctcaatgtttcctctggatcattgcagatctttggcagcagctcactgtacctgacattgtcgacgacggcgatgtcggttacatccaccgtgcactccctgtgccaatccttccatgaaccagccggtatcggcctgctccatatgttggccttccagtagtaagcaacatcctcgtctgagccgtcagaagaatccgagtcatcagaattatgttcaatcaaccgtcgtcgccgccgaggtggtggatcaccggggcgtgtcaccatctcgacgtacttgatgcaggagggagcagagtcctgcacgacgacggtgatgtcacggtaaccatgtgggtagcctctgcagaaggatttccggttcctcctcgccggcttgggcagcggcaggtcgcggagcacggggtgttcgtcgagcacgtcgtcgcagagcaggattcccctccagagatccacccagccgacggccatggcgtggtcaccgccggcgagcgtgatgaccttggtggtgtagtggaagagcacctcggtggcagtgtccgggatggggagcaccctgtccctctcggccggctcgtcgacggacaccgccgtggaggtccagcggccgacgtcggagtcgaagcgctgaagcttgaactccatggggcacctgatggtgggcatgaggccggcgatgacgtagcgtgcgccgcccgagcagcggacgatggcgaccgcgtcgctgctgaagggggaggcgtgcgggttgggcagcagccggagcgacgggcgggggctggccgtgtagacgaagtagtcgtaggatctgatgccgcggtagagctcgtcgttggggtgcgggacgaggaggagggctacgtcggcgtgcgtgctgatgactcggggatcgacggtgaaccggtaggcctcgccgtggccggcgccggggcgggggcagtggacgcagaggtaggagaggcgcggcgggcgggcgaggcagaaggagacgtggatgcgtacgccggtggtggtggtggagacggcggtggtggcgttggagacggcgtcgggggagacgtaggcactcgcgtcgaggtacacccagcttggggttgggctcacgccgccgccatcatcgtcgtcggccgggagcggaggcgaaaacagcaatggcaggaggagatcgtcatccaaggggatgggctcatcatcatccatggcgaatcacggagacgatccgatcggagatcgacgaacgcctctttggattggattgcgcccaccccacacgcattccgagctcccgcctatctcgctcgctaattgcgatcagggtgaaatttcggaccgaatttcttacgatattacttcgaccgaattttttcatgaattttggtagtatttgttcaaattcaactaaattttgttcaaaatttcggaccgaaatttcggtgaggcccaatcaaatccaacgccggcacgcgggtgcctccctccctacagcagccggagctccgccgccgttcctcgccagccgacggatagtcctccagccagggttttcccttcgggaaacaagaaaatttcggtgggcaccgaaattccgaaatttcggacaaattctgatatttcgaacgaaattttttgaagaaaaaaaattctgatttcgaatgaaatcttgcttttgaagaaaacccaaaagcaagagagttcattacaaaacgaaaggtaaaacacgaactctaacgatggggtcgccagcttgacattttattacagtataataaccgaagaaaattcctgagcatccatttcaggccaatcatcaggggaagatagcagtttaacttgggataaacagacgaaaaccaaatccattacagaaagtagcatgtcttgcacagaacaactctgataatagctcattacagaaagtagctcatgaatcgcccagtctctgcagctcgtttcatttcttcaacccaggtagcctacgtgattcattaattaattcctacttcttcttttttgagactctactattaaccccagtttttacaagagttcctgcctcacctgcatcaaacacacaacatacacagagagggtttaagtggcacttcaaaaacaaatcctaggagtgcactctgaaaaacacactcatgaatcaagtttctaacctgacaacttgtaaacagtagtcaaaatgaagaaggttatgaactatccattagattatttgactattatggtgcaacagttataaaacaaacctgtagccttgataagatatttggagatctcactggtgttgtagtagcgcttgaagaggaaattcttcctctcatcaagctcagccacgccttgcagcgtcttactcctcagatcaacagagataacccatcccttatcatccaagcgattgatcttggacaggaaagaaatgacatccccatccatacccaatgtggggaaacctgtgaccagcctcctcaatgtctcctctggatcattgccaatctttggcagcagctcactgaacctgacattgtcgacggcgatgtcagtgacatccaccgtgcactccatctgccaatcctcccatgaaccaactggtatcggcatgctccatatgttagccttccagtagtaagcaacgtcctcttcctcatcagagtcagagtcatcagaatgttgcggcggctgtcgttgtcgaggaggtggccgatcaccggggcgggtcaccatctcaacgtacttgatgcaggtgggaacagagtcctgcacgacaacggtgatgtcccggtaatgatgcggcggccctctgcagaaggatttgcggttgcttctcgctggcttgggcagtggcacgtcgcggagcaccaggtgttggtcaagcacgtcgtcacacagcaggatccctctccagagatccacccagccgatggtgccgccgagcgtgatgaccttggtggtgcagtggaagaccatctggctggccgtgtcagggatggggagcaccctgtccctctcgaccggctcactgatggacacagctgtggatttccagcggccgacgtcggagtcgaagcgcataaccttgaactccatggggcgcctgatggttggcatgaggcaggcgatgacgtagcgggcgccgccggagcagcggacgatggcgacctcctcgttgcggaagggggagacccgcgggttcggcagcagccggagcaaggaggcgcccgggcctgggcgggccgtgtagacgaagtagtcgtaggatttgattccgcggtggagcccgtcgttggggtgcgggacgcggaggagggctacatcggtgtgcgtgccgaggactcggggatcgacagtgaaccggtaggcgccctcgccgtcgccggggcgggggcagtggacgcagaggtaggagaggcgcggcgggcgggcgaggcagaaggagacatggatgcttacgccggtggtggtggtggagaaggcggtggtggagttggagacggcatcgggggagacgtaagctctgtcttcgaggtacacccagcttgggctcacgccggcggtggcgtcgtcgtcggccggcagcggcggcggaaacagcaagggtagtagcacaccctcatccatgacgtaggggacgggctcatcaccatcatccatggcgaaggcggcgagggatccggtcgaatcgaatcctaatcagcgatgaggaggaggaggagctaaccctaaatcggagttgtgccccaagacgaggaagaatggggaatttgaggtttccttttttttttttttctctctttcccccctcacccgcctcgggaaagacgggagttggattttcacctaatctgaaccgttgtgtctttttctacgcataggattaagccacgtctctcttcttgttccttgatctgtctccagggagaaaatggatatttagccattctcaaaacactggaatgctattctgaaaccgcgattgttaaaatgccaatatggaccgcacaaccatagccacttttccattttctttattttcgatttcattttcgttggggcagagcttgatgagacgattttgcccctctccccactctcttctcctctgctcgaatcggagggaagagaagaggtcgccgcgcagcgatgccgttctgcagcttctacgcctccacctccctccagcttcgacgaggaggaagaaacggtagggccccacatgttcggctggtgcccggtgaggtcacgacctcgccaccgcctgcgcgaggcgctggaccttcgcggcgatccctggcggctgcggccgctcacggccaccgcatggttcccaacgatcctgccggcacttgtgctccgccgtggtggcaccgtcgtttcctcctcgcaaatcagtccccatctccctttgctcttccttatttttttttcaatatccacatcacctcgcatggttattgctctcttgtttgattggtgtttcttttgtctcattcaaagaagcattcatgttggggatcgatatgaacggttgtgcttgctttctctgtccctgagatggatacacgcttgtactagtttgcaaatcttgatggtgccggaggagtatgtcggtgtcttgcaggtgtttggggtgaatcctgtcaggatgcatgcggtagtgtgcagtaggtccttgtggaggagccggcgacccgacgaggcatgggacagcgaggcggtgggacgtggtcgtcggcgagcagaccagcgggtaggcgtcactgtaacgccctgaaaatcgccctaaatttaaatcgtgctttaatgcatttctagaaattttaaaagcctaaaagagcctccaacaattaaaattcaccaagatttatgtcaaattggcttgtgggtatttttaataaattccccatgcttaaaaatgtttaaccaatttttacttgaattttcagagcatcctaaataattttaaggcaacaaaaacaattaaagaattttacaaaaaggaaaagctaaaagaaatcatcttcctcctgttgggctgtttgcagcccatctctctccccctcctctcagcccagcccagccgccccctcaccctccctctctccccttccactgcctctccttgggctggctcaactgctccctatattcctggacaaaagtctgcttcacctcccctgcgcgcccagcctgacaggcgtgctcctactcgatgacaggtgggtcccactcgtcatccctaacctccagccatcctctctctctccggccgaattccaagcgacggcaacctccgattcgcctcctccactcgccgtttcatcaaattaattgaggggaattaattcccacctcatcctctccaattcccccataatttcccactcaatcccacattattcgtggtggattttgatgatgctcatcaatggtgagctccaccatgccccgcgtcgatctccctccccggcgcctctctccctcccctccggcctataaaagggacccccgactccctcctctctcccctcacaccgctgccctctccctcctctctccgcggccgccgcgccgctctcttcttgtgccgccgccgtcgcaactccggccgcccctcgccggtggtcgggacctcgtcggagcccggcgtcgccaccatccgcttcgtcgcttcctcctcttccccgtccacccctccgtcgagtacaaggaccgcgggaacgacgccgacgccgacgacccgaagcttctcgtcgtttcttcctcaccgccggcaacaccgtcgacctctcgccgccgtgtctgctcggtgagaaccgtcgtctcctcccctttccgtttttcccctttccgctctccgtcgcactgccgccgcgccgttggccgtcgccggcgagccgcctggccgggtgctgctcctgcccggccgtgtctgtgcctcggtgcaccgtgagccacctcggtgctctcggctcacagtggaccgagcggctgccaagtgggacccgcccgtggacccctctctctcttctctgtgcaataaatcaatttcctttagaaaaataattcacaaaattgcaaatttccatttaaacaacacctaaacttcaaatggccatatcttgaccgtttgaactcggaatcgacccgttcaaatctctaatttctcctaaaaatgagtagaatccatttatgtgctttattgcttctgttcatatggtttttattagtccttttgtatttcttcgcgttggtcgtgtagatcctgccgttccggaagatcagctcttcatcgccgttgacgccgaagactttgtgagcgatcaaggcaagtcatatctaccttgaacatgttgaatcccatattgtgaaaattatgttgttttacttatattgcattgctttataaattataccgttcattattaatattgttttattagttattcctatgctcttggttatggccatgatgttgatttgatatccatgatctttgtgaaccctagtaaaattataacttgactagtctagtaccctacatgatggactgactagttgctttaggtaaatgcttagtcatgcttagttccaacctagaacttttggttaaactagactttggtggttaacaactaaaattggattagttatggactattgactggtttgtcaatagatgggtgataaaatgatttgtgcaactaaaatatattttttttgggctgggcttggggtgcaagctagttactttggtagtcgcaccccggctaatataaggaccggtcttcgggcctctgttgcaaggcatcttcgtgcaaccacaagtctagtgggtaaggcctgactggaaatttagatcttctcaaaacagagaccattggttggaagggtgtggggccaggattaaggccgtttttcacccggcgcaagggggggcctgactcgtcccgggggatccgacaacctttaccttgtcggggaccggcgggcggcgaaacctcagcgggttctcctgttttgggtagacctagatggatagtcttgtcacgacctctatccgagtaccgtggtggtacccggcgcgtggcaacgcgtgttgaggttgtgtcttgtgggtaaagttgtacacctctgatcagagttaaaaactattcgaatagccgcgccctcggttatgggcaagctgagcaatgtacccaaagttagttttgttttataaaacattggagggtgaaatcatgatggtgtagtcatgtggagattagcctgggttaaggcaggttcgcaggctcatgcgaccttgatgatattaaaatattggcttagaacaggatcgtgttttaaaatgagctttaacttgattaaaatgtttaaattatggctttatgcaaaataaaccctattaggccatttccttgttttccctacgcattattgttgcatttccggtgtgacttgctgagtacggtggtggtactcactcttgctcacaaaaataatccagaggatggacctgaggaaggtgaaggcttggatctctagttcgctccgccgtcgagtgcctgtggctgctgctgttccgtagtcttccgctgttttatttgtttatctttgagtgtgagggcctaagtcgcccatgtaatcaagtactcctttacgtttccgcaagtgtggcatgtaataatcaacaatgtctatgtgtacctcgcctcctgggacgaggattaatgcactgagcgtttggaaatggtgtatatttccgggcgtgacagtcacgaaacatgcgtgccgctgctcaccggctcgctgcctccatcccgcgccccaagtgagtccgagcaggcgagcaccggtccgtttttaggaacagcgcacgtcggcgtcggctgggggtgcctcctcgccgtcgaacagtcgaggatggggtcctgaagacagagagcacggccgtcgtgaaagcctaggcggcagaggtagaggagcgccgagcggagctggtcgcggacgctgcaggcgagggtctgggggcatttgacgacgacgcggcgttaggtggtgtccgggacggcgaggtcgtcggtgaggaaggcgaagaccgggcggaggtcggcgcggacgctggcggtaaagaaccgccaggagctccgtcgggatgtctctgtcgctgtggtgacgaagcagcagcaactgggtgagcaggggtaatttggtctcatcaagccacattgcagcaaatatggaattgaaaatggcaaaatggctgtgatcacgcgcttcatattggcattttaacgaaacacgcttttgagatgtcattcctctcctcttgaagccaactcccacaagcacatgatctgagtgagtcttgtgcatacgaaaaaaaaaaaactttttccacctgcaccaagcaccatatcgattgaaccacgggtaaaaatgctccctgctcctatattccatatatttaaatcctaatttcagctatttttaaattgtatttatatatagactatgtatttttaaatctgaatttcagctacggggaagaagaaatgccttccacacgatgtggcgatgaacggactggc

SEQ ID NO: 72382 - DNA, 2252 bp, Oryza sativa
acacagttagtctttactcaaaagacaaggcgcataagacttccttttctcttttctatctcatgtagagagcaaaccttccagctgggggcagggcatcaatatgaatctttggggggtcatttgatatttctctccattgatcatcaagttcatattcggtgatgaatcttcctatagcacttcgcaagaagcccacgaccctgttcagaatgaacgcacagttacaacatttgcaaaagataaagatctgtctatacaacatacgccataaatttgaggtataaacttaactacacaatccaaaataatctgataaattccaaccacagtatttggcagaatacatgttactgagattagtaagaacattttgaccacaattggatttcctaagaagcataggaaattattcatacactttcagttgacattaaaagaaagttacactctctagtcattcatatattctcctgtcttcagtctgctctctattaactacttttgcttctgacttccacatgcatgctctctctatataattgtgtcaccataaattaacaaattcgaaaggtaatggcaggaatttgtaaagcgattcatcaatattttcagctgatataacatttggaaaaaggcaatgtaaataagtagcaagtcgcacctcgcatatgagttggatatttttgtacccaggtttgcatattgtccttggaagtgcccatagtagacacaaaaagttttgctgttctgatagaccatactctttagttccccagcatagaaaggcccttctctgtgctctactgtgaagctgcatgagactataatgtcaaaaaacaaatttatacatccttcaaaaaaattataatatgactagaaaaagtgcccgtgcagaccccacatgatcatgaaaaactatcacgaagatcatgaagttgaaaaatatcatcgtatatgtcattaacatgtgggtccagaccccacatgatcattctcgtatacgatagtatttcacaactcacttatatttatgatggcattttatgaattttctattgtatgaaatcattgggatttaatttagacatatttgcattattgcagggagcaatcctgacatgtactcataaacatgtccatatttgtatcagagagcttaattggatgtgcatgtgtaggatgctctcctacggtagtttccctaaaagaaatggatttacatgcatatgcatatggagccatggagacgagcagactacataaatagccaattagcagaagagcattgaggcgatgatacacccagcatacatcttcttttctcaatggaaggcccaaaaaatatctcaaaccagtctttaaaaaagagagcccgattcagttctctgctttaagcccatcccaaaactcctattatgattactggattttacgtaggatcttcacttatgtgcacacatgtgtcggaagaagaaacatagtaggacagctatgtcgttcgtaataagaacttgatctgatgaaacacatcttcaatttttataaatcacattgggctagtcttatgctctctaggatacatcaatccaagaaatagttgataccttcgaaggaactgaaggaagttgtagccaactgtttcatcttctcttttgttcaccactgcagctgcataacttcgagggcttggtgtctgttgggactgggaggcctgctgctgccgctggccgtgttgggctgcctcgacgacgtcagtgggcgaggccaacgttcccgagcgctgcggctcgaccgcggtccccacctccgcctccgcctccacctccgcctcctcctcgacgcggacggcgggcgagctgtcgcccgacccgacattggcctctccgcggtcgtcggtcttcttccgaggcttccccttcccacccttgttcttcttcttcctaccaccatgatgaggcatctttagtagcctagcggggatgcttcgctctgcgatccgcggtggggcaagccgaggcagcggcgggaggtgcgcccgcgacgtgctcgacggaatgcgcacaagagggtgggagggcaggagggggagcaggtgggagggcaatgggtaaagtaaaaaacccctcggcctcatccgcactgaggccggcgtgggttcttatatacttcggatagacgtgttgaaccacaagctactagtagtactaaagttgaaccacaagctaggagtaccgtgtatataggagtat

SEQ ID NO: 72383 - DNA, 1213 bp, Oryza sativa
aatgagagtccaagtaggaatccaaattaaaaatagctgaaattcggaattaaaaatacaaatattaaaagaagagtccatgtaagaacccaatacaagattaattaaaattcagaataaaaataaaaataaatctgaaattagaaaaagaaaataaaagaagagttcaagtaggaatacaataaagagtaggccgcggacgggctatagagaggcataatggcatcgtttaatgggacttctaaaaattataaaaaatgaaactacaagtctaatttttaaaggtttggaacttctaaaaagtaaaaaaaaaagcaatgataatcatgttcgatattaaaatctcaatgacaataaagaagggaggcagcgggcgagctatagaggagtacaatggcaaagccgctaacggtttggcaggacttctagagagtaaaaatgaacccagacaataattatgttcgatttttaaaatctcaatgacaataaagagaaagacagtggatggaccatagaggagtataatggcaacgtttgacgggaaatctagaaattataaaaacgaaacccaacgtgacaataaactctacaaactataaaaatccaattttaaaagatttcaagaagaataagtagaaatagtggtagatcgagcaagcaaatgaagaaggagatgacataaaggatagcaactggtgtgacttaaaactatataattaaaaacacgaggatgataaggtttggtctttcaaagtcttaagacaatgagatagctatttaataaattttaagtaaaattatacttaaaaaatatgattttgtttgacacaaaataaaataaaatccgaaattagaaaagaaaaggagagtccaagtaggattacaatttaaaaattactgaaattcggaattaaaaataaggaatattgagagaagagtccatataagaacccgatacgagattaattaatattcggaataaaaataaaaataaaatccgaaactagcaaaaagataagaagagttcaagtaggaatacaatttaaaattaactgaaattcggaattaaaaaaataaaaaaatatccaaaattagaaaaatcaaagagagtttaagtagagatgtaattttgaaacaactgaaattcaaaaataaaaaataaatttaaaagaacactatactgtattaattaaaatttgaaaaaaataaattc

SEQ ID NO: 72384 - DNA, 16514 bp, Oryza sativa
  unsure (1)..(16514): unsure at all n locations
agtcgcggtggcgagacgcaagcggcccttacgcgttcgtgggcgcggcgggagaacggcggaggcgggtgcgtcgtggccggcagagagggcgtggagcatagtggtggatagtacagtcacggggctgagggtggcgaggacgcggccattctcgtggcccgttttcttccttccgacggccaaccttccacggcagtctcgatctccgccgccgccgctccggccctcgcccgcacgccgctgtcgccgctccagtgccactcccaggtctccgccgccgctggccaccgtcccacactcgcggagagaaagagagaggggaggatatgatttatgtgggccccacatgtcagtgggtcccacctatacttttggtgaatgacaaatgggtcccacgtatattttttttatttctaatgccacctaagcgccacgtcaacaccatgtggacagaagaccgagtcaatactgacatgtaagcgccacgtcagcgaaactgtcctccaaaaccaccaagggagtcaaattgcaccggttttaagagttgggggtcgagatatccggttttgtggtttagggtcatggattagatttcgatcacttttgagggtcataaagtgaacttattccacagaataaacctagcccaaacatgcaaacaattgtacaggtggcctcaaatgaaaaaaagaagggagggggggaatttataccttaattagtccgttccatcgtgccaccttggtcaatataaatgcttgttcagtttattaccacttttaaccttatcattttttatgttatcaaatttggtactctctccatctacttttgatagtcatatttcatcttgacacacagaccaaggataaataattctacttatcatctatttaaatatgctactagtcattcctcgtaaacaagcgattcattaatatttacatttctcaatacccatgtagccaatcatgtgttgaagaatggagagtcacgcattaaatttaaaaaaatcattaagatgataggttgttggattgaaatatgcctatcaaaaataaaatttttagatttgaaaatatgactatcaaaagtagatggagggagtaataccataaactaaacactcttcttcattgtcaccttaccaaattttgatatttctaaaagtttcttccaataagagaactttcaaaatttggtaagttacaaactgaaaacattcaacaataccaactttgatgacaccaaagtgtgccaatatttggcaatgtcaaatcttagtgagattgattttgacaacgagctgaactaagctaagaacgcaagcaaattaggtattaactgacagctccataagtaactcgaaaagataatgaaataagtcagagctttaattttgtcttgtgtttcttcagaaaaataaactagcactcgactaagctaagaacgcaagcaaattactatgtaaaaaaaggacaagtccccctaagaaaacaggcacctacttatgtgctcgagttaaacgacatatttgaagactatttcctccgttctaaaatataagacacagccactcttaacccaaagaccaagaaacaattattatcatcttctagtttgaatcaccataataaatactcactccatctacttttgatagtcatatttcatcttggcacacagaccaaggataaataattctacttatcatccatttaaacatgctactagtcattcctcgtaaacaaatgattcattaatatttatatttctcgatgcctatgtagccaatcttgtgtagaagaatgaagagtcacacattaaatccgagaaagtaattaagatgataggttgttggattgaaatatgcctatcaaaaataaatttttcagatttagaaatatgactatcaaaaatagatggagggagtataatacatgcatccaatagaattagaggtcttgatggtagaggattaaaaaagtaataatttaacggggaagaggttctaattaattgtatgcatgcctgcatgccttatattatggaacatccaaaaaagtagttgtgccttatattatggaacgtagggagtactacatgatagatttttctggacaccacccattttgtttccatgcggtccgaaactgaaaccgcatggaaaaatggggggacgagcaccgggctattgcccgcacgtcttaacccgactgcacgggataatcctcgttatcccgtgctgtcgacttaagagaaccgtacggaaaaatcgattttcgcgtgcaggcttttaagtggactgtacggaaaagtagatggagagtatggacgaccaggatggatagaagtacgtatgtatatagtatacaactccctctatctactcgtgatagtcatatttctaaatttaaaaaaaatatttttgataggcatatttcaattcaacaacctatcatcttaatgattttctcgaatttaatgcatgactcttcattcttccatacaagattggctacatggacatcgagaaatgtaaatattgatgaatcgtttgtttgcgatgaatgactagtagcatatttaaatagatgataagtagaattacttagggcagtcctaacccataacactagacatggtttccataaactccacatcatcaagaaactagtactagacactactcttccaatgcaaacaccactattccatacttcaatttaatgctacttatctcacatgatgccttggatgttatgtagaaaccatgtctcatgctagatatagtttccttatctttcctcatttattcacttgccacgtcattttttttcctaggtggcaacttatttaattgctatggacaccatcctatttattggattgggaatgtacttatccttggtttgtgtgccaagataaaatataactatcaaaagtaacgaagagagtatatttatatgagtagtacacaagtctagtcttggtactagctggcgagccttgtgcatttgttgcttaattatctcgggaagggaaagagttggggaggtgagaactgagaattgaaggaaggcagagcaggggagtcggtagctagtttttacggtgaagaagatgaaacgatactccggtaattgatccttgattaatgttctagtggtactagttttattgtgaggtttaaacggatgagggttgtagctgagtcaatgacatgtcagccacggcaaattcaaatggacgtggctttgcatacaatattttttacgaacgcaaaaaatttgcacgttaatatattataagaagatggcataatttagttacacaacacaaacggtcagaaagccgttgtcaggggccaagaaaaaaaagaaacaaaaaacaaatacataaacggttagctacagaaaaagaaaactcctaccacgagggagggatgggtatggaaacccactacactccggcctgcatctaggcagggagctggagaagagcgaagatagggcgatgacgttgtaagccgcaaccgtctcgatttacacaggaccctccgcctcgatttacacaggaccctccttagacaccaacccaagcttgcatatcagattgtgctgcgcacacgagaccgtatgactcgggccgtcgagcgcgagtttggccgcaatcctctcgctgtggctcggcacttccccatggccgcgatggcaggcgacggaggcgggtccagtgggagcaacgcagggggcaggccggcagaggcctagagcagctggcaagaaaggcgcgtagagcaacgttcaagtccgccatcggccgaccctcaagatcgagaacgaccatctttgcatgccaatactcgtattagcggattgtcctgcctgaaatcgttggaattttcagtcacctttgaatttactggatgtgcaatatagaccaatattctataggaattgtatatatatggtttggaaaactcaaatccttttaatcaaaaggccaaataaaaaaaattctataaaatttcaattatatgaaattcctctgtaaatcatttacttcaaagaggctctaaatttcttttatgtttcaagccaattcaaatgattttttttggaataataattcaaaggaattttgtaggatttccaaaatttcttcaagtaccctgtgttccaagggatatttgtttggataatagggtttagacatgttaaattcctacataagtttaaacggcaacatacttaattaccacaaaaacttattacacggcaccttattacacatgaccatggatgtactagcatataaccacgtcgcctaaacaccgtgaattactagcccacacagattcacagccaaacaagagtaatctaagcatgaactccatcacaaatccctccttaattagcaaggcgattactcactcaaccaaacgccacacacgaaccagcaagccaacgccagcgagcggcggacgtcggcggcggcggataccatttcttccctacaggaaagcggcggcggccgccttggcgcccaccgtgcgcaggaggtggaagtagagcttggggttcgccaggaacgccgcgcgggagatgacgtagccggcggcgcccggcgcgttcatgatggcgccgccgactgccgccgtgggccagaggaagtaggcggccacggcggccccgccgacggccagcgccgacttccccacgccctgctccttcacgaagccgacccccgcggcgaggcccggcttggccgccgccgccacggtggaggccacggccgccaccgcgctcttggcggagttgagcaggccgccgacgaactcgctcacgccaaccatattctgctaagcaaaccaaaacgacagtaataaagtaaagtagtattagctaccgaggtgaggactgagtagtggagtcttccgttgcttatgtagaaggccatggctacagtaatatagtaaacttctataaagttgcaacttccaaaaagaatttaaaaaaataaaaacatattcttattagaaaaatctagtacataataccagttccaacccaaaacactagacatggttttcataaactccatattattaaaaactagtactccctagacactactttctcaatgcaaacaccactctttcatacttaaatttaatgctacttatctcacatgatgttttaaatgttgtatagaaactatgtctcacgcaagacctggtttccttctcttttgtcattgccacatcatgtttcattctaggtaacaacttatttaatgctatggacatcatcctaattattgggttaggaatggcctaatatgtcacatcccatactaaccttgtatttttatgaaacgaatggagcagtcccaatatatacgtatcatcattattgttctaattatatttttataaagttattaagaatataactatataaaagtaaataaatctaataattttatctatatattggatttttaataactttctgaatctattaatgatttaagagctcaaggtttgactctgtgtagtatacaccattagagcttacttggaaacgaaggaattcgacattggtaaatactacagcattgattgattgtttgcacggtcccaaggtgattcctttggctaaaaaggtcttaaagataggaggtgcaccatgtaccaccagcactaacgaaacaaaagtatgagctcttgtctacgcatcacaagcaaagcaacagtgaaaggtcaccttgactaacaacagtgaacgacgaaatcgaaaaaggtaagaaaccaaagctgtggaaagcatgaaggtgaaatggaagtgtgacgcaagatgggattccctgattgatgtcatgtatgcttatgtcacgttatgctgctaggaaagataaccggcaacgaatctgggagttttttttggaaataatattattttaatggnanancncnnnattatnngtnanttaaacnaaatcncaagtttaacaccctgtccaacggaggcagttcgaaagggtacctgtcgaactgncccaattcgatagggtaccgttcgacaggtaataaaataacataaaaaaagggaaaacactggagcgacactggagcgacccttgctatcgaactcccgctgttagaaacgtccatcccacgccccctatggaactccccctgttaatacgtccctatcgggtactgttcaagaacttttttattttttttcttggacaactagcctgtcgaactagggcctgtcgaactgccccagttcgacaggggtacctatcgaactgccccagttcgacagggcgctaaaattgcgatttcgtctagccgacctataattttgcgattttccattaaaataatattatttttaaaaaaaattcacgaatctggtgcactcatgcacacacacaatcaggcccctccaatctagatccaaaggctagtgttcaggtgaggtaattttgcaaaaaaagcgcccgcctcttgccctggcattttgcaaaaacccccctcacgattggttttcctatcccctcatctatcagatcgtgtgtcctccgagcgcactaatccatgactcttgcgattctctttgttgaacttgttcgttctcctgcatttcctcttgccataggtgaaaacggtgattgggaaggagcttcatgtccttcctatgaggtaatccttgaacaagaccttatgtcttctcctatatgatattttttcttacaagcatacacatgtactggatactggatattgttatattcttttttttcaagggaatggtataggagctatgcaatgttcttggcttccatggtctaacttgatttactatttctagagatactacttggtcaggtgctgaagaatagttgaatgaagatggtagcaagagaatatgggaggcatctgcagtagcaggaaaactattagttgatcaggacagcttgcttgattttaatgtatctccttatatatgtacaagtgcatttctcattattgatatgcttcagcaagcactgaaaattttcactatgcatgttcacataattaaacctggtattgataattttcacacagagacttcgatggaaaaaccagcaaatttttttacattcatatcagcaagccatcataaccttttgcattcagatttcaagaatttgagagatattacattcaattcaatctgggtgaacatttttaccatgtaagaagaaagaaaaatgtgcagtccgctcaaaattcagaatggcaaacattctgaatatttctgaaaatatgtgcaaatcaaatgtgcgtcagatttgttgttattgcttggtagttggtactgccaattgttgctttgtaacaccactaagcagtagcaatgattcttatcaaaattattcttcttgcttcctcacaccacctaacagtagcaatgcttcctcagagcgatagctttcagaatggtcaggaacaggggcatcgccacatactacatctacaatcactcaacgccggagagaaagctagtgcgcgtgtgtgcaccaggatgggtactgtaaccaagagcaagtacggagttgcctccatatccactgttgatgccacctgcagtaccggtgagagagagagaggggattaaatattagggtttgcagagaacttgaaaaagagaaaaatggaatttgggaatgtgagagagcaaacctgcagcttgggttcctcaataatgtatcccagatgatcgttttgaatcagtcttgaagctttgcttagccaccaccatcgccgaggagcttcgcgtcgtcgccgccgccatcatctccgttttaactttatttaaattagactacttcaagattaactatgtttagtaatatctacaaaatcaaattagttttattatatctataattaaatatatttatcttgggataaaaatgtaactaattttttcctaaaaatttggttaaaacttagagcatattcaatatatctgtaagtaaggtccatatctagaaagtcttctccaccagcccagtagtgtgcatagatcttaatgcagaatcaacgactaggggattaactgatgaattacaaatttgcaggcgactgcacagtagcaaaagcgcaaaaaattaaactaaaaaccagaatctagattccttttagctactccctccgtcaaaaaaaaaaacctagatggggatgcccggattcgtagttttaggtgaagtcacatcctcatctaggttgattttttttagggcgggagagtatttctcgtaatctctcagacagaacctacgtattgctcgaaaagctagctagccaggatagccaggataacatagcatgtcgaacagcaatcgatcgtcgatcgatcaatgtgagcagcaccaacgcaaacacttcaactaggtggcacgattaacgtaagttcctacgaccaagcaacaagttaacaacaaagcagcgcaagacgtacgtactccatccgttttatattgtaaaacattatagcattacccacatttatatgaatgttagtgaatctagacataatatattcatagcaattctaaaaattcttataatataaaacagtggaagtaataattaaggtcgtcgattcgtcacgtcacacggcgaaggcggcggcggcggcgacgcggccggcggtgtggaggaggtggtagtagagctgcgggttggcctcgaaggccatgcgggagatgaggaggccggcgccgcccggcgccttcatcatcaccacgggcgccaccgccggccaaagcaggctcaccgccgcgccgacggccacggaggcgatggctcccacgatgtatcccacggcaaccatggcgatccccgatccctctgcactggctcggcctcggcttctgttgcttaccacttggaagttggaagagatgaggcgcgcgcgatatcggcgaccaagatggatacgtatgtactccatatataatccctccgtcctttaaaataaaccaacatgtaacctctcatatagaataataaatttggaattctggacagttctttatccaaatttgttgtattaaaatagatacaataacaaactataagccaactctaaacacatatatagataaaaagaagaaagtgaagagcagtaggctataatttatagcccgctgcagcatagaatggacgcaatatatgtattacaggtgggatcatgtatcaatagtatagtatatgtttataggtaactattatatatattggctataaaattgattatagattatttggaactattagttggctatactattaaacttgctcttaggaggggatgtatctccttctagattgggtttttttttatagagggagtagcgcacaagctgctttaccttgggaagctaagtaaggccttgtttagttccccttttttttcaaaaaatatcacattgaatctttggacacatacatgtagcattaactatagataaaacgaaaactaattgcacagtttgcatggaaatcacgagacgaatcttttaaacctaattagtcatgattagccataagtgttacagtaactcacgtgtgctactggtggattaattaggcttaataaatttgtctcgcggtttctagacaagttatgaaattagttttttcattcgtgtctgaaaacattttccgacatccgatcaaacgtccaatgaggcatctaaaaattttcttttcaccaaccaaacgcaccctaaatgacatgtgggcccggatgaattcgaatggacgtggcttgcatgccaatactcgtcaaaagcttttgacacgcggattgttctgcctaattaagggatccgatcctcatcaattggaaaagaagaaaaattctatgcacacaaccacgacatccgattctcctacgaccacggtttatgtgatgcctgtgacatatactccctccatttgatattaattgtcatataattattgaatatataagcatatattaatttaatttattccataaataaatcataacattgcagatgtaaactagcataatcgcattatacgatctacacatataaattggacagtaaaccttgaacagatcgaatatgcgaaacataacgaatacgtattgagggttttcgaagctcagctgcacagcgggaaggactcgcggtaccgggcgttgacaacagcgtgcagcacccgagcgaagagaaagacgagctattgtggatgaacagcaagcagtcgcgcaaagcgcttcccaaaaaccttattgtcaccttctcccgatgcagtacgtcgaaggcgagggttccggagacctgctctcccaatcactggtgcacgctggcgagcaggatggaataaactatgtgcgacaacactgtatagaggaggaggcaaaccctaaattgatttcgcgtgtgtgttgactgaaaacacggcggcttaggagatttgcttcactccagtgcaggtccaaggcttgtctcaagtgtcaagagcatgtaggctgattttatcctgcaaccagcaagaaagacaaaaacgtaattagatgaacgatagccaatcggccgatagggccgatgacttattgtcaggacccaaccgatacgggtaaacctaattggctgtggctttatgatagtcaattagagccaaaaccctaaatatgccctattggttgtaggactgtttcttttagtttttatcaatcgttttaagacaatattatggaaatagccgatagatcaatacttagagcgaagaaagataatgtactggctaatactccaatacagacttatataaacagattaatctataaaaatataccaaataacaattgatcaccagatatgaagtttaagcggtcaatctaactcgatgtatttatataaagcaatctatctatataagaggcaattataaataaacagatcatgaaactcgcgctatcatatataccaggtaagatggactgaaaccccaatactatccttagttatgattagttccatgttagtttcaattatatgattctaagcacggctagggatgatgcatcacaaagtatgcaaagaacataaagtctagacaaaattgctacaggatatcgtgactaggcaaaatttgctataggacatcgtgacttcacggttttagctgtagtacaccgcacgaagtgacttttgggggaaaacactcccaaaagttggatatttgctagtgaacaccgcaagcattaaagtaataatttacggttagagaggagagagaaatcgtgtgaaatgtcaaaaatgcccttgggcccacatgtcaactctcctatctctcttctctctctatccctccttctcttctctctttatcccaaatgtcgtggcgacggcaggagggcgagggcggagcggccgcaacaacgggacggcaatggctccggccagcggcgcctgccgccgacggcgcccctccttcctcactccgacggcacctcctcactccagttgaagaggagagagaaatcatgtgaaatatcaaaaatgcccttgggccacacgtcagctctcctatccctctgctctctatcacctctttcacttctctcactaatctcttctctctctatcccacatgttactgacgatggtgggtaggcgaggtttggccggggcggcgggaggacaagggcgaaagcagaaccgacgcgaccaacggcacgcggaggagcggcagcgcggctggacgacgacggctgcagcacgcggagtgaggaggaaggggcgccgcttgccggagccgtcgcccgcgcgaagtgaggagagaggggcgccgtcgcccgcgcgaagtgagaagcaatttgattttgatcaaaatcaaaacgacttataatttcaaatggagtgagtacttatcggacttcgctaatatttttttttaaagtattttagttaatcagtaataaaacatactagcagtgaagcccacacaaccacccaaccagcctgagagcgtacccgtacataccaccgctcatgcatttggtacaatcttataagaatttgaagcttaatgttagtacggatggtgaaaattctataaaaatatacatgtttcaaataagaaacccttaggacttctttggatggtagaatttttcgttttttttgtatgaatcaatttaattcccatgaaattcattaaaaaaattctcaattccaacggaggctttaattcacatttcagtaatacatagagttcgactgttcgagtgatcagtagagcagcgaggtgtgtggtacaacgaggcaatggggggaaataaaattaagactccatacagcttgtaaaattaagaattattgaaaagtttggatggattttagatgagaattcgtaactattaatatcaaattttatcgctattaataaaaataaagtttgcatattgtttttatagaatttagtcacatatcggtatatgatataagtagtaccgtatatatggagggattatcaactaataccccattgttatccacaaattcaatgtgtaatcttaccgatgatctcggccttcacctaagaaaaacctcacatcaaccaatgataatcttattatttgcaattagctagaacagtaacactaacgatgaccttgacagttactatcatgaggaagtttctatcccatttctcatgcctcgtcttgttgtttcgatcgttatgtacagcaaaggaaaggaaaagggaagattaggaagattcgttttaacgagataagtcattaccgtatgattaattgggtattaactattttaaattttaaaaattaatcatttgattttttaaaacaacttttcatgaatttttttttaaaaaaatatattattaccagttcggaaatcatctgccgaacacagcctagacgacatcgataccttttcctggtggcaagcaaagtggctagcttaatttcaacatgcaagtagctgcagccaaacagcatataattttggaatattgtaatagaagaatatattgtaccccgtccgttcaaaatatatatatgacgtattttaattaaccgttaaataagcaagtttgactatagtcttgcactattttgcttacggttggaaaatcgtatagtcattagaaagcacttttgaacatgaatccaacaatatcattatttatggcaaaaagaaacctaaacattatttgagatagtcagttataaggttcaaaattagacagtcaaaattcacattacatttccgagcgtacggacggaagtaaatatgcgtacacgttcggcaaatatcatccatgggccatggcgtacgtatatgctagtaagtagtactaggaaaacatttgtatatactcccttatttatatactcgtaaagaaacgtaaagaaagttgtttagtataatgtttaaatcaaacattgggaatataaatcatgaataactctaaagttgttgagtttgaaaatgtaaaaattatatgaatagatttgtcttaaaaaataattttataaaagtatacatatatcacttttaaataaatatttttatagaaacaagaagttaaagttatattttggagaccgtgtcactgtcaaaaacttcctttacgactacggagggagtatatactaccgttaccgtatggcgtacaggagtatccgagtacgtatatacggggtgtacacgtacaccgtacacgtacgtaggtccattttacacttctcgccggcggcggcgccgccgcagcagcagcagcaggcgaggcggaggcagtggagcgcgagggcgccgagcacggcggggggcacacgaccactgcggcgacgcggagccaccgccggtgtgtccgtacgtcgtctccggcggcgggtgtaagagcgtacgtctcggcttcctcggcggccgcggagaggagcaggccggccaggaagacgacgagctccgtggtcctcgccatgacgagctcccacaggcggccgaagctgtggtcggcgccggcgccggcggccacggctgcagcgccgcctggtaggagcctctcctcgccgcggtctccgggaacgccattgctgatctctcgatctcagtagtgtgaggagtgagtgtgtgagtgagtgagactgatgagacaggaaaaatatgttgggctgtaaatatagaagtatgtttatctaggcccaagaggcccatatttccatatgtacatgtatatgttcagttgatagagtaatgaaaaagaagtgaagcttccagagaaaacaaacacaaaaaacttcatggtatcagagcaggtcgccggtgacctcgccgacgctgaacccaagctggcggcggcgcggaccagcgtggcacggcgaggcggcacggatcggctgccgccgaggagccaggtggtgcaagggagctgagctgggcgtggatcgtcggcgtaggatccggctgcggcgctgtgaccggaggagcggcggcggcggcgtctacgacaggggtcgccagagctcgaagggaggaaggagacggctgctgcagctcagcagaggcagcgacggcagaggaagcccacgtggtggaagtgctgagggcaccgggcgtgcacttgctggctgagttgagacaggaggcccgtgcggtaggaaggagagagaaaaggagaagtaggagaagcagaggaaatctgcagctgagatttggtgctgttgctgcgctgagaagaaaaggagaagcttgtgctgtagcggttgcaaggaaaaagagaggaaagctgaggatttggtgctagtggtgctgcagttctggtttgctgctgctgttgttctgctgaagtagtgttgctgctactctgacctgagagaaactgggaagtggtgctattgctgtgttttcttcttcaaattgaggtaatcagtgttgttcttgttgctgctacttgattaaaatggggaaaaatcagggacttgaacaagtgatgggtaaattggtggacatgcttgcaaagaaacttagtgaggccccaactacaagtaatgcagtggttcctcatactgaaacaatgcaaaaaattgagttgatgcaaaatgacattaagttggagggtgttaaaaattatttgagttggtcaaaaagagctttattgatcttgaaaacaaagggattagaagaatatgttacaagggagataaaggagcctgagagcacttcaaatgttgagtggaagacttggagtactaccaactcttcagtagtagcgtggttgttgacttcacttattcctgctattgctacaactgttgagaccatatctagtgcaagtgagatgtggaaaactctcaccaatctctactcaggagaaggaaatgtaatgctaatggtggaggcacaagagaagataagtgctatgagacagggggagcgttctgttgcagaatatgttgcagaactgaagcatctatggtctgatttggatcattatgatcctcttgggttagagcaccccgattgtatagcaaaaaatgaggaaatggattgagcgcagaagggtcattgagttcttgaagggcctaaattcagagtttgaagggagaagggatgcaatgtttccaaattttcccaaaaaaaccacttctttcctaccttggatgaggctattgcagctatggcacaggaggagcttaagaagaaagtattgcctagtgtcacaccatcttcaccaagtgccacatatgtagttgcacaaagtaaagagactagggagtgcttcaattgtggtgaaatggggcaccttatgcgtgattgccgtgctcctcgcaagcctagttatgggagaggaagatttggtgacaggggtggagcaagaggtggaagaggttatgcaggtagaggtaacagaggtaggggttatgagtatagaggtgatcacagagctaatgtggtcactcttgaagagggttcttctggacctacaaatgttgatgttgccaaccttgttcattctacctcaggtaattcaaaccaagcatttatgtctatcaatagctctcattcaaattggatacttgactcgggtgcatctagacatgtcacgggtatgtgtggagaatttgcatcatataaaccatacccatttacacgaaaagaaacaattcaaactgctgatggaacatcatgctcagttaagggagagggtacagtacagtgtactcctttaatcactttatcatcagtgttatatgtcccttcttttccagtgaatttggtttcaataagttctcttgttgatcatatggattgtcagatcttcccttgatcgtgagaattgtttaattcaggagaggcaaatagggaagaaacttgggattggcgtcaggcgtgatggactttggtatttggatcaaaaggagacaagtgaagat

SEQ ID NO: 72385 - DNA, 10817 bp, Oryza sativa
caccgccggcgtcaccacctctgcgccgcttgaccgctcgcgccatccgcctcatctccttgaccgccccaaggtcagttctcccaaaccgacatcgccacctataaaacccacaccccccctcccatacctctcacttcctctcctccatcacaccactgccgcctcgccgttcgtcgtcgttctcgccctcctctgccgttgtgcgtgtcggggagctagcgagcacgaggagtcgacgaggagctccgcgccgcccccatcctcgcgcctctccatctcttcttccccggccgcgccgccccgccgtcgcgtccgcctcgccacgactccatccgcgccgccgacaccgtttctctcgtcggtgagctccccactgaaccccttttcccctgtcgcacgctgcgccgcgcccgccgccattcgtcacatctcgccgcgcgcccttgctctgtcccgggcgtcgctcgccgtcgccggcctctctcggcgtcgcccgtgccctctcgaccgatggaatgagctcgcgacctcgcgtagatgctccagctccaacgaatcgaacccccgttgccctggtgaagttttccccctttgctcgccgccgacgatcgccgtcaaaatccgccgccgtcggctcccctcttgtcaatccctctcgccaccacgctcccggggatccccttgatctcccccttgttgccccatggccgccggcctcccctctcgctctcgcgccgtgccgccccttccgccaccgcttagcgccgccgcctgtgcgtcgccggtgaccttcgggtcccgcgtcaccgtgtgcgcgtcgcaaccccctttccgcgacagctgagcccgagaccgcgcgcccttcgctctttccacgcgcggccacatcagcgtgtcggcgagattggccaccgccgtcggccgccgtcgttcttcccccggctaatccgctccgttgaatcgattccccttggcctcctctctcttccggtgctaaccccccaatccacctcgccgccgttcgccggtttgcgtcgctcgtcgccggccatcggatcagcctgcccggcctcctctacctccccatccgacgtggcttccacgtggacgccacctcagccctgggcccgcttgaccgagtcaagccggcgcccagtcagcccccctcctccctctccccgctcgtgggcttggcccatcaaccatccccccttctcggcctaggggaaaatgaaaagtctacttttactccctctgtccaagcccagtgcccacacacatgaacaaaagtccacttaatcccccccatgtacagtacacccttggccccgcacgtcagtgactgtcaataatattcttgagaatattatttctataaattccataaaccatttctcgtcttccagaaattctaattgaacttccaaaattcatatcttcccaaccgctcttctgattgactccgttcaacttccagtaattccgtaaaattgagatctatttaatggcactattatttagtctaaatagggtttttttcttggtcttttgtttaggtttttgtttgtttgcgtatagttgtggttaccggattttcgccgatcgcgggttttctcgaagattcgtgaagctccgtgaagaccttgagcaaggcaagtcaccctttgatcaattgcccctataattggaaaatcattattattttgtttgcaacttgcattattagaatcacacataacttgcttggcctcgatttgcgtgccaaaccgacggacctacccagtagtcgcactaattcctgtaggctgtactatcatgattccttgtcgctccacccttgtggtacttcggtattcgtgctctctgagcgcgtataccaaatatctcacatacatcgttgattgtcgaaaacttgggaaatgggtttgagaagccttgaaaacccgacatgtggtgtcggtgtgtttaaaaataaaatgaattgtgaaaactcgcgatgcgggggttgtgcctgcgtggcactgtcccgtgttcgcatataaggaccgattcctgtgggaaactcatcgagcataatcaaagtgcaaccacaaggtggaatgggacaccctggctaagtaattagtcggttcagggaaacctcgcatgccaatagttggggaacgctggggcggggtcggttggagccaaaccgggttcctggtaagcaaggaataggagcttgctgaattaccgatcgaggtggttggagtttgatttgtgaaaactaaaatggcatatatttatgtgaggatttgatccttctatgtggcatgaggtaaccctgggccggcttaggaaaggccttgttgcgaacctccgacaccgacgggtgttcggaataagttcgtatcttgtgggtaaagtgtacccctctgcagaggttaactaactgtttgaacagccgtgcccacggtcatgggcggatgtgaggtggttcccgttgcgtagatttgtttgcctgtgctttgtgaaaagttgttgtgggatgggaatcgtaaccagaatcagcctatgtggcagatggatgacctgagtggtcagaaacgaatctgtgtgattcgggatgtctacgggcatcatagactaggcttcccgagtggaagcggaatgttgtgctgctgggcagctggactctgggagtccgagaaaatgagaaaggctctgggagccgattaatcaagtgaaatagctctgggagccgagaggtaatgatctgacccgggaggtcgatacattaccaattgagttgttgaaaaatatctcttaagtcgatttgagacgcaagtctcttttcggcccaaacttaacaagaagtaaatcacttagtgatttcaaacaaaggatttgcaaaacaaccttgcccctcttccaagcttgcattaaacacctaaattccagtgacttgctgagtacgaaagtactcacccttgctctatataaatatatatagttcctccgtcctgaagttgaagatgaagtaaagtgaagattaagggttttgtcctggttcccagccgtcgcctgtggtattgggtgttagaccgttggttccgctgctgctgctgttgttggtgtttgcctcgtccgtgtcgtcggttgcattcttaggctgtctgagctgcaacctaagttaaggtaaataagtcctctatttattttaaggattgcaatgattcatatttgtcaccgtgggtaccagcgctatgtcctgggactggtactgagatcgcggtttcgtagggagcggtttgcaccgtttttcctacgacacgctcctatcaggtgccgttgtacgacggtgccagattggggtgtgacacctcgggcttgactcccctcgggggaggaccacgtggcatcggggggcagcctcctccgactagtctttgggaaggagtggccgccgccctacctcgggcccgacccccctcaggggagggccacgtggcatcggggggcagcctcctccatccagtctctgggaaggagtggccgccgtcccacctcgagcctgactcccctcgggggaggggcacgtggcatcggggggtagcctcctctgactagtctttggggaaagagtggccgccaccccacctcgggcctgactccccttgggggagggccacgcggcatcggggggcagcctcctccctctaaacctgatacatacccccgggcctatatcaccgacataactctaaaacttcttatattatgggatagaaggaatagaaaggagagcagtgccaatgtcgcacactttatgccgtcagtactcctttcaaacgcatgaattttattggattttaatacgaagaaagcatagaaaggagcttaggacaggttaatttttttttaccaaagttactggcctggtgactaactggacccacctagcggctcaaattttaaccccggccctgatcataagatgtaactaacgaatttctcaactatgtattgctcgccgcttttttgaaatttgtatgcaaaataattgcgtagttcaaccacaggacagtactcctattattttcagctggagtgtcaatatgacaacatcaatatggaatacactgtaaattcaaaaaagtgtaacatgtacataggtataaatgcctctcccttattatacctccgtttgtatcggagaaattccaaaggaattaatttcaaaggattcaattcctaaggaaatatttcactcttaatttcatcaccgtttgcaacaaggacgtgctccggcgtgttatcatcgagtcgaactccagcgtattgctggtctcggtcgcagaattgtttacgccttaggcgtgctccggcgagttgttgggcggcgtggcggcggcggcggcggcgttgatgacgttgcggcggccacgctcggagcgggagttctcggcgaacttgagacttgcaccgtggaggcccttgctcttctcctgttcgctccactcggagccgtagtagtgctcctcctcggcgccggcgttgggcgggaggaacatggagccccactgcgggaaatggacgagcaccaccggcagcgtgcacgccatgatcatgatgcccatgtactccagccccgtgcccgtggagtacctcgacgacgtgaagaagagcagctgcgtgagcccggcgccgaagttgccgccggcgccggtcatgccggagatgatgccgagcgagcggcgggagacgaaggggatgacgccgaagatggcgccgcaggcggcctgcgcgcagaaggagaagaggaccatgcagacgacggaggtggggagggtggatgcgcggccgagcaggaggcagaacgcgccgccggcggtctggaggatccaaatgttccagaggcgggcgcgcatgccgaagtagcgcgcgccgaggtccgagaggaggccgccggtggggcgcgcgacgatgttggccatgccgaaggatgcggcgatgatgccggcgacgcggaggtcgaggtcgaagcgatcgtagaagtactcggcgatgacgttgtcggtggtgagctcgacgcccatggagtagccgtagaggaggacgaagatccaggtgcggtagttggtgacggcgtaccagagcaccctggagaagctgtccctgttgacgtcacccttcttctgcaggctgcgcaggttgccgtcggggaggtcctgccccagcgtcagcaccagcacgcccatcaccacgtgcagcgtccccggcacgaagtaggccagcctccacgccgtgaacggcgtcgcgccgcacttgcggatcacgtcgtagacgagcggcatgatgagctgcgtcgcgccgccgcccatgtttccccacccggcggcgaggccgttgacgaggccgatgatcttgctgttgaacatggtgctcatccagtactggcatgacacgaaggtggcgagggagaagccgatgaggaagcgcacggcgatgtaccccgcggcggagtcgatgagcgacatgcagaagacggtgggcgcggcgagcatgatgaggaaggcgcagccgtagcgcgggccgagcatgtcgcagatggcgcccatggcgagcctggagaagatggagccggagacggaggcgacgccggcgttgccgatgtcggccttggtgaggttgaggttgtcgcggatgatggggacgagaggggcggcggcgaaggtggagacgaagcaggagaagaaggagatccatgataggtggaacgtcctcatatgcgggttcgcgaacgacagcaacctgatcgtcttcgccttgtgctccgagtccaccggcaagtcgaacttgctcgccgccgccgcgtcctcgccgcccacctccgtcgagaacgcgaacgccggctcgcgccccgtcacgccgtgcagcgagctccccggagcgcccaccgtcgacgagtccatggcaactactagctgctgctagccgctgcttcttggagatggaatcgatcgaatcgctggttgcaagagagaagctaggtgagctcggatgcaattgctggctttgctggtggcttgggagttgggatcacgcatcgcccagctatttatagagcttcaggtgcgcgggaattggcacgctctcgttggcgccatccttatggcatttgccttaagattcgtgctggtgcaaaatggcctcatcgtctccgttctctcacctgataatatcgacagacctggacacgttctctgaactctgaagtttattgctgaattaacaagagtggatttttaattatgtgattatacgattattacgttacgagcgataagggggcagcaagcgttgacaatatcagctgtgaactctgaaaatatagtactactagtagcatgatataagaggaagtcatgtgagattaattaaggagataacctcggcgccgcatctccggagcagagtggcctttatcccatggaatcctccaaggatcagaatatgcaacgccaatatgggacccacctgatgcatgcgcagaatcgatctgttcatctgttgttcctcagctggttgccacttcacaatttcacacagaaaaaaataacagatatagctgtaaatgcaagtatgcatagacgtagccagaggtgagtaaaaaaaaaattttgaacgaatcggtaagctgccaatttcattgaatagagaaagagtaaactttacaagtaagaaaaaccaggcccaggaccttcggtcctactgagctaaaaataagaagcaagccagctaccaagatgcctcgcccccgcccgagaccatgttttggcctcctttttaattttggccaacagacttccggtagataactctttgtgctgaaaaattctacgatttctctcattccagatttcccagttgaccagaagtgttaacgtgtgaagtgctttctttggggcttccttcaagttggcggtggcctcccaccactctaacaccgattgagctagttgccattgaccgggatttagttgaccacacccagtccaatcagataacgccgcccagattttcttggtgtatctgcattctgcaagaaggtggagagcagtttcttgggtgtgtctacataaggggcagaaataatcgttctgccaacctctggttgccagtctgtcggaggtccaaactctattttggataatcaactaggcaaaggtcttgcacttgcgtggtgcccacggcttccatattatgatgttgaagttggtggctgtagtacctaagagctgcgctttgtaggccgacgtcaccgtatattcaccatggccagtgagcttccacactatcttgtcctcctcattttctgtgaaatgtacgttgtgtaccgcactccagacattgattagctggctgaccagctccgttgtccagcctaaggctggaggaaggtccagatcgagcagccactggtctatagttgaggcctattgtagttctttttcttggagggaggtgagtaaaattattttgtgttaatgtgcactttgcagttctttttcatatgattcgaaagaaataaaaattagcctttggattcggtttaggcgcccagctagtagcattttcaacttcagctaatttttctacctgaaattttgatatctttgtgaatatatgcttttcctagaaatgccaatagaaaatcatttacagcatatctgttacatgcaccaatttgactttcaaatcatttcctgatcgatacaaatttcgatgccgactttaatttcaaatcatcaaaaccccgagtcggccagctgaagtagatcgagcagtaaacatcagtagtgacagacaacagcgacgtcgagtagtaaccatgaacacggcttcgtcctagtagtaaatcgcatcttttgcagcaatcgaacggccatcgcattgcatcatttgctctgactatgcaaatcatgtaattttgtcaaccgctgacactgacagcaagggacaaatgacctctagtgttcttccttcaggtctttgctgccttttacacttgtaccaaaggcatattttttttccaccaaatttaattctgcaaatacgactttggacttggatattattgctgcgactctgcaaatcggttgttacaacttacaattaacacttgcctaactaattcgatatttcgattgctgaattcttgcttgctccaacactgtgacgacaggggacagaaaggcagtctagaatcaatgctacaactgatcgaaggggacaagtgaaatgagctattgacgtctcggcgggacaaatagcatccagttcattgttctacaccgtcatccatatattctcatttctcaatttagggcaatttctcggttacggtgacatggtctcctgccttgtagaatctaactattgggaaatcaatcatgaaagctgccatgtggccggttctagtacaaataatgtgtacctgtgtactccacttacacttgcgtcctactacgttgtatgttacttgagatcgaccgctcgatatttttcatccataaatatgtgcatttaatgtaatgaagaagaatacatttaatgtgtaaaattagggaatctccacccgtttctgtaaggctttcttttccttttcaatgtgttgtttgattaccttcatcagtttttctcaattgaaaaaagctcaaagagacgtgcacatgaaatctggccttttggacttatcagggctgcgcgccgtgctatatgcatgataagttatgatcaagccagttaagtgacatcaagtgatgcatcattgagtcttgagggaaaaaaaaagaattgcttgtaaatttcagaggcatttgactttgtaggagctggtacagcagccgtacaagggcccacgatctatacagactcttcttaattaaccccccccccaaaaggttatcttttataatcatgctgaattgatctattttcctcgtaatctttaatcatcagatcaatcaataccgattgttcatcatgccatgaatctccaaacgcttcattttttgttgggccgaaagctttcgacctggctgacacgtgctgaactctatcatgggcctggagacatacggcccacgcattcaatcctctctcctgggccttggcccactaggcagtcctgaactgaactctgatgatatcttgttcttatctgaaaagatcgccacatcgatcacatggccaactcatcgagcggcgcgatgctaatcaatctaatactgatacactacactaatcatgtgttgcattggcgtttgttaatcaccatcttggtcgtcgtcgtcgtcaatcgtcatcgctgagcatctttgtattgtacattactaatacgagcagcgatcgtgatcagtaaaaacaacaacgtggtcagtccagcccccttggattagttacactaattaattaattaattaattaattaattaatactcctctcttccaggtgtatacccagtaaacgacacaagctgcaattagccgaaatcctccgtatatttcaccaagccctaacacggacaaaaccatccagatgtgcctgcaattttctttcttaactgcgtgacgtgttcgattcctcgccctcgaatggacactgccacgtaccaaacttaagattcatctgagcttgcagatcgaacatggtcgatctgtgaatctataattattcctcctcctccttcacatgcgtatgtatgtataccagtatgtggatcaactggcgtaattaaaatgagtaaattaacaacaattagtatgcagctgatggattccatcttagctagctagattctccgatccctgaaacaaatcggcagcactggacagatcatgcattgcatgtatatatatgaccaaccatttcagctaacgagtagctatccagcatatgtttgctagtttcagttcagtgatcgagtgagcgagctatagtaattaaggccttaagtgaggagtgattaattgcagttgatatggggcacagtggtggcgttgaggctgcgtgcagagtgctacccatcatcgacgaggagtcggagtcggaaatggacgaggggtcgccggagaggaaggtcgtcgacgaccgccggaaggccatcgtgtccaggatgagggagctgctccggcgagcggccgctcagtcgtcggcgcagtccaagctccggtccaccgtgcttgtcagtgccaagaaatggaaggtaagccaaaatccattcgatctctgactaatttatgcatatgaattcagttgcatttctgtgttgaacctctgaaatttaacttgtttttgtgctaattgatgttgtcagagggtggtggtgagcctgcagaacagcaggaggaagcaggagcagcagcagcagcaactgacgacgacgagccggcagagcgacggcggcatgagctcgtcgccggtctccagcaagagcgacagcttcagctgggacatcgccacagcagagagctgctcgtcctcgccagcgcagtcgccgctgtggccggcggcgctgcgtcagttctcaccgtcgccggcgacgaagcacggcatgaggctccggcgagacagctcggggtcagcagctgacgatgacaggatgagcagcatgtcgtgcagtggcagcccggatgacgacgactatggcggcagcagcaggctgtgtcagtggatcaccacggattctgactgtaagtgattgctcatcatctcgatctcgcgttcacgcataagacaattaattcaggttgctgatgaacggatcatt

SEQ ID NO: 72386 - DNA, 1145 bp, Oryza sativa
gggggctggtggtgttggtgcgtgtacgattgctattatttcgtgctgattgatttctctcatgtgctctctgattgcacatacggttcatggctttgtacgtgttcgttcgtgcgattgctgcttagctcgggatggagttgctcgcgaagtctagctagttgtaggttgcttgtgtcccctggattacagctctctatgtgatgctggcatgctgctgctgctgctgccatgcatatcagaagctagtaatatacagtggtggtacatgcactgttgctgatttagctttatatgctgctcagttttgttcttggggactcatcaatcatcgtagcattggtgaacacgttcacttccatttttttttgtataaaaaggaatggaataataggtgaaaaaaaattcatgtgcttcatcagtacgggcggaaagaaagatatgtttaaattttaattagtgtgcttatctaggtttatcatatgcttatactcttgtgtactgtagcatatacaagtgatgcttattaccaaagcctagctaggccggtaaacttgtattatttgtctcgttatttctggaaatcattagagcagcacttcagttgaaatatgcacggacgccttgctaattaagcggctcctctaaccaggccagtaaggtcttaagttactgacaactcctggactggtataaatggcgcggccagctttacatgacatatggtttgatacttttgtttagttaatttcgaggtggaatataaggtgaccagcttacttaacttgttcatttgatgcattcggtttcatttccctttttttttttaagataatgggaagtaaattaatacccggccttgctttaactgaaactacaactttcttttgtccctttagtgtgtactgtcaccaagttagctatacatggtgcaagttgccattgcccattgctattaacttgctctcacaaattggggtgtttatttcttgaaatggattttttaggacaacaataaactgattgacatagctatactgttcaagtataaccatgtttatggttttcaattaagcaaactgcttatgtttatgctaatatcttttgtttaatgggaggaatttaaatatttcattattggtatt

SEQ ID NO: 72387 - DNA, 621 bp, Oryza sativa
tcacctcctcctcgccaccgcacgctgtcgagccgtcctcaccgctgcgtcaagccgccgcaccgccgcgcgccgtcgagccctcctcgccgctcgcctcctcctcgccaccgcaccgcagccgacgacgacctggagggcgccgcgccgagagaagggataagggagaagggatgagagagagagtgagggatatttaagtaaaggagatggtaccggttctaacacaaataggtgccggttctatcattaaattcggcacatttgactattggaacaattttttttcttaaaaaaattacgggcaaaaacatcattcaattttttttataataagtagagataagcgtgttatataaatgtaactttatacagtattaattataaattacaatttctttcttaaatttaagtttcactataaaataggcctattacttaatatgttcaaaaaagagtataaagggcaaaaaaaaagaaattaaatattagaccgcacaaaatatgttccaagtttttgctgatttaaatcaaatggttgccatacaaatccgtagaatgaagttagaaattaattcaaaccctaactactatcccttccgcatgatcggaccgtacata

SEQ ID NO: 72388 - DNA, 941 bp, Oryza sativa
cgaattcgagctcggtacccattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggtgaaatcgtgacaagaccctccacataaccctcccctaaccatccacaccacgctaaggtttcacccccacccctcaaaaggcagtgggcggtcccctcttgcgccgcagtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccatgaaccggtccttaactgccatgggtgcgaccagcaaaaccatgcactcacagcccgccattcagaatattttaattaactgacacccttgcggtggcaccaatctaaagctatgccaatagacaaagtctatgtaataatgtgatccctttttgtgtactagttgagctaagcatggctaagcatttcctaaaccaacatctaatcattttgatacccaggttatcaatggcatatggtaaacaataaatggctgagtaataggacccatcccacatgacattgtaaaagaatgcaacatttaatagaaatgcagggtgtttgtaaattgggtacaatatgatcaaatgtaaagcatgacttgccttgctctcgaactgatgagacctcagcaacg

SEQ ID NO: 72389 - DNA, 1170 bp, Oryza sativa
ccacatgacattgtgaaagaatgcaacatttaatagaaatgcagggtgtttgttaattgggtacaatatgatcaaatgtaaagcatgacttgccttgctctcgaactgatgagacctcagcaacgtcttcgagaaaccgcggatcgacgaaacggccgaaacccacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccaaggggggcgccgacaggtggggcccatgggtcagcggctcaaaggggagaggaagggggcgccggcatgtgggccccacgggcagtggctcaaggtggccggtctaccgtagaccgggaccacgcgggtggtccaccgccggtccacgggaccgacggtccggatcggccgggaggccgatcggacggcacggcagcggctaggcacggcttcaaaaccgaccggccggccatggcaaccggctgtgacgcgcacggtcgccggcgacggcaatcggcggcgcgggaagcaacggcggacggggtacaggacggcggcgtcgaccgaaggtgacggcgagcgcgtggagagaggcggcgcaaacgagagagaggggaagagggaggaggggaggatcctcaccggcgagtatggcggccggggcggaggatgaaggtggcggcgacgacctggcgatgaggaggggcggacgggtggcggcggcacctacggagggtgttgagaaggattaggagtagagagagtgaccacggcggccaccattgttggccggagacgaaggagaatggatagctcaccggcgtgcgaggagaaccgggctccggtggggtttagcggaaatcgagcggcggccgaggtggctcacgcggcggcaatgctaatggcggcggcggcttggcgcggcggcggctctagcggctgcggcgcgcgaccggaggtggcggcaagcggcggcgctagtggcgaacggcgcgcgaccggtaggaggcacg

SEQ ID NO: 72390 - DNA, 7938 bp, Oryza sativa
cgggaaaccctggaagaattcctcgtacttatcacaagccagcgtgggcaacggctgggcttgtagtgtagctttcctctaactgatgcatccaggcaagggtgggcgtgatggagattggatgggccctgcgacggcctatgcggcttccggattcatctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtccagttgtacacctctgatcagagtaaaactattcgaatagccatgcccgcggttatgggcggtcaaccagattcgctgtgattagtttcaccctagtctagtctaatggaattgaatagtataggtggatggttgggcctgttgcaatgtggtgtagcgttggacagtggatgtttaatattgattaattattacaaatgttttactgtttccaactactgtttataaatgctcgctttatgcaaatgaaccactatagctatccctcgatacttccctgcatcatacccctattccggtatgacgtgctgagtacagtgggtagtactcagtcttgctctatttttcccaaaccccagagtttgagtatgcgtcagatggtggcttctccgaggagtaggcttcgtccgtgccgtcgagaatgcctgtggagtggggatcccgctgcggtgcaagtcaaggcttagccccatttatcttttaattttccactgcatttatgtaagacttttataatgtttgtaagacgtggatctgtatgtcaactttgttgtttctgttccccggccggtcctggacgagaattttaatgcacattctgcttggaattctattcgagaatttctgggcgtgacaacaatgctggaggattgtttcaaatattacaagggatgtcaagattgtcaaaaatttggagcgattcaaagggcacaggcatcggctatgaatcctattattaaaccatggccatttagaggttggggaattgatatgatcggtatgattaatccgccatcaagcaaagggcataagtttatattggtggcaaccgattattttaccaagtgggtagaagcgattcctttgaagaaggttgattctggggatgctatacaatttgttcaagagcatataatttatcgatttggtattccccaagccattacaaccgatcaaggttcaatcttcgtgtccgatgagtttgttcagtttgccgaaagcatgagtatcaaattgttgaattcttcaccatattatgcacaagctaatgggcaagccgaggcatctaacaagagtttgatcaaattgattaagagaaagatttttgattatcctcggcagtggcatactcgattggccgaagcgttgtggtcttatcggatggcttgtcgtggattgatccaagtccctccttataagcttgtttatggacatgaggctgttttaccatgggaagttagaatcggctcaagaagaacggagttgcaaaatgatttgacagccgatgaatattataatctcatagccgatgaaagggaagacttggttcaatctagattgcgagcccttgcaaaggttaccaaggataaggaacgagttgctcaacattacaacaagaagggggtgcccaagactttttcggatggtgaacttgtatagaagttgattttgccgattgggactcaggatagtaaatttggcaagtggtcaccgaattgggaaggaccgttccaaatctataaggttgtatctaggggatcttacatgttgcaaggactcgatggagaagtttatggacgagcgctaaatgtaaaatatttgaagaaatattactcaagtgtttgggttaatgcatgatcggctggtgttgccgatacattatagccgatgtattcacatcgccttgagatggccgatgttatatcgcccttagttggtttcatattgtaatcggatatggtttgccgatgtacaatggctgatattgctatatcgcccttagtacaaattataattttatcaatgcttttgacattgtaaaattaggggggcacatatatgaaaaattgcaaatttttgagcaaaaaatatggagttatattgaatcggcataaaggttatcaagatgagttagataaagagctagagtttcttagccgattacaaaatttcctaagatctattacacaagatatcactgagacaagtagcgctggatagccgatatagctctttgcctaatttgttctacttcttcaatggcttgggcatcttgagcatcggtttcagagatgaatcttagggacttggtcatatcagcgacattcttgatagccgatttcagccttgccttttgttcttcgacagattgtgggagatcgactagcttcttgtgttccagatccagatcggcattgcattcttggagttgtgccaagagctcaatcttccgagcttcaagccgatcaatattagacctgatcgggccttcagatagttgatcaagtttggacttttcttcatgcacgagttgccgattggcttggatggtagcttcaatctctttgcgttctcggcgttcggctagtttctgcttggctttctccagcttgaattgatgctgttcaagataagtagctggagtaaggacattggctagttcttcaggaattagagcttgaacttcgtgtagccgggtcctaattgatccacagtcgaccaccaagctgcctagagaagatgcctctagccgatgagagatatcttcaagagttttcttcacatcatcggataagggggctaaggctttgcttgtggtatcctcttctgtctcatcaaagtagtccttgatgtcaatagagaatagatcggctaagacccgtaagaacaatttcaagagagttaggagctaaatagacatagccgatctaagttcttgtatcaaagggaaacttactgggatagcaggagcggctggttgttcttcttcctcaacgcggtgactccctatagccgatggagtttggtcactggatgattgctgtacagggggagaaggaggaggaggctaaaaagagacaagtattagataagatcggatgagatcaactgctgaaagaattaagaacatcttattggtggagccggtttgagagttggtgctgccgatttcttcttaacagcaattctctttttctgcaaagacaagattaataagtaatcggctgaagataaaatggttataaaagggaatcagggaatggtacttaccctcgagaaatgagctggggcagaaggagttgaaggggtttgattgggtgaagccgatggtgttttatctgtatcacttacttcggctgcggcttgatcaacatcttctccgatttcctcttcatccaaagcttgttcaatggatggatcaagggcaggcagatcatcggttggcttgggtttctgttttttggccttcttcttgagagccagaaccgatggatcaattgctggcactttggttttccttttcctgcctgcatcggctggttctctcatctgcccttggagcagacttacggtcttaggggcatgatagccgataactggaggggttagtccaccaccattgggcaataagcctggggtatactatatatctctgccactgttgctttggtgtggatgggaagattctgttgtctgtaggataaagggaaaagttggtttaagattcaagttggttaacaagttatgcaaatgaaataagcaaagtaaggatgtacctgagggacaacatcagggaatagatctgtcatatacatagaggccgactgatggaatagatgctgcttccattctccccaccatctatcaaaatttctgctcctgaatcttgctagttctatattctcaatgctgcccaagggaggaccttggatgttgagtagccgatccatcatcagggttgatgaaatttctccgcggcattgaattttgtcagcaaagaacaagccgatggggagttggcaaattccaaattgcctggccgaattctttgggtgatagaattcataggagacttgaatgtttctcccttgatgaataccgacaggaagaatgcatgggctgattgcagctgagaagacttctctagacttttggaatctctcatgattgatgtctttgaatctaaagtccaatgggagatccaaatgcactgagtcttcataaggaaaccaaactcgagcatctttctgaaaaccttcatagaagctgcagaaccaatccttgagcaattcggctcttaattttgctcctgcatcggctggtgtggatgcatattctccatatgacatgcatctgcgatgggtgcggtcttctttatcatcttctacaatcggctccagtcttgggaattcggcttctgtcacaaatggccgattgacgactgtcatgaccatcaggttgagccaagactgtagcagccaccatggtccacctgctccaaccactgagccgacgactatcttggccgatgcattgttcagcatttggtataagtagccgaggaggatcttgcctagaggaaattctctttttgattccagagcctcggctgcaaactggcagttggttgtacgaccacaactagatccacagaaaaggaacttttctagccacatgagcaaaaaggccacatgttctcgaggagtaacagatccttggcccatatatgccgccacataaccagaccaaccacctatgctcttggtcctaaagtcgtattgattattggtgttcagactcatagggttagccgatgaggtcacatctagaccaatgatcatggtgatatcaatcagagttggggtcatcggaccttggttgaacagaaaagcgttgatggtattggaccagaagtacgtggcggcagccattaagggttcatccttagccgaatttgctatggtgagggcgagtgcttggccgattccaatctcgtcctagtgagtttgcttgttagccgatacacgcttgtaccatgtggtccagcttttctcaggggaagttttttctagagatggccaagacttgaaggtgttcttccaatgacctagattagggttggccaatctgaaagggattctattggtttcgccaatgatgaaattagtgggtcgacatcgccgatcggaccaaggaaataatgtctctcgtgcgatagacttgggattgtgaccagattggaaagatgctaataatccaaaagggacagaggagaagaaaacaagatgagatgggcacatacatcagcatattcgactgatggcgcggcagacaggctggcggaggtcgacatcgctgcaggcggaaatttggacggagaagagatcgcctggaaatcgctttgtgcatcgagggggtcgccggagagagagaggacggagtttgcttcggcagtgaaaatggaggaaacggtgtgagatttctcggggacaacggttagtatttaaagcgctgaataacagtcggaaaatggcaagcacgatattctctcggagtcgacgtatgacaaatccgaaacattatccaatattccggacttggggggcatgtgttaacgaccaaatttggtaatccaaggatcggatgtgaaggaggaatcgagacggagttcaagatagagattgtcccagaaacagagtaaggatcggctaaggtccgaatcggctacgaccaagatcggcagagttcgagtcggacgggattagccgattgagccaagtccgacaatatgacacaacacacgttcaatacaatctcggcgcatcaccaccctttttattttcgttttgtttcgacgagttcttgctttcgggttgagctgcaacggttacgatcttcaagaagaggtaaaacttgttatggcggcttgcgttctcgagattagtgcttccatcttcatgacactctaatcttgtttatgtaattcgtcgagttatcatatatcttacataatctctggcaatatcgctatctaacctacaatcggctaacatctgtcagtagaaggcagccgattaggttaaatatcgatattgacttagattatataagatatccatcactctatgacacatccaacggcttgattgtctagatgttgtccttcttttcatacttatagctgcatcagttgagtttgatcttatgagtcgtgattagaatctcaaatctctagcctgtctttggttgccgattagggtagtatcggagtttcagctgatcttacctaacttaactatattcatcttatatgctttactgatatgttaaatctgccctttatgttaagatcttgttgcgttaaaagtatattaggctttctgtttgatatattctacttgcattaatatcttaatatagagtggtatcggagtattagccgatacatgctagatctatctgatcggctatgctatgtacatatatagtctcattattaatatatatttcgatttaagtgatttatactatctcggcatagcgaccgatctatcccaatcacaaggattgcgtattgttaatatctacagccgatcgagtagatttagtatatccgacataaggattgtgtattgttaatatctacagccgatcgagtagatttaattctgtcttacttattaatgactgccgatcgatgcatatatgacatcggctcaaagataaatgatatgtcatcggcatttagccgatcggcgtttatggatttaatcgcggtttctttgtctttgtttcttattgattgcaggatcaaattaattggcacgctcacacacccaaaggcaagttttggacctgcactagagttaagcagatctcccaggcctcgtgtttttacatcaacaaaacccaaattcatccctacagccccacatccatacagcacattcgcattcatatttcacattcacatccacattctacattccacattccacatccacatcacatttcacattcacatttcacaattcacattcacattcacattcacattcatcacaacaaataaaaacctacaagccattcatcacaacatataaaaacctacaagcctaagtcaaaattcgtaaatccaaactcaaaatatatatcctaaacatttgcatataaatcctaaacatttgcatatatatcctaactcaaaatatgcgtagtttaaaattcctaagtcaaaagattgtaagtctaaatttttaggtcgaaaaattcctatgtctagattatgaacattaatatgaaaaattcctaagtctgcaatatttaagaattcataagtgcaaaaatataaatgcgattgtattttacctccaacatggggtgagcctatgattttaagagtttctcatcctcaagtcatcgagcatgtaatagaaaacatagaatagaatccataataatagcaaatattcaaatgcattacacataaagtacacttccatagttcatgcataaacactaattaaatacatttttttcacataaatctagctagtaggtttttttttcctaggagctaatttcttcgcggcttggtgccgagggggaggggcagaagattgcactcgttgtggggccttgttgatgttgtattcgccacgacatgatgacggatgaacccgcaaaactcgtcagtgagagctttgaagacgtgtggtagaatttcacttgtatcgagacccaatttctgcaacgcaaggatggaagcacgtagaaatttacttagtacttaaatagaattgctcaatgttatgacttaggtct

SEQ ID NO: 72391 - DNA, 1599 bp, Oryza sativa
tcaaaagattgtaagtctaaatttttaggtcgaaaaattcctatgtctagattatgaacattaatatgaaaaattcctaagtctgcaatatttaaaaattcataagtgcaaaaatataaatgcgattgtattttacctccaacatggggtgagcctatgattttaagagtttctcatcctcaagtcatcgagcatgtaatagaaaacatagaatagaatccataataatagcaaatattcaaatgcattacacataaagtacacttccatagttcatgcataaacactaattaaatacatttttttcacataaatctagctagtaggtttttttttcctaggagctaatttcttcgcggcttggtgccgagggggaggggcagaagattgcactcgttgtggggccttgttgatgttgtattcgccacgacatgatgacggatgaacccgcaaaactcgtcagtgagagctttgaagacgtgtggtagaatttcacttgtatcgagacccaatttctgcaacgcaaggatggaagcacgtagaaatttacttagtacttaaatagaattgctcaatgttatgacttaggtacctgaagcatgtcatacctcagcattgcggtgattgtatccatcctctacaaaatatagcatgtaccgcatgacgtagaatccacagaggtcgatggcctctggttgacgaaggatatatttatgttcgaagatccgaaattcagttgcatcaatcttgcatctcccatacgatcttccggacctacagtacttcttatatgccctatttagtgcactgaaaatagtttggtacttgtctatccctctcctcaggctatcatatatgcaaattgaactatcgtcgatgttgattacgaggaggatccaatgatggctacacatagtgacaatttatcaataacttgatatgggtcgaggggcaaacataactggaaatcgatgatagtgacttactgagaaaggtaaggaaataaaatgtggtcacatccattaagtttggcgagggcatcaaagagatagcggtcaatttcagcttcggatgtgcattgcttgtcaaagtttacaacggctgggtctagaaaagctatcttatggttcatggatctaacctgataagagcaatgcccgcaaaaggagaacacagttgagaattactgagtacgtagaatgctatggattaagaacgacaagatatcaaaggactcaaaatgaccacaattgcaggaggcagatatcgaattcccttctttggtacaactggaagagttccttaaattctacaaagcatgtattactggggtggtgaaaatccacatcagtgtagtaggcaccgaacatcccgacccccttttttggcctcctccaaataccattcatgcagccaatgcgcttgagttcctaaggattcaatttccgtgtcaagcaccatcggttgaccaagttggaatcgcagtacaatcggggcctcttcaagttcatctagattgtctaggcttttcaaaccagctgacttgcagaaatcaacttccttggacgctttctcttcaaggtacaactccctactgag

SEQ ID NO: 72392 - DNA, 3090 bp, Oryza sativa
accaaaaagtgaagtgatgctggcattgattgtcttcttaggcagcgatgttgttggctttgacactaagtatgaattggaatgtgtgagtcactatttgcttgatggaacagacatctgtgatgcacttggtgttcgggtcttttttctgagtgggggtggacttgtggacttctccggacgatgtggttcattaggtgtgttttcacgaggtggactgaaggtcctctgtcgaggcggagaaggagctagatttgcacctcgtccgtttgaagggctggaagcaccgtcgcctggatcccctgccccatcgttcaacgtgataacgatgtagcgtttgggccatatgatcaggttgtgaagagcagcgcccagagtgtcaaccccttcctccggaggaaactgtagcacataacctctgtattggcttggcacgtcttccacttcaacccttgagtggcctacaggcaatggaacaccatgtattgtttgccctgcacatattggatgtgccacaccgcgtgcaatctcctgagtaatgttgctttgaagagggacatggagcacgcacggcatatgtgttgttatgtcgtccacaacataacgtgatgtgtcctgttctggaggggggttatccgcggacgcgcaagtgctccgtttggcacctgggttaaccacttggtcaccagcttgcccctgttgtcttggtaacccattgggaaacagcactgcaagttgttcctttacctgacgggccacctctaatctcatacgtttggcctcctcttctctcatgggtcttcttggatgggcccgatacatgtgtgcatcatctgggaacccttcctttcatggaacggaaccaacgcctctcgtgcgtccagggtgctctttcatccccagtgccaatgtgaactcatctttttctcttactggcacatatttaccctgtctcgccaaggaaacagcctcggtgatcttttctttcagctcttgctatcgaggtcccagtgcaaccaactcccctgaatccgatagttgagccttcctggcgtacgcgtagtgctttgtccgggtcccccatccatctatctcaacaactatacctgcttggcacagttgttcctccttctcttcccatttggggatattcttagcatatctgctcggcccaagtcggtgaggaagcttgttcaacgcggagttggccttgtttagggtgctcacttctcttgcctcttgagatgttttccagttcacaaactcatcccattaatctgtcaacttctgatacctgggtttctcaaaatccagggtccggttgcgttggaccaacttcgcgttcaagtcagtcctccactttctgaataatgtgctcatcttcgataaggctcccttctttgctagctcttcttggccttttggaaaggtgaatgtcagcttcaactttcgccaacattcttccttcaggttatgtggcaccgtccagtcgagttgtgttacatcatttgttttccaatgtctatacttgatgggaatgaaatccttgacgatacatccacacgccctaccatagggagttactgccgtcgatggttcgtgtggccacccagtttcagtgagcactgtcacaacgtagtgaccatccggcatcgagctaggacccctaggctacctcccatatgagacggttgaatcctggcccgaaccaccagtggaagtgccaacctccttggaaattgcaaattcgattagttcgaatggtccattagagttggaatttgctaatgcactattgcgtgaaatatacgtcgaaattacctcgctgccttcggaatgctcttgatttaagtttaagaatgcgctagggctggcattatgttcaccctcagatccggagctagcgaattcttcgtgttccatctagtcatcatcgagcataataacattactaatgttgaaaaataacatggtctaaaggtgtaagatattttgtgctctcggaactgctacaagcacaaaacaggaatatatttgctctcagatggcgggttgccaacttaatggcctcctcgccaaaatatggcaggctgccaattgcacggcctccatgccatggtgtactaggtcgtcatcgattatgtgtggcagtataaacagagacgagaataaagggcaattcaaaaatagtgaacaaaagagaataagggagagagcgtgtggataagagagatagagggtgaagtgggtaagtggttggccgggtaattaaatagtaggagataggtgccggttttataccctaatccggcacaattcacaaatcacacaaataaatgaaatactgccacacataatctcccatcatatgaatttcatcatcgagcagcaagttatattcacatggggagtttggaaagattgggtaaatgttcagatgtgcattccaagatatacttttcctttaccaaacaagaaatgaggatgatggatcatggaaacagaacctaagggcatgaacatattaatactagtaatataacctaagtaagcaagtaagcaacctaagtaagcaacattttaaatcagcagcagcataaaaaaaagctattagcaatccagggagcatgctcatataagtattggctcacacgaaaaactgtactcttatcataataccatagatctgatcaactgtatgagatcatacaaaatactggtaatatgtaagacggatgctctcctagtgtcctgacaaaaaattgcaggccagcattgttacagaacaaagtggccttaactttagtgagtttatgattaaaatttagacaattctgatcaactaggcaaaattttaaatttgaaacaataggaaaataagtgtactctccatctccatcccaaaatatagtaacagattagacactgcctattactacattacaatagcgtgtcgattcagtaaataggcaactgcatcaaaaatcaccctgggaaaccatgctaggccatgcacagtgagaaacgactgtcctaaaatattaatatttagcataatcgacagatgtagtattgtatccaggtattagt

SEQ ID NO: 72393 - DNA, 1735 bp, Oryza sativa
ttcggcacatttgactattggaacaattttttttcttaaaaaaattacgggcaaaaacatcattcaattttttttataataagtagagataagcgtgttatataaatgtaactttatacagtattaattataaattacaatttctttcttaaatttaagtttcactataaaataggcctattacttaatatgttcaaaaaagagtataaagggcaaaaaaaaagaaattaaatattagaccgcacaaaatatgttccaagtttttgctgatttaaatcaaatggttgccatacaaatccgtagaatgaagttagaaattaattcaaaccctaactactatcccttccgcatgatcggaccgtacatacaacgcttggtcattctcttcagcagttgcctcgttttccgtctcgatatcaattgtgggtagcggtggctcatcgggctgatcgtagtcatcttcgtcaatgatattctccattccgacaatacttcgcttgccttctaatacaacatgacatggcctcatgagtgatgggtccttaatatagaatatttacttaacggactttgcaagcacgaatggttcatcttcgtagccaacatcattgaggtcaacgatgatcgttccatgcttgtcaatcttcaaaccccttggaattttgacccatttgcattggaatagagggactttgagggctccgtaatctaactcctagattgactctatgaaaccgtaataagtctgcttattgccgcctcatcgtaggcatcgatgcgcacagcactgttttgatttgtactcttgttgtcctgagtcttggtgtaaaaggtatacccgttcatatcatagccctggtacatgtggattgtgttggatggcccccgagataatgaaaaaagggcaccatcgatgtctgcagttgtcaggtactccatcaaccatttcccgaattgaagtttatgcatcttcgcaagccatgctgctcctttcctgggattgtctctgcggagtacatccaagtgcatgtgcacgtacggagacaccaaagctgactgtcgtaacactgcaaaatgggcgtgtcttatggtttgtcgatcaggggtgaaaattctcctgtgacctaatgttccctttccaagcatcctaccctcatgacgaggcacaggaacaccgataggttgtagatccatgtaatctatacagaattcgaccacctcctctattgcataactgtcacacccagaaattctcgaaccagaatttctaagctgaatgtgcattaaatccctgtccaggaccagccagggtacacaaatgacaattgttgacatacagacccacgtcttacaaaaatataaaagattacaaatgcagcgggaaagattaaagcgagctaaaccgggaagcttgacttcagcagcgggcgacgccactccacaggcaaaccttgacggcagcgacgaaaccaacctctctgagacggctctaactaagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaa

SEQ ID NO: 72394 - DNA, 1406 bp, Oryza sativa
acgagggtgagtatcgttgggtttgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgagtatggttgttcaggatggttgggcctgtacagcatgggtgtgctgttcagtgttgattaaaatttttaattaattactctactgttttactactcttaactctttgctaa

SEQ ID NO: 72395 - DNA, 2196 bp, Oryza sativa
tgaaattaattttattcgttaagttattattatgtgatcttgaggtgtaggttcatgacttcatgttaagtagctccaaattattcttcattccccctcctccccctgaaaatcttgttctgaattccaatagaaaagttattcttcctttttcccctgaaaatttcgttctgaattcccaataaaaaggttataaatttatatgcatgaagttcatcgagttgttctgaaaatcttacagttcgttatcaatacaaagactacttcaagtcaaacaagcaggattctacctgatgagctcatcaagttgcacgggttcacaactcttggtggcaaacggccagcatatgacggaagagagagtctctataccaatggttcacttccttttgaatcaaaggagtctgtggtcaaagtatttgatccagaaaagaatgctaaagaaaggtttgtgtgattctagctaagaattttcttatgtaccgagctacatgtttctcaatattagattattatgtcttgcccttctgcagggcgcaaaaggaatttaagatcacaattgaaattgttggcaaaacaaacttgtaccacctccagcgctttctgctcggaaagcacaggggcatagcccaagaaatcatccatgtttttgatgttatcctcagtgataaactttctcggaagtatgagatctttctcatttgacatttgattgataacttcttgaccagggtattgacaatgttgtaaatacaattaccttttttgcagtcatgtcacagggcccagatcctttctttgtactcagattggtcaccagggttacattggtgatggacttgactcttggagaggttaccatcaaagcttgcgcctgagaaagatagggatttcactcaatacgggtacttccgttcagttattgcttattagttttcactgaatataaatattattccctctggtcataactatttgatgttaggacaatatttgatgaaactttaaccatcaataacttctaaaaaaacaaaaaaaatggtatgtgtaatgccttaaaaaagctatcagaaaattattctaatacaaaatttatggtcaaaatttcaaaagtttgaccaaatcttgacctaaatgttaaatatttgtgactggagggaatatttagatactaactaccgtttttgatctacttcattcagatatgtctgcagcatcctttatgcctgtgagaattatccaaattatagatgggttcctgaacataagttacacctcaagacctttgttagagcggaaccgtgtgcaggtaatattcctaccgagggaatttacaaaatgtgctatataatacctataatgactaacattcttttttcaacatgttcagctaaagaaagtattatgtcatgtttgcattgaaacaaaccaccatgatgaccaaatcggaagatataagataacagggatcacccctattcctatgagcaataacatgtaattatctttcctctcacggctgctgttatagcttctattttgtttgcatgctgtaagcaatgggggcaaaaatgtaccagatcgttgatacttgatataatattagaaaggtctgtgttaaggattctgggcatattggtacattaacagtatgtggattttgggcatttttttttctgccatagatatttttttcttgaacatgcaggttctgccttagatatctatctgtgcaattgaaaatccataactattcaattgaaatactgtgtaaatgatgcattacaaacaatttttcctgtccggatggagtatagcagtttgttgtcatcttttcaatagggcctacattttgttgttatacttgctcacttctttataacatgaataattactgttttattcctcccaaactgatgcctgttattcgatgctgttagatgtcctgttggtgaggaaggaacaacaatgactgttcttcagtacttctgtgatatggagaaaacaggtgtgcctagtgttggacattggaacatcgctgaagaggtgatgacatgcttcattgttataactcagtttcgcccaaaactcaaaataacttagcattgctttgttgaagcgaattcatggttacttgtttagcttttttaatgtttaggctcataacttttgttttttatgtggggatagccgaag

SEQ ID NO: 72396 - DNA, 6321 bp, Oryza sativa
tgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggttgcaatggtggccccaggctcttggaaacctaggtcatcatcgccgtcatcgatgtcctcggcgggggccttctgcttggcctcacttcgccgattaccggaaggaaccgccggggatttgccctctcggcgctcctgcctcctcttctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccgtcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccgtgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaacaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatctttccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgatcaatttggccacatcgtccagccaacgttgggctggagactccgggtcatgggcgacgggcgggtgacgtaggagcgcgcccgcagcttggagcgcgccctggggcgtgctgccatcgccgtagacgaggaggcgacgctccccatctcgccgcccttctccacctcctgtgggtgtcgaagtcgcggatccttcggccctctcgagcgccttctcccgcataggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagtcccctacctggcgcgccagatgacggagcgtggggctcctcactgggagaccgcacaggcccccctttgccagttcggccggggactcagggtgagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatgagccagcctctcccttgttctgggttccccatctggaaaagtccagtcccccctcccagtgggcaaggtcctccttttatatcttaaggggataccacatgcaccatttctctcttttttgtggggacttaccccaccttttcataaatggacggagatttgtatagttgccgtccgagtcaccatctgatgagacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgactaggactaacgtgccatctctgggaggtaacacgctagctccagctggggacgagcgcctagaagccctcgtcctgacgggatggggcgaggcgtgcgtcagatcgcctgtcgccaccaaacccgcgatctgaccagtctgtgactggtcacagaccggataaacgagtgcactgcactgcgttacatgcggcatgacgcgctcagccaaaccgcaataaatgtggttaggtgagccccattgtgctcacctaacccatacacgcggagcaaaaacccacgaggggtcggggcgcctcggccctcggggccgaggcgggtgcggcccgaccccctcggggggactaagaggagggcgaacacatcaccctcgggcccgacgtcctcgggggtgccaggccacgtgtgcgattgtgtctgcctcaaacctctagtcatgatactcctgatcccatgtcaccgacagacggcgtgaagatcagcgaaattgagccacaagaaaccttcctcggccatgaaagcatcaagtgatgttcaaacagctaatgacattaggcctttcttgttggcgtccgtgtaccatttatgtaatcttctcatctcccacggaccttcttcaagtgcataatccagccaaaaggctttgccattttcaaacactgccagacaatcatctgttccaaagtattttgggccggcaagttcaccggtcttcttctcatcaacatctctttccttggcacgttttttaccacctcagaaggcggttaccatccacttcaccttctgattatccttggacttggagttgtggcttttgaccagtttaggcacttcggacttgtcgatgacatagtcatcgaccgagggtgcgtccacgttgtcttttgcaggagatggatcctcatacacatctggttctatttcgacccattccaaacctgttgcgacttcgatttcggttctattgctggcataattgacaatattgctgatgtagatgccacttcagtgctcttaggttgctcatgttcttccaccttatcattcgatagttgtttttgaggaggtctcagtggtttcgacagagcattgttgccagtcccaaagagtatatctttatgtgctacaatactataatgtcaaccgcatccccaagtacggatatgccatcaggagtttggatgtccagatcgtatgactctaaccctttgttcaccacttgcaactgcactttcgcataatcatatggaatagtgttatcgtgataaattcttcaagggatatccattccaatcgcagccacaagggttcttccagctctaccatgtgggacgtattctctttcaagcctgttgacggtcgttatcgataagtttcgaccatcaatatagccaaaatagaggagaactagtgatgcttgcaatgcatatacatgttagaataataatattccactagtattaggttcactaaccttttgcagagaataaaaataaagtggaggagaatcgacatcaacatagatgataaatcaatcgggcgatgttgagaatcagacttatgtatgaatgggccaagaacttagaattgacacgacaaactgggccaaaattcacaagtttgcatagaagaacaacggaggaggccgctagccgaaattgggctggattgggccggccctagatttggccgaaccagggggttaggccgaaccctcatcagcgccatctgatccagggcttcgcctggacggtgtggattatcccccaatgacggttggagggtatttctgaccattccaaccatcacaatcgtcattgggaggctataaaaggagttgctcttctcacttcactcacacacctcaagcaatagctctctcatattctctcaagtttagtttagtagtatctagctagtggaataagaatagagtagaaatcaggagtccggaagccttcggaagagttcgggtatgactctagtagctttcctttcctcttttgtaagctttgtacttttattagaatactcttctttatacatttatggtattgaaatactttccgagtatatgaatgcctactttatattatgttcatgttatactgaatatactgctagcttatctgggagatgctttggtgcaggtataatgtttgtgtatgcaattactctatgtcatgacgatgatattagagtagtatctggtagtttagacgtggtgtctagattacaggatatcattatttggggttatatgctgcggatgagaggtgggccgctgatggcaatagctcagtacgggtattcctccgcgtgtgtatataatcctatgttaattcactggggagggtattcctccttatttagccccggttgtatggtcataatgggctgtcgtaaggaactcgacagtcaggggtggcttctcagagtaccaggagagcatcggatagagggtactagctagtatatcagataacaagaatgtatgtatactatatatattagaagtataggaatagattatctttctcttttctttccacttagcttagataatatattatgagaataagtagctaatgcttgtgtgtcactctacccttggattattctaacccctgcttagaatatgattatcacaagtaatatataaattattagtcaagttctctctacatgatcttcccacgggataaaataaatatgatacccttggaatactctcgggtgaattgctacaatggtatatccgtgcgcttgcggataaactctataaccataatataccataagtatttttgcgccattgctgggaattatatttctaataatgttgttaagaaataccaacaagcatttctagcgccgttgaaggggaagattcataacagagattaactgaactaatactttatatttacctctgtataaccttggttgttttcacttttgttgtgaaaacagggtcgtgcatgactggtttcaacttgccgggaaacttcaaggaaaatctagaagctttcatccggagcatcaggtcgcgagtcattgctccgcagaaaactctaccgacagagaaaccagttgtaccaacgccatcatccttcaagactatggctgacaagacccttcgcgagttcgctgctccctctgctgagaatgtggccatttggccacagatcaacatgggagacgtggatttcgacttgaagtccagcctcgttacgttggcacaggctagcccgttctgtggcaagcctaacgaggatgccaacgctcatctacagcagttcctggagatctgtagcacgtgcaccatgaagggcgtcggtcccgacgccgtcaggctaaggctgtttccgttctccctcctcgggagagtgaagcagtggttctacgccaatcatgctgctgtcaacacctaggacaaatgttctacggcattcctctcgaaattcttcccaacgggcaaaaccaatgcccttcatggacggattccagtttccagcagacaagggacgagtccattcgggaagcatgggaacgtctgcaggagtatgtggccgcatgtcctcatcatgggatggaagactgattaatcctgcagaacttttataatagactcaccccaatgtcccgccatcacatggtcgaggcagctggaggagcattcttctctaaaacggttcgaggaaccgttgatttaatagagaagatggtctccaatatgggttggagcgaggaacgactccag

SEQ ID NO: 72397 - DNA, 2085 bp, Oryza sativa
ttgccccttttttttctcatttctcttcctctttttcctttttgtttgatgagggtccttctttttccttattattgcatttttttttacaatgatttgaattattgatgagaaagtggttggttggatagtaacaaatagagtaattttcactttggtcaccttttattactactggtgttttgttttggaccacattttaactaatgtttttactttgatccgggtaattttgcatttatgttattttggaccacccttaacttctttttctatttacatcaaacttgtcgtatttcaaataaattgtctatataaagcggtgtgggtttactgatgaatttgagccggcgtacttgaaatcattcatatgcttgagataagagttagagtagtccaaagtataacaaaggtaagattacctggttgaaagtgaaaacaccggttaaagggtggtccaaagcgaaacaccagtaataaaaaggtggtccaaagtaaaatttactctaaaaattgagtaaatttcatcttccatcactttatattaccctagttacacgatgaaataagaatttataaatttttcacttaataataccatctaatcttaccaaaacatagtagcttcgaatagggtactgagttgagttattgcttgagtttctaccatggctatttggtccatccatagaagaagaaagaggtgaacacaagggaatatatgtgtagtgcgacattaggagtcagcccactacttgttcttgtgcagatatggcaaggagctcaacattgcttgccctattgcctagcccaaggttcatcactagcacctctggtatgccaacactcgagctaaaacccctccaatgttgctaatcccatacgttgatgctcctatctccaaatagggcgcccgatataatgaaccactatctctactccgtcctccaaatcaggacacaaaccatcgcccattgggactggggacgctcgctgctgccctactcctgctcccttgtagatcaggttgccaccatcaccactctcctctctcggttagatccaagttacacattgattgggctgcacaacaccgatagtcatgcttggtgatggcaatgtgtgcacgcgagagagagcacacacgcaatggtgtaggtgcatgggtgatgccatgatgtgttaccagatttggaaaatatgaggatgtggtcttgagtgaaacacatagtaaatagtaaagttacacggtccaaagtataaaatatgggtaagctatcagaaacaagggtaaaaatatacgagccaaactacaatttacttattttttttctttataaaacagctttacaaacacatattttgatgatctaattatgtgaaaaacgatcactttttttttgacagctttgatgccaaagttgcattatacatcgtggctttgtgtttctaatgatgcattttctattagaatttaaataattgatatgctaataaataattagtcccttttactttattttttattttttatgtcatttgtaaatttaaataattttttatttgttaactaactcgaaaaaagaatgtcgccgacaaatggcagacgtcgccgcgggtgatgggacgacggcccattacacagcccggcccggctggcacggcccacacggccacacctcaatcctcaataggcgcacgtgcgacgcacgcatctccctgtacaaaaccctagccttccccatcctcgcctcctcctctctccccccgcaccaccgcctcccctcctctcctctcctctctcccgccgaccaggagaaagaaggaaaaagaagaagaaaaatcctctgcgatggcgaagaagaaggagagggcggtgaacgtgtcggggaagccgcgccactcgctcgacgtcaaccgcgccaatgacaagaagggcgcgggcggcggcgccgggggcggcggcggcggccgctcggccgccacggtgcggcggctcaagatgtacaagatgaggcccctcagggaccgaggcgggaagatcctgaagcacgacctccagtccaaggagctccccaacacccg

SEQ ID NO: 72398 - DNA, 1445 bp, Oryza sativa
tgttagtgatatgccctagaggcaatcatagagatgattgtatcacatactatgtttacatatttatttgacattgttccttgaaatagataactccttattggttaatgaatatgtgattctttcatgagactctttatgttgtttgttactatttctaaaggatccttgatcaaatatcatatgtggaacaaatatgtttatatgatcagcacatgtattaattgatgatcatgcctcatggatcatggtatagagataccaaattaataatgtggacacatgttggtgaacatgttgttggatagacccaacatgagacactacaagagccctatgtgttgtgtcatcagtgatctcatttagtgttggtgttgaatccttagacctgagattatcatggttctcaacatgtgtagtagcttacttagggactgctaaacgctactccgtaaatgggtagctataaaagtagttttcggatatgctatgaaacatgtagtgggatatgaataatcaagatgggatttgaccctcctatggagagatatgtctgggcccctcgatgttgtagattatggaagtgcatggccatggcaaaggtggaggagtcaatcacaagttacataatctatcaacaggttcgagtgaatgattgagctattagaggatggcatatatctagccttgagcttaatcgatatcgtgaggcaaaggggttcatacaagtatacactagaggttcagccgatatgatctttatgtatgcacggtgggtcaattcgttctactaggagccgctgttgacgcatggaccgaaaaggagttttcgggttgcagccgagtatacatgaacctacagggtcgcacgcttaatgggccggactaaggggattggatggagatccaatatgagcatacttcgtatagggatccaaataggagtcttacgggccttggaggcccgagtgatggatcctatatattcgtgaggggtgtgaccggtggaggcattgcatcacgtgagaaaccctagccgtcacttccctccccgagcaaaaccctagccgcgcgcgggtgctagcacatctgcgcgtggcgtttcgtccctgtatgtgtggataccggtagaggcgccgctggtttgcggtgctgatcagcgtaggagtacggcaaggagaacgcacgaggaggagaaggtcgagccggtgcgatcgactacttcctctacaacgacgcgtgctacttcgcgagagtttcttcgacttctcagtgtcttcttccgctgcgcagcgcgtcgagtggtaacgatatatgatctaatacttgcttggttcctggtttatgcgatagaaatgtttgatttatgctatcgtagcttacgcttatcccaacagtggtatcagagccgccttgtatagtttatgatctagatcattgcatat

SEQ ID NO: 72399 - DNA, 2611 bp, Oryza sativa
agatctatgtaccccgtgacatggtaggatagattccctcatatctatgtaccgccgtgtgcgttgccccttagatttcgcttggggtttttatatctatcttactttactgctgttgtatattggatatgacatggtaggatagattccctcagaaaaattaagtgtgatttatgctcttccagtaattgcacctaatacggttgtgatcataagtgatgggtttgtcatagcaaagtgtcactttttatcatgataaaataggatagatgtcggacatctatgtgcggagattattggtttacttgacaaggttattaaaacagttttggaccttggggcataggttgggttggacatggagatgtcaccccaacagcacaagagtcacatatgatgtgattagcaaggtgttgcttacctattttgatagttgtctagctatgatgccaaagctcactagacactaataaaatgaggatcttgactcactatgttactagagggaattttgtttcacaatacatagtggaagtatcttttgttaaattgtttaatgaaaggttaaatgtaaacatgatgctgattttgcatacatatatttctattgtagatcatggcagctcctgcatcatccaattttaacttgcggtctattcttgagaaagagaagttgactggaataaacttcatggattggtatcgcaacctgagaactgttctcaggcaagagcacaaagagtttgtgcttacagagccttttccagctaacttgcccaacaatgctcctgctgctcaacgtagggagcatgaaaagcgatgcaatgattatcttgatacaagctatctcatgcttgctactatgtcccctgagcttcaaaggaaatatgatgcattggatgctcatacgataatcacgagactacgtaacatgtttgaggaccaagcaagagctgagaggtttaatacctcaaagtccttggttgcgtgcaggctagcagaaggtaatccaatgagcccacatgtgatcaaaatgattggttacgccgagagtctggataagcttggttttccccttagccgagagttggttactgatttgattctccagtcgctacctcccagctttgagccgttcataatgaatttcaatatgaacaacctgaacaggaccttggcagaattgcatgggatgctaaagactgctgaggaaagcattaagaaaaactccaaccatgtgatagttgtgcataagcgcaagcccaacaacaagaaaagttgtcaaaagagaaagctaaactctgatgagatcacgagtactagcaactctaagaccaaggttcaaaagacagggcccgctaaggatgcagagtgcttcttttgcaaggagacaggtcattggaagagaaactgtaagaaatacctagagcagttcaagcagaagcagcaggatggaaagagttccacctcaggtattaatgttatagaaattaatcttgctacttcctctactgattcttaggtatttgataccgggtcagttgctcacatatgcaaatcgttgcaggggctgaaaagaagtaggagcttagcaagaggcgaagtggacaatgattgttcagtctattataatgacattttctatttccatgcacccatgatgaatggcttatacattgtgaatcttgatggatgttcagtctataacattaatgcaaaaaggcaacgtcctaatgatttgaatcccacttttatttggcattgtcgcttgggtcatataaatgagaaacgcatggagaagcttcatagagatggacttctacactcttttgattttaaatcatttgagacatgcgaatcttgtttacttggcaaaatgacaaaggcacctttcacgggtcaaagtgaaagggcaagtgaactattgggactagtacatactgatgtatgtggaccaatgagctcaactgccaaaggtggttttgggtactttattacctttaccgctgactttagtagatatggttatgtctacttaatgaggcataagtctgagtactttgaaaagttcaaggaatttcagaatgaggtacaaaatcatttgggcaagacaatcaagtatctacgatttgatcgtggtggaaagtacttgagcctagaatttggcaatcatctaaaggaatgtgcaattgttccacaactcactccgccaggaacgcctcagtggaatggggtgtctgaacggaggaatcgtacattgttggacatggtacgatcaatgatgagccaaactgatctgccgctaagcttttggggttacgctctagagacagttgcgttcacactaaacagggttccatcaaaatcagtggataagacaccatatgagatatggactgggaagcgtcccagtttgtctttcctaaagatttggggctgtgtggtctatgtaaaacgtttgcaatcagacaaactcacacctaaatcagataaatgcttctttgtgggatatcctaaggaaacgaaaggatattatttttataatcgggaagagggcaaagtgtttgtcgcccgacacggtgttttcttggaaaaagagtttatttcaaga

SEQ ID NO: 72400 - DNA, 2895 bp, Oryza sativa
ctttagcggggtcaataataacccaatcatcaagccgggcggtgccaactcaacatagaacattaattgggtgacaccatgccaaagagaaaccatggtggtcaggcctaggcctagagcatgaaggagattagtagtgcaggaccgcatacagaagtctccatggacatctcgattgatcacgattaggtaggctagctgctagtcatcactgaaaactattggaagtcccattctttttagcaacaaaatatatatatcatctcaacttgtctcttgcatcaaatccattggctcgcacagtactatggcgctatggcaattggcaacactagatccatggggttgccttttggtttggcaaccaatgcttgggcctcagagtgtcttgcttggacggtttggagacttttgaggcgctctagggcaggacgattcaaggtgcagagattggtgatataaggacggagatgaatgatacgagaaaggagatgaatgatgtgaaattgtggaacaatcaagttgtgtgaaaagaagtgacaattaagatccgctgaaatccatctcgtggagttaaggccaactctagatgatccggacctatgtatactactaaaaaatcgaacacgaataagtagggtctcaacatgagcccttaccttttgtgctagcatagttgccaaaattaagaatccagacgatgcatatcattcagtcaatgtttaatgcatatcccatattaaacaagtttcatggttctcaatgtgtgcgttattcataggaattaaaagaggaacttcaaaattggaacatagcatggcacaatcaatttaaaaaatgaggtcgttggacaaagtcatgcaccgatagaggctgtggctcatgcaatcttactagcaaaggtgagacgaataacatgaacacggtagcgtcgataaagagaatgctagagtgttagcaagcccaatcctgtcaatttagtggcctggagcgaagctagaaaaatgggccctctaatacaactatagtaatgtgcattttgggcaacatgatttcactctaaatttagaaataagcaagtgatttatgaaaattatgtcatactagattcaattcaacgttataataaaaatgagtgctggtaaattaccaagatgagaactagagaaaatgactattcactgtcctagttgcacagctgcaccgcaaggatccctaaatcctaaatcaaaatttcagaaattagaagaggagcaattgggagtaacattttgcatcccaaaatttaaacacataaacttagcatacatcaaaggggagagcaattgggtacctcctagtctcctagaattgaacagagagatcggatttttgcatccggctgccagttgcagttttgccgccgagcacgacgccgtagacatgtagccgcgcgcagtcgtcgacgtagcattgcgtagctgagacgcggctggaagggcggcgaatagccgaacaggcgactgcgagcgaaggcgaagcaatcggacggaatcacggaaggaagccaaatcgacacaattttttttcctgtacgtgtgcctcttcatctactgagctagtgggcttcctaattcctataggctattatgttagcatatatggggttgggcccccatcacttcgcgggccctgtgtggaggcccagctcgaccccctagggctgggcctgagtgttagctcagaagtcccacgaaatagaatgtgacatgagcgaatggtggtggcttggtggaagtcgacgaggagataataatgatgggaggttttggcgaatggcaggcgggtaattttctcttaatttaatgggcacttccatatttcattcgcttaattcttttggggaaggcaaataccacaccacatgccttgtgtaaaaggatggacagactcttgttgatattactggggaaaccgtgtaacaaatactcatttggtagaattcatcttgaaatttgttaaaatcacccaattgaagagacaaaatagtgggccgttcattagtttagatgaaaaatctggactcttgagtaaaattcgcatagttgcatgaccggatttaatgtgagaacgaaaaatcccgcgtccccccaacgaacccaagcgctagagagagggaaaaaaaacctctcgccgtcgcatgcactcccggttcgctttccctgctcccctctcttctcctctcgcgtcgtgctcgtgcctgcccccttcccagttccctccctttggcttggtttctctcaccaaatgccaaagccaccatgccttctctactactactactactactactactccccaccacaacatcccgcagccccccctccccaccgcctccttctccctcctctccgtcccccccttctctccccccctccgctccccaaaacctaaccctaatctccacgcctccctccccgccgccgcccgccgctgcgggggctcgactccaccctccgccgcggtccctcccgggggacctcgcgtgcgcccgcggccgccggctcctcctggttctccctcttcctgcttgcgtctctgcgcgcgtgggggcgggggcgcggtagggtttcgggatggacccgcggcgccctccgtcgcgcgggggcgccgccgccaacggcggcgggctctcctactccaccctcttcaacctcgaggtactgcctgctctctctctctctccctctctgtatgtgcgtgcttcggtggatggtggttttgacgcgcgcggtagtggcggtgttggagtggggggcgcgttgtgattggggtgggtattggtagtgctcattgtcgctgggttttggagaattctctccgggcgctgtatcatcacttggttgtttttttaag

SEQ ID NO: 72401 - DNA, 3556 bp, Oryza sativa
attcctgcagcccagatcttcatgtagacttgggctactttagtggcttccaccgatcaaagtttcgtgtgtttcagatagtgacagagtgatacgagtatcgtgatcatctgttgtgccattcatgtcgctaatcaaatgttgatgccggtaacttggtcgttatattcatgcaacatttccaatatcgcatgcgcgacgatgatgaccttgttttgttgcgattgcatgccatttcttttttctgaatttagttaatgctatgtttcgttcatagatgagtattgtcagttgctggcatcatctgtgtatgttcctgtgttgtctgttgtgattgtggtctgcatggcgtgcaacatgctgctgcactgttatcattgttctggcagttttgttgttttttttatcgctgttcttttattatttttcttgataagtatggtcatgcataataaagttttttttcttgacatgtgtgatccttgcttcgggtttaaatttattttatttgataaggttatgaattgggggcctgcaagggtacattggtttactacgtaatcgcatcttttatcttgtcatcctttgtttttgatactactatagtgttattgttgcttgtctatccgtttggtctatatggatgcaggtctctttatttgtctttggtagggttgaaaattatatatagattttgtcattgtgaagcatatgtcttcccactcatgttaataatatggtttactttagttgaatttacctccattctgatgtcaagtttttacatgaactgctgatgcagcctttgctgaactttaaggtccccttgccggaagatcttgatcgctataggcgtagtagcccaaatgggagtatgagtagccaaggtaaaggctatttaaaaaaatccacctcctagcattgacactccatcaaattgtggtcttgccatttctttacatatatctacttctgtgtttgttctgcttaccctacttttccttttaggtcaagggtccttgtcagaccagtataatggaattaatgatgcttcccatgggctacatcggaagcgcaaaaggaatctggatggtgctagcgatgatgatgaggtagatgcctacagtaaccaaataactgaggagcactaccgtacaatgctgagtgaacacgttcagaagtacagaaggtcaaagtttaaggaggatgtttttagttctgatcctcctcaggtgatagttcctcagaaacacaaaaatggtagtgcaagagttacaaagtacagaagtgatacaaggaatgttgcaatgttgggtggggtagaagccacagctgagtataatgggacaaaatctactaatgcatatggtggtttcaataaggttgtagcttcactggattcttcctatttagatatgggagataatgtaagctacaaaatcccagaagggtatgataagttggcactatcccttaatctacctgttttttctgacatacgtgtcgaggaaactttcttgaatggcacactagatttacgcactctagcggcaatgctcagtacggaccaaaaatttgagacaaccaatcgtggtggattagctgaacctcagccacaatatgaatcactccaggaaagggtaaaggtgcagaaattttctcttcaagtaactgaggatcccttcgcaattccagaaggagcagctgggaggatacggagatttattatttcggaatccggcagtttgcatgttcattacgttaaagtcttggaaaaaggagatacatatgaggttggttggacctgttcaaatattgatagcatgcttttgttttctatatacttagcagttaacctataaatgcagattatcgagcgtagtttgccaaagaagcaaataataagaaaggatccttctgaaattgcaagagaagagtcagaaaagactattaaactttggcatgctattgctgttaaaggcattcctaggcaccacaggaatttcatggctttgctgaagaaacggcaagtagatgctaagcgtttttctgagaattgccaacgggaggtattgcacttctctatcttgttggctattttgtagtttggttcactctagtttttgatcttgctgagttaatagcaatgctgcagctttattgagttttgtgtttaaaatgtccaggtaaagttcaaagtaagcaggtcactgaaattgatgaggagtgccgccatacgtacacggaggctggctagggatatgttgatattttggaagcgagttgacaaggagcaggttttttttaatctcttaagcttattgttttttagttccactgaaaccaaattcggaattattgccttttattttttttctaaacaacagtatatggggctgaatactatttaaatacttaaacttatgagttgtatatggctatgtatttcagttcttccaagccactgaactgaaaccaaacaacagtatatggggctgaatactatttaaatacttaaaattaggggttatatatggctatgattccagtcgttccaagccactttaatttctatatacatggttaaaacttaaaaattagcaccaagtattgtattgttttgcatagcacatgtttttctttttgctgatttttcttatgcgatcttatgatgggagttatatatcttttttttttgtctgtttcatagtatgaattgaggaaaagagaagaaaaggaggcggctgaagctttgaagcgtgaagaggagctacgtgaagcaaaaagacagcaacagaggctcaactttctcctatcccaaactgagctttatagtcactttatgcagaataaggctggtgaatcagcaccatcagatgaggcatctgtccctgaagaggatgaggaagatcctgaggaagctgaattaaagagagaggccttgagagctgcgcaacatgctgtctcccaacagaaaaggatgacaaatgcgtttgatagtgaaactgggaggcttcgtcaatcatctgactctggtattccaactgatgatttagctagtatggagcctaacaagattgatctattacacccgtaagttccactcgactggtttggttgtccttgttcagaattgagcatgttagaaagaatgaaaggacttctaacactggtttctttggggttatcttattttcagctcaacaatgcctgagaagtcgtctgtgcagacaccagaattgtttaaaggtgcactaaaagaatatcagttaaaaggtttacagtggttggttaattgctacgagcaggtacactgttaaaaagttaatgcatctgatcattttctgtgacttctctgctgtttcacttcaatattttctatttcttgcagggattaaatggtattcttgctgatgagatgggtcttggcaaaaccgtccaggctatggcattcttagcacatttggctgaggttggtgaatttgccctttcttaaatccatgttatctttctactattggattaatacccaatgaagcaatctcttttggccttt

SEQ ID NO: 72402 - DNA, 4486 bp, Oryza sativa
tcggatggtaccgactcaatcaggtgataaaggtgcagcagatggttctcaaggggttcaaggtgatggttctcaaggaacttaaggtgatggttctcagggatttcaatgtgagaatcttaaccatgatggcaacacggcacagctacagtttaacaacattcaagaatggattgactatgtcgcgcaacatgctttgatttatcaatctggagtgttagtcaacactttgtcaaacatggttgatggctcaatagcttaataccaggctacaggaccggtctatttgccaggaggtgttttcacgaactatcagcccttgatcactaataatcagccagctgtttagccaattcctcccaatgcaccatcggctcaaccgacagcacctgtatcagctcttgcacctgttgcaccatcatcggcaccaggtcaactaattaatcctcggttgttggtgggagagcagccacaacatagtggacaaaaatgtgaatcggctaatccaagaccaagttgcagctatgttcttgccagctcagcctactgttgacccaatccagcaacagccgattcaacagacgccaccgaggtagcaggttgtgcagccgattcaacaaacaccaccaagacagcaggttgtgtagccaattcaacaaacgccatcgaggcaacaggttgttcagccgattcagcagcaaggtttgatgaatgcatcggctaggtttagaacacctgacaatcagctaaggcagcacgctgcgaatcaagttgtccaagagcatttggttcataatgtgcaaccagatcaaacggtgaaacctcaagttattcccgaacatttggtgcgcaatgtacaaccaaacattcagaattatcaagggggcaatttaaattatcagtatcagcctccatcgccgcaagttcaatatcagcaaggaggatcggcttagcctcagttcgctcctcaatacaatcaattcgagcccgtgccacaacaatcacagggggtgcctcagcaacgaccatgggccgatatgattgcagatgtgatgagagagcagtttgggcttaagccgaaggatgctggaaacttgtatcggcatccataccctgagtggttttagagagttccattgcctaaccgattcaaggttccatatttttcaaaattctcaggcaggacagtgtttcaacctatgaacacgttagccgattcttagctcagagtggtgaagcatcggctgtggatgccttggttttcttccttgccatgtggatcaatcaacagttgggccgatttggagaagcattttcatagctatttctatagtggggttcatgagatgaaactgtcggatttaacggcgagtaagcaaagacatgatgagcctgtgtaggactacattcaaagatttagagagatgaggaataaatgctacagcttgagtttaattgatgcctagttagccgatttggcttttcatggtatggtagctccgatcacggagaagttctcgtctcaagactttgatagtttgtcacatcttgcacagaaggtaaccctgcatgagcagaggtttgcagaagccaggaaaagcttttaaaaggtcaatcatgtctgtccctacatgtatgggtctgatgacgatgatgatgatgattttgaaatagcagcagccgaatgggttagaagtaagaaggttataccatgccaatgggtgaagaattctggaaaagaagagaggtatgactttgatgttaccaaggctgataagatctttgatttgctacttcgggagaaatagattgaacttcctgccggtcatacaatcccatcggctgaggaattaggcaagaggaggtattgtaagtggcataattttgggtctcattctaccaatgattgtaaagtcttcagacagcagatccaagaggctattgaagggggcaaaatcaagtttgatgactccaagaggccgatgaaggttgatggcaatccttttcctgtcaatatggtgcacacagctggccgaacagccgacgaaggaagggctagaggttttcaggtgaattcggctaggattatcaataagtatcagaagaaatatgacaagcagcgggagaggcattatgaagaagacgatggtagctttaatcctcattggggttgtgagttctttagattttgctggaatgaaggtatgaggttgccgtctattgaagactgccctgggtgcagctatgttacagaaagttcaagccgatcgtataatagaggcaatcggctaaggcaaataagagttcctgttgatcaaagattgggtccagtgaaccaagatcgtggccaagaggacaatgaagacaggaagactcaatggtgtccttctggtatttttacaaagaatcagaagagaagggttcaaatgttgaggaacagggaacgctttcaggaggttgagcaagaaatcaaccattggctgaaggagacgaagccgaagcaggagtggcgcgttaagaatcaagttcctacagcagacgaagccacaaccgatgaagcaaaaagattggctaaagggaaaagtgtcgtgactgcatcggttaacatggtattcacgttaccttctgaatttggggtcaaacaagccaatgttgatgaagttgaggaagaatcagctaaattgattttatcatgagaacaagaagtctttaagaaaccagaagggacggagaatcggcatcttaagccattgtatgtaaatggctatatcaatgggaagccgatgtctaaaatgatggtcgatggtggggttgtggtgaatttgatgccttatgctacatttaggaagctgggcagaaatgctgaggatctcatcaagacaaacatggtgctcaaagattttggtggcaatccattagaaaccaaaggagttttgaatgtggagctgacagtcggcagcaagactaaccctacaacattttttgtcttcgatgggaagggttcctacagcttattgcttggaagggattggatccatgccaattgttgtattccttcaaccatgcatcaatgcttgattcagtggcaagacgacaagattgaaatcgtgttagccgacaagtcagtcaacgttgctagtgccgatttagctctttgggagatgcctggtctcgattgcttatctggaaaagtttgggatggagattttctaaaagtgtccaattgtgatatacaaccaattgaagatggagagcccaagcttttattttgagggtgtcgtggagggttcaaatgtctacaccaaggacacagtagatgatctcaatgacaagcaaggacagggtttcatgtcggctgatgatttggaagatattgatataggtccaggtgatcgaccaaggccgacatttatcagtaagaacttatctccagagtttagaaccaagttgatagagctcttaaaggaattcagagattgctttgcttgggagtattatgagatgccaggactcagccgatcgattgttgaacatcggctacctatcaaactaggggttagaccacatcaacagcctccgagaagatgcaaagccgatatgctcgaacctgtcaaggctgagattaaacgtttatatgatgctggttttattcgtccttgccaatgtgggtttctagtatagttcctgttatcaagaaaaacggcaaggttagggtgtgcattgatttcagggatttaaacaaagctacccccaaggatgagtatccaatgccagtggccgatcagttggttgatgctgcttcagggcacaagatattgagttttatggatggaaatgcaggatataatcagattttcatggccgaagaagatatccataagacagattttcatggtgcaatcggcttatttgagtgggttgtaatgacttttggcttgaaaagtgctggagctacatatcaaagagccatgaattatatatatcatgatctgatcggctggttggttgaggtttacattgatgatgtggttgttaagtctaaagagatagaggaccacatagccgatttgaggaaggtttttgagagaactaggaaatatgacttgaagatgaacccgacaaagtgtgctttcggtgtatcggctggccagtttttgggatttcttgttcatgagagggggattgaggtaactcaaaggagtgttaatgcaatcaagaaaattcagcctccagagaataagacagaattgtaggagatgatcggcaagataaattttgttagaaggtttatttctaatttatctggaaggttagaaccttttacaccattgttaagattgaaagctgatcaaaagtttacttggggagcagagcaacagaaggctttggatagtattaaggaatatcttagatctcctccagttttgatccctccccaaaaggggataccttttaggttatatttatcagccggtgagaagttaat

SEQ ID NO: 72403 - DNA, 1319 bp, Oryza sativa
taaaggttgcaaagctttcttttaaggggttacctctgatgaagatcacacaagagtactatatcctcaaacaagaaagagctacagtcagctgtgtccatggctgaacagtattgtccactgacccaccaatccaatttgctaaatactgatgtactgttgtcaatgccatctggttctaatgcttgcacaaataaaggtaagatatgtatttcaacattgagaattggatccaatcctccagtttttgataaatcaatcttaaggtccttgatgccgagagcagcttttggagcctacaataagttattaccaaatagtcatcagaatatacaagacaaacaaacaaacactcaacaaaatttcaagtcactgtgactcttgttaaaccctcatgtccctagagaaacagcgtgatttgcaaacagtaaatgagaatatattgggagaggaacgtgagcataaaattcagcagtaataaatagattaaatagataatcatttttcaacatgaacctattcatacaaccagaacataaaaattagaagacatacggcttgaattcaattaatcgacatttataatgtatttgacaaggtggcggtaccttgaacctcagctccactatagaaagcgacaaaagactggcaatgtttgttataagcctccatttcccttgtcctttcggctttccttttccttttgccggtgaggtcgaggttgatttgcgagggggaggtttctttttcttagcagattttgcaggttgcctgagcacaatgtccaggtcagagatttgcaattgcaggatagggccatggtttagtatggtaaatcccagttgggtgagtggccttcgcaggccaagtctaatttcacctacacagatggagtcaactgcaccctgaaaagcgaagcacacgagaatcaatcgcacacatcggcattggcatcggcatcgacagcagcatgaagtaccaagaattgattgatgaaactaggcaggcagattaggtacctttggggattttatggtgatgtccctgagataattgaagctgaaggagcggcatccgatggagagcttggccgtgcgccgaagcacccaggccacaaccctggcaaggaagctgcaataggatcgaaagcattagattcattcttagttatttctttttttttttcagaaaaaaaaaaggaaatagtacattgatcatcccctctgaagtctgaagagagatatcagacagcatatatggaattgagcgatgaaactgaaaccggagcaagaggcgggggtttggtggggggaggaggg

SEQ ID NO: 72404 - DNA, 1471 bp, Oryza sativa
cattggtaaaaagattgccatcatcgagtttgggtcattacataaattacataaagatgctctaattttctaattgtgttagctacaacgatccatagagtgcgcttgaaaaatgtctattgtcattggattatattttttacccgttgcaacacacgggcatttttgctagtcaatataaatgtgaaaaatgttagaatgacttacattatgaaacagagggagtatataaaagttttatttacaaattatttttcgtttgcaaatatacctaataaaccaaacgatggcccggtgagtttggaagggatatgcttgaggcttaaccggaacgtttgaacataaaccagaagcaacacaattacaacgatcacttgcagtccaggaaaattcatgtcaagtaacaggaaggcaggcatgaagctaggtgaatttctattttctagcatggcattgcaacagtggcacaaatcaattggctgctgagcatgattagcctcatttggatgatgaatcaggaaccgagtacaaagttcatcgtgtctggcaaaaacggcagctctggcctctggccctggccaaaggtgcaaacatttctacagagtggttacagaaacattcactcacttcctccctttgttcttccgtttaccctttgcagcacctcgcttctggtcgcccttcttagatttactcttattcctgaaggttctcttcgatggcttcttctttacacctagactagcactcttcttggagacgctcttgttggcgtagcccgtcgatgcaggggtgatccttttcgggccaaggtcttcatcgtcatcttcaggagtgatttcgctcgtggtgaccgtaattttagtcccaccatcttcgtatgtttttacttctacataaacagaacaacttatgaataataggataagaagtcatggttgtacaaaggtagcatggcaagagctgttactaaaatctggtcaatggtctcaccaggttcaggcaaatcatcagtttccatttcatcaccatcattctcaacatcttcaccatcagcattatctgatgacaggactcttccatacagcgcaatttctttctcttgctttctctggaacaaaatgacatcactcagtaaaaccacaaggaagtaatctggattgtatagttcatgttataaatcagccacagtaaacacacttaagcataatccacttgaaacgacactaaagccttgcccctccagtgtcatccctacaattctctcttggtctagtccgttttctaatccaagaagatctgggtttgatgatactttttcatacgaaaaaatgagaattatgtacccataacagaaagcaggtacccacacataattcagctgtgaagactgcgttacaaacagccgctaagctaggcgctacgggtgaaattaactgcttttgctgctatgctgacgggctgcaggaat

SEQ ID NO: 72405 - DNA, 3653 bp, Oryza sativa
cctcttcgcgctactctcatcagaaaactactccaccgaggggccgaaaatatcgctacgaatcaaagaaaagattagaggacggacttgagggctttcttgtcgagggagacggagagggccttgttcttgagggcgcgtttgttgatgtgcttgggcaccatcaccgtcggcatctgccccaccaccacgtcctccgcctccgaccccgacccctccatctcctccccgtactcgtactcctcttccaccgccgcctcctcctcccacgccatggctacgaagttcgctggctcgctctctctctctctctctctctctctcttgtggggagacgaggaaggaagccgccgccgccttcgtgacggccagcagcggaaggggcagctaggttacaagagatcacgtgcaagccgcgtgattgatcttgctcgtctctactcaatttgcacttatacccttaaaactagggataattgaatccacgttattataaattttagcgtattgcatatcgttagtattcacctatttgcaactataccattataattttacaagtatattgaaaaaacaccacttcatacccattcgctccatttatcaatctttttagacgccatgtcttctacctttatcccttcttcctttcccctctctcccagccaataactccgacgagcgtgtgtagtcgaccaaccacccacgctgttagaagatctggagcaagatgccacacgtcgctgagaaggagctggagaggggcaggccacccagtcgggacatgctgcttgccacgggatttgatcgctgccaaatggagtgatgtctatcacacggttgtgttgtcacattgagacttggagtgagcagatgctcatctcaagcagtaatggcggcaacaactagctagaacatgcaagcctcccaggcaacacgtgtctcttttcttggattccatgaattctcgttcgagacttggagtgagcagatgctcatctcaagcagtaatggcggcaacaactagctagaacatgcaagcctcccaggcaacacgtgtctcttttcttggattccatgaattctcgttcgtgccagctgactacaacataccgtggggctgcgagtcctcagaagtatcccacacagtcgcatcatggacttccccgaggtgtcagaggcattccaaccggccttcgatgactttgtcgctggtgccgcctcgccattggttgagcaaatgagggggtgaaggaataaagggtagtttggtcttaaaattagtgaaaacgatgaaaggggtcttcagtgacattgctccaatacttgtgaaattataatgatatggttacaactatgtgaatagtaatggtatatttgaaaaatgtaaaatttataatgggatggttccaattaacccttaaaactatgggaactattccgaattgtgcggttataccctgcgggattggaagagatttgtagttatcccctcatgagttttcataggccagtctggtcgcacccattagtagcgaaccaaacttcggtgggcctaatttggtttgctaccattcatagcgacccaaattctagtcgtcccaataaatctgcactgttcgtagtgatccaaacccgataatatctatcgttattagcgatccaaaatttttcaattgaaccaataagatcgccaccattgattatgatccaaattatctaggaagagagaatgagaaagaagaggtgtaacattgcaggagctgtgatttcatcaccactgtcattctatcaccatcgatctgatagatcaagctgagaaagaaactgagcatggaggattttcaagccccggaagacacaagatgttccttgaaaatgctactcatctgtcccataatgttcaagtgttccgtaaatgttacttgaaagtagcaacctaatactttaatggaatatatattagaactacatattctataatattatagtaatctaatattagataaaacacatctaaaactacggatactatgttgctatatgatatacatagacggagccacggagcctatagagatagtattagtcctttagtgctcatccgatgaaatcttatttctatgcttctaaggacgtggtgtgttattagtagtggattgaaaaacaaagtctctcatttccacgcgtacgtacttttgccgaattgctaaaagaaaagttgatttaaaacataatattaattatttttcaagtttatataattaatatttaattaatcatctgctaatagcttacgtatcttttcaatcgttttatttctctcctctcaaacacaccccactctgaatcatccgatgtcagtattcaactactatgaggatggctgtcgccggtcgggtatattatgctcaattattggggtcatcacacatcaagcggcaacaggttctaatcagcagaagtttgtgacattcaagaattcgcctgaattaggccatggaccgacgggggacaaactacagcagatgttgacctgttgtgtatcactgtatcatgacagcatgtcgcaaactcgcagttgggcttgggcatattcttgtcgatgtatgttcatcatgtgaacttgagattactgacttctggtaatccgtggaaaatgtcagttctgtaggtagttatagtgtataccacttcctccgtactaaaaataaactaatgtatataatataaatttggacataggttatagcttgattttgagctagagaaattacaaatgttgtggttctttacaaattattattgaatagataaaattgtataaaccaccctaattactctggttttgagtttttaccccataacctattttgttgtaaaagcctacccacatgatatggtttcacatcaaaattgacccctccgtgcacataagtaattgaatatgtccatatcttctaatgtggatttattgccaatcaccgattcttatcgcctccgcgctcggctctctcatcatttatagtcatcttactactttgagcagtctaagcacaaactcgagtcgaactcacctcataaccacgttggacgagtccaacctacttggtacggtccctataaatccacatcggaggaaattgtccgaatcaactactcacatatattgggtaagtggatttttcatcaaaataggttatagaataaaatattcagaatcttatatattggcatgaattgtgtgcttctatcatacatattcagttgaaccattcctctgattgttttagatagaattatcatcagaatggtagattttctgttaggtcaatgtatatagctttaattaataatggatatattgaatgaaataagattatttagaagcttaagataccacttaagattaagatctttatgtggtacttgcttaaaggggttgtgctaactaagaataagttggcaagacgaaattggaatggtagtttaagattttgtttctgtatgaaaaatgagatcattcaacatctttttcttgactgtcattatacaaagatttgtttggagagcagtacagttctcttttggtttataccttccaagtaccatatctaatatgtttgatgggtggcttatgggggttgacaaga

SEQ ID NO: 72406 - DNA, 1878 bp, Oryza sativa
cccaaacgaatgaacatgaacactgaacagtaagctgcaaactacatgtacatatgcattgcatacgggatataccgcgcatatggaaaattaaatatagttgattgcattcagagaattatagatcaatatatttttatctgcttctactgtcattaaacaacttgtcaaaatcagacaacttagaacatgcaagtttaatggaataaaaaaacacattcaatatgtaaaagatgatcagcaaatagttgatcattccaatcaaaaccataaattgagtgcgtcctaattaaatagactgctaaatatgtattgcaaattgaacacgcaaaccatgcaaattcaaaggaatacgtatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaacagggatgaacgatacctctggagcgatcactgattcactggaaacttttaacttctcctcatgattgaggcaaattgtcgctgatcgggaccacagtctgggatcaaggtcgactgcagcctatgcatatctcatcgccctcgctcacgttcttctcgatcgcgttcgccgtttctttatcgcttcttaatttccaatctgatttctcacgatggaacttggagataaattagatggattctgtccttccatcgataactggatagataggatttgcaaggagcccactgagtttaagattgattggcccacgatgttaaagtattgcaggatctacggtgtagattaaacgacttatctaattgatgctcagatctttctggttaacgtgagagctccaaaaaagtgtccgattagtataggtatagatagatagataaatggtctcaaggaaataccggtgtaaagcaagagtaaaccctaataaattaatgcaaataataaccggatttggcatgtggaatttttcttgagttctacatgtcgaaatacgctaacaagatttttagtggaattttgagagctctggaaataattttaaccaattaaaattgatcacaagcaatatttaatcccaggaaaactcatttccttttttcctttttttctttcttttctttttcccttttctctttcgaatgggccgccggcccattctctcctccctccccttcccgctgggccggccgaaggccgaggcccagctgagccggccgcctctcctctctctcggggtcgccgacaggtggggcccacctatcgggcccgtctcccttctccagccggcgccgacgcgccccgcaaccaccgccacgcctcgctcccgcgtcttccggggcacgtcggccacgcccgcgcgtgcgcccgtgtctcccgcacccactccctctctctcccgcccgcgcccacgctcgtgacggcccggattcgattttcgaatcccgcctctctctcctcccccactcccccacgtcggccggcgattcccgcctctcccggccacgtccggacccctctctctatttaagcaccaccgccacccctatcttttttttcccagctcgccgagtcctcccgtcttttctaacgccctagcgccatcaccctcctctccgtcgctgtcgccgccgctccggtcgccgctagccaccgctagatgccgtgccgagccgcgccgtcgacgccatcgcgttcgccgtcgtgcgggccattccgtccaccccttcttcgtcggaatccaccgccggaattcactccttgccgtgcgccggtgagcaccg

SEQ ID NO: 72407 - DNA, 7405 bp, Oryza sativa
tcgcaaacttgagacgacggtgatgcaactctttacaaactatagatggagattcacaaatagacttaataaatgtgtcctcctcatcttggtttgccttttattttgttgagtgtgtttgattacatttgaactacactctttatatgagtggtattctgtaataattggctgtaactctgttgagtaaaggccaggatatttattccattatctgaaaaatagaataaaatatcaaaatagaagtaaaattagggtggtttatgcaatttttacctatctgataaccaagattcagagcgtacaatatttcggaagagactcctttgacataaagtcagagggacatggtcattagcatgtagggaggctcccacgtccagctccctccatgagttcttggctccatgcgctcttcaatgaaaaaaaaaaacatcaaaaagcaatagtactttcaaacataactggctgaaagccggaaacagttgttgcctggtgtttcctgacaagcagtgatgctcacgaatcctttggttctttgctctactagtgctgtgtttgttacggttggatgggaacatgcatagtgcttatgaaaaacggagtagtctattagcgcgtgataaattaagtattagctaattttttttcaaaaatgaatcaatatgatttttttaaacaactttcgtatagaaactttttgcaaaaaaacacactgttgagcagtttgaaaagcgtgcgcatgaaaaatgagaggggagtgttaggaacttgctcttacaaacacctcttacaaacacagcataggttactagtgttgaattctgatctgcctactgctgtagtgggcttagtataagtgtgcaaggcaagtatttagaatttctgatgccaatgcccttgtctgcttgatgtagccatctgcacattacagttacagtgtaaatctccagctgccatgttccatgaattattggagttgagagtacatcatgatgtacaaatatagtacaaattgcaatgattgagctatagaaatagtttctgtttgctataaattgccacatgccaagtttttggaacagccaaaactccagaacctcagttcagcaccccaagaattgtaagtggggaaaaaaagttccaaacggagatcttcgtttctaccccactcttttttagaactgaagacagattcagatttcaaagcgagcaagatcatcataagacgtggtgatgaattgcttgcagatttcagtcccaaagaagaaccgaggcagtgatcaagcagcagttcatcacaggagatcagtggcactagacaacaaacaacacacagctgagaaaagtctgaatattcaacattaggctgcttgctattgcacatcatcagaacattaacaggagtgcacactactacattcttcttccacttcttctttttggaattttcctagacgaactctagatgaacattaaacttacaaggcaacactgaacaaaggttgcattttgttcatactttttttagggtcattttggtttatactatacaaaaggacacaactaaattcctagataaactctagggacaaacccagactttgagtagaccacaccagcagcagcagccgggaggaaggaagcaaagcaaaacaccgcggcgcaaagacgcaatgcttttgctacatcctttagtttttgccatcctagccatcgcagcctagcgaggctggtggatgacgcggggagcgccgccgctcctcgggctgccggcgtacttggtgggcttctcggagtgccggggcttctcccggagcccccgcggcgcgtcgccgcccttgggagacaccaggctcagcgccttgagcaccgcatctgcacacacacatgggagacatggcgatgaatttcactgcaattctcgttttagactcgatcttttgatgatcaacaaagcgagcaagcgagtgagtcagtcggtaccagtcttgagagcggcgggcggctgcgggggatcgacgaggaggttatgggtctggtcgaagaagaggtcgtcgtcgtcgtcgtcgtcgaaggcgtcgtcggggaggaggccggcgaggtcgtcgtcgtcggcggcggcgtcgtggagggcgagggagtcggccatctcgtcgagctgctggtgctcgtggaaccagtggtcgcggaaccaggcggtggtcttgacgaggtcccaccactgcggcgagaagtcctccacctgccggaacgccgccgggatgaagagcggcgcgtccgggttcagcgacgacaccgccgtggcgctcatccttccttccttcctcctctgtccagatcaagcggattcagatcggagacacatccaaagaagaaacaaaaaaaaaaaagaaaagcaaacgatgaatttccacgatccggaagatccgttcactctcgcggaaccgcagatcgcgaactgggctcaaaaaattgaacctctttccacagatctaccagcgtacacacgcagatctgagccgagcgagcagagaagcgattgctcaccttttttttttctcctttgcgatggcgacgggagcagggggagagaaaatatccgtggaatcttgggggagtgatgggtagtggaaggagagtagtgggcgcttgggatttatagaagtggaatggattatggatagcctcaaatcatatgagaggaagctacgagcgagccgggccggccgggacgcggtgtggagcgaggccgaggcagcttccagccggtcgggtccggatcgggctcgtgcacggtcagtctctcacgcgcaacgcacggaatttgccgtgtagcggagctctacagttctaccgcggagactgtagagtgtacgagtcacagttggcaacttggcgtcactcgagacttgtcgagagaaaatgatgttggtgtcagttggtgtggtttgtctcctcactctagtgatttagtacgcgttatattccacacgaatagataggacactattacgctgtatatcactaaaagcacaaaactgctgtcgacgggtacgccgtctattattaaaagcacaaagctattaaatcctgaatagataggacactattatgcctcgctatcaacgggtacgtcgcctaccactgaaagcacaaagccgttaaatcatggaaaattcaaattcgctgtcgacgggtacgtcgcctaccactgaaagcaccgttaaatcctgaaaaatttaaattcactcccatggggagtcgaagccagaacctaaggtatcactgagactcttataactactggggtacatgccctttcacattattattattattattattattattattattattattattattattattattaatgtaataccttcgtcttgaaatatattgttatgagtggaacacatgctacgaacctagacaagtttcctgtagtagatgtatctcattcaatactagttttttatattttggaccgagagaaactaagatcagattacacgtattctattacttcggtacttcctatgttctcataagatgtcgttttacagccttcaaaatgtccctaaaaggtgatcatttcagctttgtggtatcatctagtttttccttggatcattctggtccactaatttgaattgagtccatgctcattaattcattgttgtttaacaagcatttaacatcagctgattaaatatggaggccgatttaattttaccctatgagctattttgtctcttaatctctgcaacgtcaatctttacgaaggaagtactccctccgtccagatttattgcgttgtccagattgatgtacacatccttctaatatcgcttatcttataggatgaagagagcactatgaatctaaatataaatcatgactacattcatactatcatgtatataattcagttttagatttgttatattttagaatacggatgggttagccagcctgagtttgaagttttacccccttctatttatatattaggaaagtctctggtattcacgttttcacaacaatgctctcttgcccttttcgtaggtgtaaaatttctccgaggtgtatacgatcataatgctccataactcagactcatcgatcggcatgattgtgaaaaacggacatcatcattatctgataggattaggattaggattagacagcagcaaggcatcttctaaagtaaacaagctccttaatcagccttgcgtaaattccaaaccgaaaggtgcttatctgaaaggcgcgcgagctccgccgcagcagcgcacatggaggccagcgtcgaggcgacacgctaggcgtcggcgcggccgcgcgcggcggagcggaaaagaaaaccatccatccggcatccgccgtctcgtacagcaccacaccggcacacccgcgattcgcgtttgcgtgcgtgaacggtaactagggaacacatctcatattaataataacatcatcacgactgtgtgtgtgttttttttggctttcccatcctaaccctctttttttcatacacgctttccaaactactcatacatttttaaagaaattttctatataaaagctgttttaaaaaatcatattaatttattttttaaaaaaattactaatacttaattattatgtgctaattagtcgtttttttctttttttttaatgcgggaaggattagttcgaattaacttcaaacaactcttgcttttggtgggacacctggccccacggagaagcgtgaaatgacaaggtagggacaccgaggcattattatcctctcagtttgtgtctggcccatgagcaatgatttggttgatcgccctttgcaatcggcatcataaacccatgttgaataatggaaactgcgttgtgtactccagtctctagtctcagctccatcacccatcatcaaacgaacgatgatgtgtttctgaattctgatgtgtgtagtactccgcgtgcaatttggcaagaacagatggttctatactaatactccctcgaatagcgaactacatgcacaatgtcgagatcaaagttttcttccaagggcatgggagtggattggatcattgatgtacatgtaaatagtcataatcatctgaccccaatgaagaaatttcatatactagccaactacccgtgcgttaccatggaatccaagggcatgctggggattgagagcaggtacaatagcagactagaagttagctataaacacatgtcgagtagataaatgaggagagagaagagcagcgggctacaaatttatagccagctgcagcacagactacaaatattactagtgtagtatatatttatatgtaactatcgtatgaattggttattaaattgactatagatgatttggagttagtagttggctatactctgagaatatgaagcatttgaattagggggcacaaaatttctcagaagttgggaggaacaaacgtcagtgatatgagatggtggtggcaccactgctaatatttaaaatagtatagatatcgtttcatccctacgtgaattggaaaagatatgaatatttcctttcaaacggaggatttcttcccagaatttcataataatcaaatttattcatgtaaaattcctgctctgtaatttttgaaagttggaaagtgctgtgatgaagtcgttagttgtggttgtatgactccatacactgcagtataaattctattgaccatgaatattttgtactaatctgtcctttaaaaaaaagccaatcctggctatgaacctggaccatggtaggattagtttttttatgggacagaggagtacatgcatacacgtcttcaatactattcattaattaaggcttggaatttccattcattttggtctatgtaaacatgtcagggattatatttgtaggtataaacatatgggtaccctatattaggtgtgtatagtagtgttatgtgcttgcacagatttaaaaggagctcctcatgaaagctaaattaaaattcctgacagtgattcaaagaggccatcatataaactaataagttcatttgggtccctcaagttgagcgcaagtttgaaaatgtccttcacgataataccagatataacccatccctaatctttgcagaccaggttaaatgagatcccaatgcagtattgaggacagttttggctgacgtggcactagaagaaaaattaaaacccaagtgagacccgtatgtttgtgaaacaatatattcttccttatctatctccctccccaacttttggactcagcggtagcaaatgcggtggaggcaccatgtaatcggcgaggagatgatggtcaacacgcggtgtgcccgacggcggcagtggaggaggcccaatagttaatggaggtgtgccttgctgcctacaagccaaagtgtcgacgttgcccgctcatcacacgacagattgggaggggcagcgactgacggggagaggggcagtgattgcggcgaattggaaggtctcccaatctcctatgtcatgtgtagtggcggccggattgaggatatggcgaagctggagacggggacaccagagaagaagtagtgggtcgggcggagcaggggatagaatcgtcgagcagtggcggcatcaagatctgcacgagtcgaaggcagaggtgataggctgagctggccagtgtggtagaggagatgagagtgacagaggaatcggcggggagtagattaggagctcaggtggatcgagtgaaaggtgcgccagcatggtcaagccgctgcgccgtcgtcgttcctgttgcgtcagaagctgcccgcatgtctctatggcccacatggccacctccgcgcctacccgtgctcgcctccttaggcctcgtggtcgcctccacacctatcacagccgatgccaactcgtggccccacgaggccaaagttgtcttcgtgtggcccacactgccagcaccgcctccgcgtgttcaccccagccgaggtaggcccaaaagcgtcttcgcttcgcaccgccgccgtctccgcctaaagcaccagacacaagtagcacgtgcagcggctagcaaccaatcgccccctcctgcgaccaaactctggagccgcgttgtgcccttcctcaccgtgacaagtgaccaagcgtcccctgccccacaccggcgccatcatgtccttcatgtgccacgcgctagagtctgacggggctggcaccgagcacatccactcatcacggacgcgtggcgtcgatggtggatggagtgagagagagacaggagaagagaggggtagtgatttttttttgtatgacatgtgggtctcatgctgacttagtttggttgaccgaagtattgccttgagactaaaatataacccagtttgat

SEQ ID NO: 72408 - DNA, 5091 bp, Oryza sativa
tcgtcggtgaggcccctcctcccctttctccctctctcccgcgccgcttagccgctgcgctgacgcccaaccgcttagccgctgctgtcgccatccgcgtcgccgcgacgccgccgctctctgccgctggccggtcgccgccggtcgcccccttgcgccgccgctgcgtcaagccacgccgccgtgcgccatggccgccgggccggcttgagccgcacgtgcgcgccggccgcgtaccgccccctccgccgtccgatccaccccgagtggatcggggccgtcggttcggctgcccgcgtggctgccgcgtgtgcgccgcgtcggcgccacgagtgcaccacgtggcgcaccgctccttcccggtccgtggacccagtccaccatggaccgccctccccgagtcactgccatgtgggacccgcatgtcggcgccgcccctctctctctcgggatttatgtattgcgcaataaatcaattaaggatttttctgttatagtaaaaacacagtgaatcttctaaaattcatatctaattcatctgagctccgtttatgcccattcaagtctcagtaaatcaagaaaaatgcatagaatccattaaaaatggttttgttctctgtttcagtagtcttacagcctgtttctattgtttgctttgtatgtcgcttagattccggctctcccgacgctccggtgtactttgaaatagtcgccgaggttcctccagcagcagagcaaggcaagtcatgcttgtcacttaatcatgttgatcctatattgcaaatgctccattgttttccttcaaatactgcattgttttataatattaccatgggatgtatacctactgttatagccatgttatttttgtaccatgttcctttgttagcctgggatataacatgactacatattgaactaggggttgcttagccatgcttagttcaactagcacagaatggggaaaattatatttaatgtatagacttcaggttctagtgttgatgttggattagagccaccgtcctggtgtcgcttcattaaaatttgttaaatggtgggctatgggtgcatggttttgctagtcgcacccatggcaattaaggaccggttcgcgggaaaccctggaagaattcctcgtacttaccacaagccagcgtgggcaacggctgggcttgtagtatagctttcctctagttgacgcatccaggcaagggtgggcgtgatggagtttggatgggccctgcgatggcctatacggcttccggattcatctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcgctgtgattagtttcaccctagtctagtctaatggaattgaatagtataggtggatggttgggcctgttgcaatgtggtgtagcgttggacagtggatgtttaatattgattaattattacaaatgttttactgtttccaactattgtttataaatgctcgctttatgcaaatgaaccactatagctatgcctcgatacttccctgcatcatacccctattccggtataacgtgctgagtacagtgggtagtactcagtcttgctctatttttcccaaaccctagagtttgagtatgcgtcagatggtggcttctccgaggagtaggcttcgtccgtgccgtcgaggatgcctgtggagtggggatcccgctgcggtgcaagtcaaggcatagccccatttatcttttaattctccactgcatttatgtaagacttttataatgtttgtaagacgtggatctgtatgtcaactttatcgtttgtgtaccccggccggtcctggacggggaatttaatgcacattctgcttggaatttgtcaaatcaagtcagtctagggttttagtaaaattatttgagatttatttgacagtcagtcgggatttgatgggaggaatgcattaggtcctaactcaggaatatgggttgcaaggtctttatgctcttattgttattattagtaagtatctaatttctcattattttatcgctatgtaagtctatcttatttattcgctctcatgcaaaaaaatgatctatgcataaaattccgctcttattcgcttatttaatttgagtcctttactgcttcatttaaattggatttgagcatgcattgatcctacccctttgtcttctctagatggccgaccacccaaccaactaccgcggagaaggcattgacgattttgtggcagagttggctcgcatgaccctggtggtgggctaccccaatgcgtcggagtactcgactgttccgccgctcagtggcaagcttcctcaccgtgttcgtctggaggttcatggctaagtgggcacctgcctcgctaacatggtggttgtggcatctggaggcacagcagatcacgcctgtcaggaggcagcatatctgatgatggccagacttcgtgagcgcgacaactacatcttctgcaacacggcgtaccgtttccaccctcgccgagcaagtggtgacggtgtcagcaccttccgtccgacagccggtgagaacgacaccaccttcggtcacatgtgcgcaatgatgaggggaatggacaggatgcactcggatctgcacaaggcgtccaaggccttgaatgatgggaagctcgtgaggatcatagctctgaaggatgagatagcacgcctgaagaaggagaatgctcacttgaagggtctccccattcccggaggagtccggatccgcaccatgccccgcaagtcgacgactgcacccgtgcgcatttagcttgcgcccaggaacccacctccgcccgcagctctcgcagctcctccagttccgcccgcagttcccgcagctcctgcagctccacctccagtcccggctccagtcccagtgtcagctcccgcgtctgctctctccttcgctccagcatcagccgccaggggtccagccagtggcaacggaggttggttgcctgctactcccagtggcagccgcgaccacagtagcagcagttccagtggctcagagctgggcagcggcgagacgtatctgctagactccaggagccgctcagagggacctggcgacgagcaggaggacgccttcgactccaccgaccgcaggagccgttccgagcattaggctcgctttcccttagtttaccgactgcttagtatttgtctgttagtttgtgtgtttaggtttgttcgcttgtgggtcagtcgacatttgatatcatgtgcctatgatatggctgtcttaataaggatttgcttgctgtttaaagtgtttcaattcagatcagaacaattgcagtttaaattcctataaaataaagcttagttcctgagcatctgtttttcttcttttccaccccctccgtctgctcttccttcagatggccaacaccaggaatggcagccgtgcagcaggtgagggcagcaacggcgaagaacgcaccgacggtgggtatcccaacagcgcctccggcaatggtccgcccccgctccccgagaatccgactcttgccccagtaatggctcatcaaactcagatgatggcagccatgatgcagcagatgcagcagcggcaccagcagatgcaccagaggatgcagcagcaagccgagcagcagtagcaacagtttggtccccctccccctcagtccaagctactagagtttttacgcgtcaggccacccaccttctccagcaccaccaaccctatggaggcaaatgactggctccacaccatagagaagaagctcaatctcctacagtgcaatgatcaggagaaggttgccttcgccacacaccagctccaaggtcccgtgtcagcttggtgggacaatcacatggccacccgtccggcaggtacggaggtcacttgggtggagttctgtcgcagctttaggaaggcgtaggtgcccgacggggtcgtggcacagaagaagagagaattccgggcactccaccagggcaaccggacggtaactgagtacctccatgagttcaatcgcctagcgtgatatgcaccggaggatgtccgcactgacgcagagaagcaggagaagttcctagcaggcctagatgacgagctgaccaaccagttgatctctggagactacgccgactttgagggggatcctctggttgacaaggcaattcgtcaggaggatcagcgcaacaaagtggacaggaagagaaaggcagcgcagttccggtcaaaccaaggaagtcaccagcgaccgcgcttcactcccggacagcagggtggacctaccaccatgatcgtccgccagcatcgccctttcaactcgagcagcttccacccgggcgctagtggcagctagaaccaccagggaggtcagctcaactgcagtgcagctctgcgcccaccaatggcaccggcacaatcagttccatcagcccaagccaagaaggagactagagcaaagccaaggtcctgtttcaactgtggcgagcatggccactttgccaacaagtgcccgaagccaaggcgtgccgggccaaggtttgcccaagctcgtgtcaaccacgcgtccgcagaggaggcgcaagcagcaccagaggtcgtactgggtacgtttcttgtcaactcagtccctgctacagtactttttgattctggtgcaacgcattctttcatttcaaagaaatttgtggggatgcatgggttaagaaaagaagagcttagtacaccaatgagggttcataccccgggaaatagttcaacctcggtcagttatagccctttagtgctaatagaaatacacctatcacaatttctagccaacctcatccttctcgggatccaaagacctagatgtcattcttgggctggattggctgaccaagttcaa

SEQ ID NO: 72409 - DNA, 5658 bp, Oryza sativa
acacggacacgattcgatttgatttgatcatacctgaatcacaatgcctttgatcacgaagacggggttgaagagatcgagatagccgatgcttcgcaggctgggcgcttcaccgatgaagatcttggatggtctcgtcggtggtaacaggtgcagcttccggagttggatggcgtcgtgcacgacgaccgtgccctgcaccacgttgttgtgcatctccagagagcggaggcgcgtggtctggacgaggacgtctaccagacggctgaagtcgatcgtcagcacccggatttccgattcggggcggagtgctcgcaggatcatgccagggcagccatacagcccgaggacgcggaggttgacgagggagtcgatgtggtcggcttccatggtgaagaagaagacgtggagtcccttgaggcttgtggcgcagtcgcggatgccctgggggagctcggggtgcccttccatggtgaggttggcgagggtgacctcacgaacacggccgcgctggagcgcggcgcaccagcggtggagttggtcggcgcgccaccgcgtggtctccactcggaagctgtagacgcggccgatctcgtaaccaccatctgggatgtcgtcgtggccgtagatgtcgtcgtcgctgatgacgccgtcgtcggcgcctacgcctccagggaatcggaggcgacggcggccggcgacacctccaccgtcagaattgttgacgactccaccgccttgatctgctgcctcgtgttcgagttcgacggcaaccccgggtccagaatcgtggccatccacgccaactacctcgttgcctccacctccatctccgtcgtcgtcgtcgtcgctcccgttctctccttgtacgcctacgaactggacgccgtcgcctacgtggagctcgagaacgttggcgatggcgtcggcgacgtcggcggcggcgatccggggagaggcgaactggcggtcatggagatacagcggctcggcgcgccagatgtcgagccagcgcggggagaagaggtagccgaggcggaacaggtcgacgacggggaggcggacgagcaccctggcgacgacgtcgtcgggtagcccccgccactcggcgtgcggggcgtcggcgacgggcggcgcgaggacggcggccggagcgtcatgcgtcagcgtcgcccgcggtggcttcaacctggccacggcggaggcgacgattgtcgcgcggcccgcttccattcctctccggcgagtcggaaatctggacacggcggaggcgtgtggagcaagctgcctcctctctctctctctctctctctctctggggtttcaaattttgatataccggaggttggatatttatagagagagtttttctctggtttttttttatcaatctggtgcgcacgttactgatcggacggtctgggtccaattccggataggaagaaaaaaaatctacggcttcttctggaaatacagaataaaactaatcggttagtagcaaatctacggcgcacaatgttgatcggacgacacaccgagcgccacctcacagtcacttcgccgtggacttggcaagttggcgtcagcagaaaagccatcgataccggtgtctcgattctcaattatctcatcagcagatgagatttttatcgataagatttctgcaattcatactgaaacgccacaaacacatttttccacaagacttgcacatcacaagatagtagacaactcatggttttgttaagcaaaatgaataaaaaaaatccatttattattcttcctcaatttaaggttccaaaagtgacaatgcaatctattgtcagttcatatgtcatataactacaagtgccaatccatattattcagtggtcaggcacaaaaattgtaagagagttcaggacatgtttgctcagatagcatgtaattacacttcagagagacacaagcatacatacatacttcctctgttccacaatataagtcattctagatttccccacattcatattcatgctaatgaatctagataaatatatatgtctagattcattaatatcaatatgaatgtggaaaatgttagaatgacttatattgtgaaacggagggagtacaccagaatagaatacacaccatgagcaacagagcagaatacaacagcataagcatagtatagacttgatccatttcattcaataaccatctcactgcagccaaatattttgtcggttcataaaataggttttatttgatcccctgagactgtccctttgcctgaatagttgatcacatgcctcataacctgtcaggatcagccaaccagaattgctccatcactcggctgctgcttccactccaaagctctggttccatccatggaagagtagtgtctcgtacatcagcagaaaccaaagagttcatcagtgatctgagaagcaaaattgaaacatacagatatggaatcaagatatcaggataatttctgtactaaatactccttatattcagatacataataacgctggagtaaagaaatatagaatgcactaatatgtagtttgtattgtaccccttagatgaagttccaacggtaggtcatagaagagaacaagcacaaacttacagtgaaatttgggagtcctgaaagtgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgccccccctcgatcggttagggtttatggggtggagtggcggcggcggcgacgaacctcgttccttgtgtcgttatgtcgtcccgtcctccacccctctttatatggcacagtgtgacgggggcccaccagccattgggctgggcgcccctgatcagggcgcgggtcaaggcccccttgagccgttgggctcaaggggagggagatccatctaacattctcccccttgatctcactatttcctttagctttttctattccatcacagatttacatatagagcatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacataatactttatgtcaatgtgtttggcagcaccacttgactaattgttgtgagagtacattactgtgggttctttatcgcagtataactttagtggtttctcaatactatcaaccacctttaaaaccgggtatgaacttcattagccagttcacctgccccgtagcctcatggcatgctataaactcggcatacatggtagaccctgcagtggtcgtctgttttgagcttttccatgaaatagctcctactgccagggtaaacatgtatcccgatgttaactttgtattatcttttgcaaagtcagaatccgaataccccactatctggagcgattctgcttttctgtaagacatgatgaggccttttgttccttgcaatcacgcaagactttctataccaatttccagtgctctaggcctggattactttgaaatctgccaaataacccggtaacaaatgccaagtcaggtcgtgtgcacacttgcgcgtactataggcttcctacagctgacgcatatggctttgttttcattttattgagctcatactgatttctgggacattgcgatgccccatacttttcgcctttgactataggagcaggtgtagcactgcatctgtacatattgaatttcttcaacaccttttctatatatatgctttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagctagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgctttaacccataaatggatctctttatacggcatcccatattttcgtttcctttcatgacaaaacctttcggttgcgccatgtatactttttcctccaaatctccatttagaaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacgagtcgcactttaaacttttctatattccctctagagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggtgtggcaaccatttctgttgaatcctgtataacaggttcctcactctcattcattgttgccacaggaggggtaacaacaggtgctggtaccgcaagggcatgcattgctggcacaacattagcaggtagagagaagaaaggttcctgagtcgacggagcgggtacagacacccgcctctcctcaagatcaatttctcgaattaccgagctccccctaatcatttcgtcttccaagaagacggcgtgtctcgtttctacaaactttgtataactgtttggacagtagaaacgatgaccctttgatctttcagaatagccaataaaatggcagcttactgttttgggttaaatactttatcctttgcaggactcccccacacacggaggatccatagttcatacggtgttttgggcaccgatgcattctatgcattgtatgcattgttctaaaactgagaactccaatggaggaagaattacattcttaaccagtctctcaattctccccctcgaaatatggcctaaacaacagtgccataatttcgatgagacatcaggagttcgctttcttttcttgggctgcaggaat

SEQ ID NO: 72410 - DNA, 5713 bp, Oryza sativa
tttttttgtggcgtttgtgtcacgcccggtaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccacgggcacggctattcgaatagttttactctgaccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcagcaaaattggagaaaaagagcaacggggaggcgagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttgaagaaaaatcctgaaaatacttggacactcaaagtacttaaaaaaattacaattagaccatttaatgattaatttaatatgtggttaattactgaaatgctctttgtatgattaaaaattatgaattgagctccgaaaaatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacagtttggttaaatattgaagcctaaaggtaaatattcattatttctcgcttcgtttaactcttggttgttgatttgaattgtcgtgtgctgcacgtatgcatgtaaaatacgctatgggtgttgtttttagggataattctttttatctcttttgtgtctattgttggatgaaatgctaaatttgcgttaatgttttcttcgatctacgtcatggccattagtcaaattaatgcttgtcaaactatgttaaggccacgaaaatatccattgatagtttgatttatctcaaatttatgttaagggtgcccatcgatccgctagaggaggtggaagcggttttgcttgatttttcttgggttttggttgaagattaaagcctacaaggtaaatattcagaatttctcaccccgattcacacccgctcgttgaattgaactgccatgcagtaatacatgtaaaatgcactagtcattaatttgtatggatccataagtcattcgtagatctgttctcgggtgttatgctaaatttgaattaatggtttattccatctatgccatcgtcattaatgtttcacattagccaaatattatttcggattgacaaaaaatagaatttttttaatatttttgttagccatgactatctaattaaggtgacgtgggtgtgtgcaaaaacctctattttgtcgtagggtaaaatggtcattcctagttgtttttattctaatgtgcttgtaaatgatgaaatcttcattgtttttttccttcatggtttgtaataaatgataataaccgcaggtacccactggatataatggatctagaatggataactatagcggatcgtgactctgtggagtatttcaggggagtaacggctctcgttgccacgtccaccagcacaaacttagtcgatgcaccagaatatatttggtgtccatgccatgattgtaagaaagacagacaacttccagctcagcgggtccattcacatatccttacaaggggttttatggacaatttccttagcgaggagaatcaaggtgagggaagtgctggcaactgtcatgggcatgatgcggatgtaggctacgaggaggaggaggaccaaacatgtgtcgatcacggtgaacctaatctagatcagatgttgcgcgacggggagagatttgacactgatgatagggaatatcacaagttcacaaccatggtgaaggactccaaaactccaatttacaatggatgtaaggcagagcacagcaagctccaagtggtcctatcgctgcttcacttgaaggcgagcaacggatggtctgataagagcttcatgagttgctagagctcttgaaagaaattcttcctacagacaatgtcttgccagaatcgacgtaccaacccaaaaaagttacatgtccccttagtcttgacatacagaaaattcacgcttgtctaaatgattgcattctgtatcgtggtgaatttgcagatttggagtaatgcccggtatgcaagggagcggaagcacatgtgcatccacatcgagcggtgagacccctctattcaaaaagaagtctgtcttttgggacttgccatattgggaagacctggatattcgtcatgcgatcgatgtgatgcacgtgatgcacgtggagaagaacgtgtgccaaggcgtgctcggggtattgttgaacacacctggcaagatgaaagacacttcgcaagcacggaaagatctcaaagacatgggcatcaggaaagagctgcatcctcaggacagaggaaatgaccgctattacctatctccggcatgctacactcttagtgctgcagaaaaaacgagtatgttggaatgcatgtggggtgtcaaagtcccatccggttactgtgcgaacattaagagactggttagcatgaaagataagaggttggttggaatgaagtcacatgactgccatgttcttatgacgcaactgctaccggtcgcaattagggtatccttctagaaaaggtccaagacccaatcatcaagttgtgccagttcttcaatgcgataaaccaaaaggttatcgatccggcttcattgggcaagcttcaggaggacgcgattctcaacttttgccagctggagatgttgttccctctttctttcttcgatatcatggtgcatctgattgttcatcttgtggaacaagtaaagatcttaggtccagcatatctgcatagcatgtgggctttcgagaggtttatgggcatcataaagaaatatgtcaggaatagatcaagacccgaaggcagcatcgtcgagggttattgtcacaccctgaagtttcccctttttcttgctttaaaaattggttaaataaattgcccgaagaaattatcttaattaacctagagctaaatccctagttaataaatgcaattaataatcggaaatagcgtgtggaatttttcttgagtaccccatgctccaatgcattaacaagatttttagtggaattttcagagccttggaaataattttaaccaattaaaaatcaccaaaatgcaattttaaatcccaggaaaaatcctttcttctttttctttttcttttccttcttttttctctattgggccgtcggctcactctctccacgcgctcggcctccttactttgggccggcccgttcccctttcccctctctccgggacgctgacaggtggggcccacctgtcaggtcgtccccttcctccagccgcccgccccacgacggcaaccgccgcagaaaccgtccgcgccg

SEQ ID NO: 72411 - DNA, 4193 bp, Oryza sativa
ttgtagttgacaacaaggttgtcaaagttctttggcaatgaggacaaaaccagatggaccagaaagtcatctgagatgcccaaatctttttgcttcaatttggaagccatgttgctcatcctaagaatgtggtcttttacaccacctccatggtacctctctgtaacaagctgcattatcagctgtgtcgcataaaactttgaagaaccagtaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttgtttacgctctgtaaaattctcccgttggttcaaatttaaacagagataaaacatgtaaaaacaattcaaaattctattgtaatttgcatgaaaatatacaaaatacatgttcagaagcatttctcacatttatctattctctaaacaattttcacgttggttcaaattgcttagaaataaacacaatcattaaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttccccaggccgcaacctgggcctgggccgggaaagtggctcgccgtgcgctcccacatgggccgatttcggtccggccgccgtcggccgtccgatcgctagggtttcgatcggacggtcgcgcggcggatcgggcaaacaaaaccgcccccggccgccggcgccgaaaccctagctcctcttctcttctttctcttgcggttgcacggagcggcgtcgccgtcgccgaaaaccctagcacagcgccggcggcggcatggcgacacggcggcgccgtcgcactccccttcgccgatgcgcgcactcactcaagggtgagtgcgccgccgtcgagcggttgtgccgcgacgccctctcctttctcttgcgggcgtgcgccgtgccgagcggcgtcgccgacgccggcagccttcgcgccgccgcgccatggccgacgccctcgcgccgccacgccctctattcttttctcttctcccccccaccgtctcacccctccacgcgagtgaagagtgagagaccggcgacgacggagatggtggcgccgccgcgggccccctcgccggcgcgcgcgtgcacccgcgggtgcgcacgcggctgtcgagtggctcctcggcggtgcctctttgcccctctccccctccgtggccggcgtcaacgacggccggcgacgaggtaagattagggttagggtttcgatcttttcgatccgttggatcgtttgcttttctttgcctttcttttggatttctttccccaaccaatctaaacgctaggatggctctgataccattgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtggttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgccccccctcgatcggttagggtttatggggtggagtggcggcggcggcgacgaacctcgttccttgtgtcgttatgtcgtcccgtcctccacccctctttatatgacacagtgtgacgggggcccaccagccattgggctgggcgcccccgatcagggcgcgggtcaaggcccccttgagccgttgggctcaaggggagggagatccatctaacagaaaggtcactgaattatgcgtgtcaagattgagctacttcctgccaaacatttgacatgcctcaaatcatctgagaactttgaacccagcaaaaccctgatgcaattctgcctaaagaactggcagacccacattatgctacagccacaacaagtaaacaacccgatatctctcataaccagcccttttttttttgagaaagaggggcagaacgccattttattaatgaaatgagcaaaagctagaggttcatataatcccaaatccatttctagcagatcaacaaaatgaaagagcaacacaaattccgattcccaggtaacatgactaagacttttcattatcagcacgcccacatcatcgcggcagagattcaccaggcgatcataaaaataaaatattcaaaataaccagccaatttacaacaggaaagaaaatatccacacgatcatcctctaccagaagagggcttcgatcgcaatctcgtattgagataaaagcaaagtttagaatcactggcaaatgacaatgcaaacaggcataattcctatgcagcagtgcaccatatttctacaacagcagcaaaagacatagcatgattatagaaggcctcacctatcatcagacatttccatcacatcagaaaaccaaagctgtatccaaacagaagtaaagcagaatagcatggtagaactggtaagcttgtgaattctgaattgataagagcaattcgaatcggccttagcaccaaacaactcaagtagctctcacatcagaccttgataaagtgcacacaggcacgcagttggcttaacagaattctagccatgtactgaagacttaacctaacccaaaacataggtagtatatactacttaactaggttaatgaccagggtgatgatctgctaatgataactaggaaaaatgccatttgcggagccgttcacaggtgtcccagcacattctgcaaaaacagcttcacttcctgtggactcatctgatgatcttgcagcatccttttgtggcattcatccttaagatcttccatgtcgagtgcaatcgcagcctgtacagagaaatcagattagaaacatataaacatctgtctgaactctgaacagagaaatcaggcagcctactatagtatatctaggacaagtttcaaaagtggaagtactttagtcactatatatcttacataatactactatatcttacaaaagaaatcaagctgctaattgtttgttttattcccaagatctcagccaaaatttgggccgttggttctagatccaacgggttctgtgcatcttctacctctagaacactgaactctctctctcccctcacctatcgattagctgcgcaactgcgtgtctgcgccttccccgtctccaccggcgcagcccgccgcctactcggtttccctcgccgtcgccgtcgccgtcgtcgaccccttccaccgccaagccgcgagattccgatcaacgggagaaagagagggagaggaaggtagaggttgaagacgaagtacacacaaaatcgcaacgcaaaaccacacagtcggaaaaatccctaacaattgcaagatgcctccattcccggcgaggagaggagaggagcgaggggcgcttacccttgtgaggtggccgagggtgtccaggtcgtggacgggctgcagga

SEQ ID NO: 72412 - DNA, 6343 bp, Oryza sativa
ccgccagtcgccccgcgctgctcttctcccggggtcgccgtgaagaagatggggaagagagatggagagaggaagaaagaattggtcgttcacatgtggggcccacatggtcccatgctgactcagatgcaagtcaatacggggtataaatactgtcttagacctctggtaatccggttttgtttctggtaatgtggttcagggataaaattaaactcggcgacaaattgaggaacttattattacgcagttcaagctacatgggccgtagaagaaaattctctgagaaaatgaaggcccacaaggcccaatactacctaaagggcctaaaacccctcgagctctctcatctcttctcctcactccgcggccgcagcgaacccttccctcctctctcgccgccgccgccgatccccacctggaagcagcgagccgccgcctcctccccaattcctctccagaatggccggggcgaggagcctgctcctgaggcacctccgcgtggcggtggccccttcctcctcctcaccggcggcgtccctcaggcccgtggtggcgctgcgcgaggccctgtgtgcccggcggtggatgtcgtcggaggaggccaaggggtcgttcctggacaaggccgaggtcaccgagcgcatcgtcaaggtcgtcaggaacttccagaagatcgacgaccccgccaaggtatcactggccgcagcataccgttcttcccccctcccttttttctttcttacttgtcgaatcgaatcgaatcgagaagtgaattggttctcgatttagcttgaattgatcccgtgggatagcatttcgatgttgcctggcgagtagtcctgcagatctggatgcattccgcagtttaggttgacgctctagcctgtggcaatgctgtcggcacgtgtacatgctctttagtggccttgttgaaaccactcttgagtttggtcgaggagttgcgggggattgtgatttgtgagtatcatctgtgctcagttggatgttaattttagcaagttatgcgtatatctgtgatcacattgaggcatacagtaggtgataaaaaccccgtttccttatttttactggaagtttggttaaaaacatagtctgtagcagattggtagaaccacctgagtaggtaaagagtcacagggggactgtgagcaacatcttctgtgttcagttggatgttgtaatcttagtaagttatgccatttccatgcgtatctgtatgacagcatcgaggcttgcattaggtgataaatccttggttctttagcgcataagcctatcatcatcagtagaacaaaggttgtggtggttgaggttgtgatttccacttttcgagctctacacttcgttggaaacaaaatgtaggcagttccacacttgtgtaatcctttacttttctcttctgtcccagaagccatcactctagttcatgtaaaatttggatagagtcctagagtatgacgacaaagtatggttgagcaaactgcatggggtttggtctgtttctgttactcatgtgctcatggaacctactacaagtaaccaatacttgggttgccacagtagccagcaggtaaattgaagacccaacattcactcaattttgagaattgtttggtggattcatcatttatgttagcttttttagaactaatgttagtttaaaaacatgtgcctggcaaatccatagaaagtatgtaggctgcctcaagtgaatctattaaagcaaagaaaaaaaacattctgaagttattgtcatgtttcggttgttcaacaacaaaaatgttttatgcataataattatggaaaatcatcaataatctgtgagaacatgaaattattcatattagctctaactctagttctgtcaaatatctggtttcaaaaggttgcttgggttcatttaaggttttcctgttgcagctaaatagctagtagtcatcttgattctgttccttggacacatttctgtgcacttagttacaaccattataaatgaattctttttgctgcatatttgttttgaagatttaaatactttgggttccccattgatgtgctttaatgctggtttgctgtgattgcaccttgataatctgcagcattttatctgtcgtgttttgatgcctggaatttgcatacggtgccttttgttttgctccaggattgagttgctttagttcatgatacttaagatggatcctttccttacggatactttttaaatatcccagatttgcatggcaccaattagttcacgctaaattcttagtcaatttcttactacgtcctacaggtcacaccagatgcacatttcaagaatgatcttggtctagacagtttggacgcagtggaggttgtcatggctttggaagaggaatttggttttgagatacctgacaatgaagctgacaagatcgactccattaaagttgcagttgatttcattgcttcacacccccaagcaaaatgagcaaatcaattgtgttatactcgttaattttctatgttttgttgtcacggagcctgtctaaggtggaagtcatctgctgtccgcatgatgtccacttttgcaatcagcattgtaccaatgctaccgttctgaatattttcttctgcctgtgggttttctggaccaaataatacttgattctgaggcggcagcccgccatcttgtatggagatttcgctggatatcaaaggtttagtttcatgccaagagtctcactgattctgtctttttccattttcttagattttggtgatatgattacatggctttgcacataattcccaaactgcatgcttggtgcaatcctgaaccgtggattggtgtttaccactgaaggataaatatgttttgataactgtagcatgcatgtctatgtagaatgcacaaatcacaagctgaagagcagttggtatggactggaacagcaacaagattgaatcttgccacaacttcagcaatcgagttaaaacatacttcctccgttttacaatgtaagtcattctagcattatgtctagattcattagcatcaatatgaatgtgggaaatgctagaatgacttacattgtgaaacggagggagtatatatatatttttacaggaaatacctcacggcccagcttatattgaaagccacaaacgagttaaaacaatttcgactgtgaccttttagtctagaacataaattacttcactgcactctacagctacacgctaacaccaatgatatggtgcgcataaatgtccgtgcatgtagttgtagtgtgtgatcactgcaggctggtgcatgagtgcgtcatgtccatgccctaatgagtccattcctgtggtagagcgagctctgggcacgggctggtggttgccgctggagcaccggcgagctgctgcatgtttgccgccattgctcgcgtgagctcttgctgcctcctcgccatggtcgtcgccgcagccgctgcctcgttgcctcgccggtgcctttgtgcccgacactgcctcggtggaacattggtagtaggggggcctcgccgcagccgccgtcatgtggtggttcgcgtggcgggggtcggcggccgtggtgcgcggcaagaagaagcctgtgccgctgctgcgccgcgtcgtcaccggcggagctgctccggtgacggcgccgccacggagtagcgggtgtgggtggttcatcgccggtggcggcgctgggcgcagaaccatggtgttccttgggccacccgtcatgacatgccacggcgcggccggcgctggcaatggcagtcgactattcccaacaagtcgcagttgcagcggcggcgtggcggccacccttggacggccggcgcccgcgagggcgtgatggtccctaagcatttcaccaccatccccgcccgtcacctgtggtcgatggtgacaagagaagagagggcgctgggcctggcgaggtcgatcctcgacgatggcgaggcggcggcgctcgtcggcatctgcgatcccgatgtccctgaggacctccgacggcagccaccggtggacgtcatccatctcgtgcatgtaaacgcagcagcggtcggccattgccggcaaagctagcttgagcttgagcttgaggaagccgatgagtcgacgctggatcgggctagacgaagcttgtgcttcttgttggttgcaactacgtaggagaggtgaggaggaagaagagatgctttgaggtgtggagaatgatgggggtcaaaggagtttatatagagaggtgagagctggactaaagaggaaggagataaatagacatgctccaaataaacatgtttttttgttggctatttttttcttcgtacctagctagatttttttgctattttttcttgatggtttttaatgtgtttttggtgttgagaatgccatttacatgcacgtattgttgtctgaaaagaagcacacttgaaaatgagctagctgaactgaaagttgctataattagatttttactgcatggtaatttcttttttttttttttagtttcagatctctagacatgagggggaaaaaagaaatcgaccggttggtgtgctctgggctattgttgtggcaaaatggctgattgttcatcttgggaagtgaagtaattaaggagaaatttcaatacatatacatatttaatgttttatttttctattcttaaagtcgaaaacgagagtctcctaccgcaatatatacatacaatagaacaatatagaaggaaaagttacagttacaaagcaaataaagaaacaattttaaattattggatccaaacccagataaagtaaggttttaagactggattgtacttccagtcatattttaatgccaaagttttactttcgatcactcttagtccaatcactagataactttatatttgttactctgttccacccctggtctcttctctagctatatctatccacttatcctcaaatgtatgtcttgcctataggtgaggggagatcgctagggcgaaaccgatacgctcgggattgttgatataaatgaaaagattggataaagtgtagtctaaagtaaaactttgataataaaaaatgactcaaattgtaatttaccctttttaaaagtgttttagaaaaaaaactctaccgctagtgtgtttcatcttcatgtattgggaagtcctagcgttttcctctcttcatatttccgggataactacatatgattccttttatggttgtcttgttgctagagctatcttctcgtacaagcgcttagtaaaagttgtaacggcaccgttgcatccatattgtcaggtggagaaaagcaaaagtaccaagtctcgtagtttagatcgactctttttaaactcgtaaccataacaagtcaagtcaagttgggattatatgtggcttgactaggagcataatatgcttgaactttcatgaaggtgctcttcgttttggaaacaaaagtagactaatactacgataatcaatctactcgatgaaatgagaagtgtcaatacacttacatactccctccattcttctttacatgatatcgtaaaactagtgccatacttcatgaactaatataaacagttaatatatatatcacataattttaaaaaatgtatagcacacaattctaagaaaatgtattgcacgattagttcattatcaatgtggtatgagtgtggctcgagtctaataatgggaaatgtttgattgaaaatgtcaatctacaaaatattttcacaatcatgccagtaaaaatgttcccaccataacttaaaaccagttttggaaacaaaacctttgatggctggcttctcactggaataattagtaacaggttaattttacattcatacttagcttagttatcttcaggaaacatatacctctcatcttgtgtggcaggctagcagcaaacatagttttgattaaaaaaggaacttagtttttgattggtgaacacgtgtgcatcttttggaacaagattttcaatagtgctaaaagttcaaagcctcttatggtgagaatatatagggccaacgggtacctagacgtctatagtgcaaccacatgatccaagggttgaaaaatttgcagaaagtggaactagcagaatatttgctaagtaacgttaattgctccatcaacttagaattatttagtagaaacaataaaaccgtcacacttattacgcctttaggtggaaccccaattatataaggtagtgcaattaccgttacttgatagaaaatttggtaagtaataggaaatggtccatcaaattaaaattatttaagtaaaaataatggggg

SEQ ID NO: 72413 - DNA, 1079 bp, Oryza sativa
tcagtacgcacatcttctgaagaatagcgagccagacgattgaactcatgaagatactctgccacggtacgatccttttgctccaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaagatttgtccttaaggtttgaccatttggcttatcctacagtcaagatggctctgataccaacttgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaat

SEQ ID NO: 72414 - DNA, 4009 bp, Oryza sativa
ggagagatatttccagcacacgcaaaacgagacaactcactaccacatgattaattaagtattaactattataaaattgaaaaaaatagatttatttaatttattaaacaacttctatatagaaacttttgtcaataacgcacaatttaacggtttagaaagcatgctaacggaaaacgaggaagttaaagtttggagttgagaaaaagaaccgagccttattaccactccctctcaacatagacttgtttagtcaaaataaataaaaccgacatacttattacgcttttcggtgaaaccgcacttccgtgaatacgatatcatgaccaaccattccctacattttatgactagagcaacataacatcattagtacatatgattaattcgacgagatatgtaaaacccaagctgatggtatcaactctcccacaactcagtaaacccattctcgagggagggcgagcttgccgcatgcttgaggcagaacggtgttcgaattcaccgtccacggacgccaattctcatcatggctgcctcctcctcgtattgctgacgctcttgacatggacgaggtggccgcttcacgctggccaaccctgacatccccatggccacattggtggatcgcccggttatcgtatgccttggctcttgcagcaagaaaactccgttgcatccggcatcactccacttaatttgcaagatggggtgtctgcagggtgccagcggcgctagcactggttgtggtgaccgcatcaccggagcaaaacctcggcggtgcaacaagcacaccagattttcatcgtttctcatgaactgccacactttcatcggtggtggggcacaaaatttttgaccatatgagttggccgacctaaccagagaggggtgggagcaagaaggacaatggtgagacgtgcggcgaggtcctcgacgatggcgaggttgtgcccctcagctgcacgtttgtcgaaaatgctgatgtccctaaggatctccaacggcagccactggtggacatcgtggaccattgctttctacgcttctttggaggaagagaggctttgaggtgtggagaatggagggatcattggatgagtttatacagagaggtgatgaatgggctatatatagaggaaaaggcgagtaatagacacgtttttttaatcttatcaaaagaacatattcttactgattttcaccttaatttcaaggtgtttgccttatttacttgatgacttttatgtttttttagtgatgagaattaatgtgtcccacatggagtcttaaaaagaaatttgcattatctggagagatgatgtgattcaggcaaagataacttgggtggtgtgctctctctgcttgtgtcaaaattaatgaatttttcctcgcaaagaaaagaaattaatgaattttcatcactgtatattttacctttaaactataactgagcaattgattggcaaaaaaaatacaataaatgatgacaggcaatgcattaattagatgtacttgctggtgcaataagggtcagtactacgtattccatccattcatcttgacgtcattaaagcttaaacccagttcaaagtaatttatcaaacaaaaatgttaatttgaacttttcaaaacattgcaattccacacagtttaatgtggatcatggaatgatcgcgcacatgatgctcttaggtgactttcctcttgctcctcttctctctttaattatttcattcgaggagttactaacttatggtttctatccaagtaactaattaatgcaaatagtatttattcacctctactgttaaaagatagagttctgttcatgtcatcccctcgaccaccatacccaatgtatcacatggaaactgctctgaccaaaaatagaccgacacaaatgaaaaccgcccaacctagaaaaaatgaaccacacttaaatggggtccaacgagccatcgctcctcatcatccccgaaatgccactcacacttgccactgcctgctgcatcctctgcacattggccttctcccatgccacggtaggagattgtgctcatgtagttcagtggttgcagtgaattgaatagcaccctaaggtattgagtttaaattttcatagaattaaatttctgaattgttttaggagctaattttttaatttaaaaaggttgcatatgtccagttgaatgtagaggccaggtaaaaaatactcctctagaaaaacgaaattgttctcatgaccacagccatgaaacaaaagtggtcagcaccctcaagtatgaggcagacgaagcagacaagaagggcctgcaccttcttggtgaagaggaatagtctacccccaactctcatctccacatttctttctcggcctctccttatttggattataatccctcgccctactcctatgtgatgaaaacaactcaacatgatcggtttaaggtgtcagaaaatagatggataatcaatttccagttcattaaatcgtttgctttgcactttgcttgcaatatgtaaatccatttgaccagaacttagaagtggcataaacaattaacctcttcgacttatattaggcatgtagtaacaccctacgtcaggcgctcgacactctggagaaatatcggaaaccactcccccctcttctctctctcatctcattatgcacttgcttccccacagcaccattttatgtacaaatgaatgcatctttatatggttttttttcttaaattacttctctaatttatggtccggccatactattaaatttgttataattaaatagttacaacaagaatacacattccgatgaaaataatatttagctttttcaatagattttttaatattgcatctaattttacttaaatgtttcaactagtgctagttaatttgcacatgttacatgtattaattctttgaatgttttagttagtatttcagtttaatgtttcaaaagttagttttatacatgatataaaaatgtttcaacaatattaagtatttgcaaatatactgcatttttcatatgatttttttatgtctcactcgttgggactcaatgcttcatacaatgattgctagtattgcagtcaatatattcaaaatgttgcattttttttgaaacatttttattgagtaagctggaacatttaacgaagtggtgaaacaaatttttataaatggttaaacaacgttcaatttttcttatcaaaatataattctatgagatattattataaagatttaattacaatgagtataatggtcaaattggattattagcctcataggatggctgtttgaggtgaggcttttcagcgaaagcccatcgcctcgctgattaggctgagagctttcagccagatatacatggatatacaagagctaaaagctaggagctacaaccaccagtcgtagaaattcttcttcgaaccatttaagcaaaacaaaccaaccgatggattttctttggctgaattgaagaaggcaactttggctgatcagccaaaacatttaactttccgatgagaacctataaattagataattaatttagaagaaaatttcacttaaagacctaagaaatagcttaagataagcatataaaatgggcttaagccatatatgaatttatgcacatccatatagcgtcttgcgtgtgttagatagccaaccagagaaaaagattagagggagtaccgccagcatcagggaatgaagcacccgattttttatttttatttaaaaaatcagacgcctgatttgtagttacttccttaagcatgttttgtagttacttccttaagcatggctggttctgttttgcaatcacatgataccaattgccaaaccaaaatttcgcaacattcaaatctatgctgaccataaaatataacaattagcaatttagcatagggattagcatagacgttcataaatggtcgaaaatgtttccaatttggaagcacagcagctttcctgctatgttctcttt

SEQ ID NO: 72415 - DNA, 1287 bp, Oryza sativa
agaagcaaagatgacaatttcataaaaaaaaattgttgcaagtctaattaaacctacgcattagtactcttcctctaaatgcacaggttatagagatgagttataattcaagtcaaactcgagctaaccaatatagcctaacaccaaactcatatataggagtacatgctcctgtatatggtatagaggtctgtcaactgagtttaacatggacaatttatcaaattcaagcagtgaaaattatagccccacaaatttgaacttttacgctctacttagcttaaaattgaaattcaagattgtgtactgtgtatttaaattaatgtctcaatgactttgtgtgcatttgtgatagacagcaatcattcgggaaactgcagattgttctgactattttctactatggaaatagctaactcattgcttggaggcatttcttgtgttcacctttttgcttgatgtgttatcatgttctgcagcccctgaagtttgatcatccaagtcttcaagcatcaaatctccttctttgtcaaccttgatgccctttgtacgcctcttttttagtcggtcctttgcctaaaagggtaaatagaaatgaaaaacattgtcacccgacttttttccattgaaattaaataaaacatgttgacattccatgccatactcaatatttcattataacgaaaactcaacggacattctattaagaaaccaattcaaacaacctcatcttttgccatattactgcagcaattttaattcaaggtttgttgttctacagcatgtaaaacctaataacatgtaataagatgacatgtgtaacaattgttatagtacaataccaacaagaaaaaaagttggtcgccaaactcttccataaaccaatgaaaggtttccaaatgctttcatgatgatacgttttctaatgcaaaccataaaatgaactaggcaaaatctcaaaaacaaacaggagaaataagcttcgtacttttttgaggttgttttcttaagtttttcaataatacactacataaactccttgataattggcagaaccagaaatcaaccaatcatgaatcaagtcttaactcaataaaagtagtaaggtttttgcactgaatctaataaggggtgggccctatggttggtttattgtcccaatggggatagattttcccaatcatcttgagaacattaataacacggtgatttgcaactattcaaagagtttgaatagcatatgccaaacaggtgttactaaatggggaaaaaatgaacaaaagcatg

SEQ ID NO: 72416 - DNA, 713 bp, Oryza sativa
ttgggagcagtaaaacatttgtaataattaatcaatattaaacatcccactgtccaacgctacaccatgttgcaacaggcccaaccatccacctatactattcaattccattagactagactagggtgaaactaatcacggtgaatctggttgaccgcccacaaccgcgggcacggctattcgaatagttttactctgatcagaggtatacaactgtacccacaagacacagccccacgacacgtttccgtgcgccgacatgccaccagacataccggaaagaggccgtgacaggacccttcgcataaccccctctaaccaagcacaccacacctcaggtttcacccccactccttgcaaggcagcgggcagtcccctctcgtgccttggtgaatccggaagccgtataggccatcgcagggcccatccaaactccatcacgcccacccttgcctggatgcgtcaactagaggaaagctatactacaagcccagccgttgcccacgctggcttgtggtaagtacgaggaattcttccagggtttcccgcgaaccggtccttaattgccatgggtgcgactagcaaaaccatgcacccatagcccaccatttaacaaattttaatgaagcgacaccaggacggtggctctaatccaacatcaacactaaaacctgaagtctatacattaaatataattttccccattctgtgct

SEQ ID NO: 72417 - DNA, 24565 bp, Oryza sativa
cgaaccaaatactcctactccgcgaccttcattctctttcctgcaaaagttcagtatcgttggttttaccaatgaactaaacaaagctcgttaggttaaagttaggtttacctttggggacagtaatcctgaccagctgtagaccccgtgagaaataacacagagacgtgcgaagagctgtgaccgcgttgccggctcagctccacagctgtaaggccagcacacaccgtaggaccggcacgtggcggccagccacgacaggataagccgatagactgccccggtgccgtggcgtccaggcttaagccccaaccaaaatctgccacgtaacgtggaagctcacgtgggcagccagcactgcagggcccaggcggcggcgccttgccgaccttgccaaagctgagagctccccgcgcctcgccgccgtcgccaaccggcggctttgaattgaggccccagcaacgttcaaacgtgtatccataccaaccgcagccgagcatctgtggtagtatatgcccgtggcatgtcgggaacgcaaatatcgcccagcgcctaacatactagtactaccaaccaaacattatctgatctgatcctgatcctgatccaatctaatctcacatggcgcactaccgttctcgtcatgcagatccagggaggacgcagacggattagcagaagatcagaagaatacgattttcttttatatagggtattttgtagtagttgtagctctaacttgtgcagttgtgcaactcctacaagtagatcggtacggattatgtgtaagacagcaacaaaacagattagccgtcaacgtagccagccaagctctttaaaaagcattaattaaaaccactaccaacagtcaaaccccccaaataaacggaggcgcgcttctactgcccgtgaggcacaacagatcgttacgatttcgaaccatctccatgtcgcatgtcgctgacgacggcagctggccctttttactgcagtcacgggtgagcgaacggccgaagcgacactggcgactgggccgtcccccaccggttgccccgccacgccgaagcatcgcgtgcagacgcagacacagtcaccacgtagtcaaacacatgcccactcgaggtgatatttttccctctgcgttgcacttgtgtgtggcgtacacgtactactaccggatacagtacagtcgtagcgaacgtggctgagttatgggcgtacacgtgggtgtcgcgaggcggagccgcggttgcagtgggaacttgggtctcctccaacctcgtatggtcgacacgtcacggtcggcagcgagggttgacgtgaaggggattgcgggggggactgacgcgtggatggtgactcccggtccccggcacgtgccgctccggcgggtcagtccatccatctggctcactcgtcgctctgtccacgtcggtcggttccaccacctgggtcagtctttttttcgtttttttgactcgtcgctggcttctaaaaagtgtagctaaatttaaatttcaaaaatatttcttttttttgttacgagtactcctactcctatcatttcgtttcacccttagggtgtgttttgttcacgccacaattagaagtttggttgaaattgaaacgatgtgatggaaaagttgaaagttcatgtgtgtagaaaagttctgatgtgatgaaaaagttaaaaatttggagaaaaaatttaaaactaaacaaggccttatcttcgaaactgttgaaaacgaaaacgcagtaatataaggtatgaatgaggtattggcctgttcgactgctagcaacagtatcggcgatacggtatcgcgcacacgcgacgcaaacacagctgcccatctgctgaacaagcttatttatgtgaaaaaaattgctccaataaaaattgatgttttaaagagacgagttaggataagcactcaacatgaaataagattaatactattcgcacacatgggtgcagccagtaatgaagtctactctctttaataaaaaaatataacttaatggaggacaatccaaatttattgttttatgtctcatttctaattaagatgattttcttttatggaggaactctatctatgtgaagctaggcattcaacgtataatcacctgcgcgtgtatgtgcgcgtgagcacaaaagtggtgtgtttactcagttaaaagaaacttacatctataaatacattttagtctacacaagagtataaaagtggtatgtctaaattcgtagaaatagataattgcttatttgaccctgttttaaagcataattatcaatttgaccctacttgtttttagtttacttatttggacctgtttttcaaaatggaatgaactatttgaccatgttccgttaaggcgggttaacacggttaaataggggccaatagtccattttacccttacttatttgacactgttatatcaaaatatacatatatttggaccttttaacaaatctaaatcaatttgacaaatttaatagacagtagctagagctcggaggttgatgctgggtgccgctgtggaccaccctttgcacgccgccaccactccaccgcacgacagcacgcgcggacgtccctacacgcaccgcacggtggcgccgacctccatctgcacgccgccgcccccgaagccgtgcgccggcgccgcgcgatggcgccggcgccgacttccctcagcacaccgccgccgccgaagcggtgcaccgctgccgacctccctacgcatgccactgtgatggcgccactgccgacctcccaacgcgcgtcgcgtgacggcgtcgccaccactcctccctccggtcctccgccagccaccgtcgcctgcctcaccgtgcgccgccgccagtgctccctcccttcccacagaaccgccgcctccccatcaaagtccgccaccgctacaccgccttcgctgaccgccagagctagatccgtcgtgcgcgtgcctcggcaccactggatccgtcgcctcatcgccgagtacaaaagtggtctgttcaaattcgtagtactataagactggctgcgttcgttcattggagataggggagattgtcactcgttttccgcgcgcacgcttttcaaactactaaacggtgtgttttttacaaaaattttctatagaaaagttgctttaaaaaatcatattaatccatttttgatgtttaaaatagttaatactcaattaattatgagctaatggctcacctcgttttgcgtatcttcccaatcctctctccctcgaacacaccctaatgttttattcggttgtatgttcttatattttagaatcgagaaagtaattaactggaatagttatttagggcttgttagtcagggatggaaacagttaaaatgggaacattaattataaatgtgggccatgaatggatcacggacagtagccacgcgttgatcctatccaatagcgtagcacggccgggggaacggtggtccccagcaaaaggagtacgagaagaaaagaatggagggacggcatggcaggcacagtgcaagattgtggggcgccgccacattatcctctctctcccccggcccgtatttcgtgccgcgtaagccaaccgggtgcgtgcccctggcccccactcgcaacatggcttttgctacagctatagagtagttgtactccagtgggccatgcctccatttataactccattggccgcccgtacggatttgctaccaacttgtggaatcaacaacgatatcgttaacccatacccgtaatagcttcgttagtttagtgatcatcgtcacattttctatacttagttaagtttagttaagtatacgggtttttttagttaagtatacgggtttagaaatgaaaattaaagttcgttactcggatacgcttacatcgttttttaatatatagtcgcaataagtgaaaccaaggtaatcttttagcttgttaatgttagcataagagatcactattttttttatataggccttgtttagtttcacactttcaactttttcatcacatcaaaactgtcctacacacgtaaacttttaacttttccatcacatcgttccaatttcaaccaaacttctaattttagtgtaaactaaacacacccatacttaatattttttaacttagaacttaatcttttaagtattttagctaatatttaattaattatgtactaatttaacgttctttttttctgcacgaaggattaggtggtgtttggattcagggacttaactttagtgtctatatttatacactaatttatagtattaaatatagactacttacaaaactaattacatatatgaaagctaattcgcgagacaaattatttaagccaaattaaatccataattaaagaatatttactgtaacatcacataggctaattatgaattaattaggctcaatagattcgtctcgcgaattagttcaagatcatggatgggttttattaatagtctacatttaatatttataattagtgtccaaacatcttatgtgataaggataaaaagttttagtcccatctaaatatggttttagttccaacccacgtaaaagaatacagcctaataaagtaatagtgctaacttagtagtattatcttcttctctttttttgcccagctactagttgctgctagactactgctgctgtgctgtacaagcttgacaggatcatgaagagaaggttagaatgtactaagaaggtgaggtgttattccaagtcttgatcagaaagtaaagcacgcgatctgcaaaaaggggaaatcctcggacgggataacataatcaaagcaatgtgcacagtgacttttcgcgcgaaaaaaaaacatatattagtacgtactgatcctgcatctggtcctggtgatggaattaggtatgggaaagagataaataatataatgggcgaacagtattataagggtggacccggcgctatcaagaacgtgaaggcagtgttttaggatataataaaccaaccaaatcttgacgtactggtagatcattaaagagatggtcctccacgcggccaattcattaagaaatcgataattaaagaagggattaccactacgctagcagtagcagtagtagtagtagcaggtaggagtaattgttatccggataaggttactgcagctggagctagcattatggtacttagtttgtttaggttaatcctcttctgcgcccgcactcagatcggaaaactgcaaattgctgtaatgctgaagctgtcatatgctgtgtctatgtggcccttttcatttgacccgtcttttagcaattttcacacgagaaattccgacgttttcacgctgctagtcgtgtgctcgtgccgggaaacagccaggcgcgcgccgcacagatcaacatcgtgtgctgcacgccgcgggatcggggcacaccagtgaaaatcaccaccgccagagtcaaccaaaacgtacgcgtcgtatgcgcgcgattcgtcgacgcgtctcgtcggagcaggcagcctctcgctgtcgcccgcgtcgcgctcgtcgatctcgatccgttgctaaactcgaacgggaatgcgagctaattacggggtttagcatgtgtaataaggtgcggtgattcgatcgatcggcatcctcgtgcatgcgagccgtacgtaccggcctaccggggggatcgaaaaaaatcgtgtgggtctctagggtcccaagtgtaatcgcttccatgatttttttggtgaggatgatgtatgatgttgacgagcaactcagaaaactactatctcctcaccatcaccacttttatcctctccaaaaaaagagtacgaagtagatttcatcagatggacacttggacggatggtggtgctacgatcacgatagatctcttggggccccttcccaactgtaccagattgcttaaaaaggatggcactccatgtctcacctgaaaggctgatgactcggagctatttccagacgtgctagaaggtgaggtgtcgtccaacgacaccaccacgcaacaatgctcgtcagaaatatatcgtgcgatttctgctgctgctgctgtgtgcgatgcgaacatttcgctggagaaaaagaccagcgcactcgactcgaccaccatgcatgcgctgcgctgcgctgcgctgccatgtgtgcgcctcggctcggcgacagcgcacggcgcgtatgcgattcttgccttggactccatgccattgcagcgccgtgccatgtcgcgccgtggccaggccgccgcgccgcgccgcgcccaagtctttgactcgcgggacgcgccgcgcgcgcgcttttctgcgccggaatgcttgaaattttcgaccgatcggggccctcgttctcccgacatctccgcgccgacactgcccggtaatccgcttgcgttccggtcaactcgtcgcattgctcgcgatggatttcgtcgcggtgcgtacactggttgcattgcatggccacttggccagcaacggcgacgtcgtcgtactcgccgttttttcactcatgtcgttcgaccacaacacaaccactacacacgactacacgagtcgcgactcgcgagtgagtacactacactgcacacgaaaggaacatgacgtagccgtagtatcgcccggtggtcgagatgtcgaatgattggtcgcatccaacgatcggagataagaatatcgtatgctactcgatcgtctgtactactgctattatcgcaaaggctaaaagggggattagctagctagcgacatactcacattggggataatgatgctgtggctatagtgcggcagctgctgctgggatgacaggatgagggcagtgggtacaggtgttgcttttgctttctctgcagatcttcttcaatccatcgcgagatctttgccgtgattgtatgggtttgaccctggcgaatttcggttggcaattgcttagacagttcgatcaggatcaattcccttttcatttcggcgacgtcgtcgttgtggatcagatcaaagagtaggttatggtataaaaacagtacggattcattggaccatcctatacttgattagcatgttcaaatcctttactccaggaatgtttggcagcattccggctcagcatgtttcaggccaccaatgccatcgaaacatgggtacttttttgcacagaatacgccatgttatccggggtatagggcttcggtttgttgatggcgatcttatctcttcccgttttgtggcgaactaattgcgaattatatattgcacgcgcgagaccgtaccgaattagaagtccattaagaaaataaccgaagaaatgaagttgttggaacgtaggagtaaatctactttaattcatatctgcaaatcttgctccagaggcaactaccagcacatttctgtgcctaatccataacaatattaaattactggcacacacgtatgcactactaccattgtagacttggtagtagttgttggcaccactactacctttcgttgctgatctgggtcatgaccattctgcccctgagaatgctatacattcacaaagtcaacaggtcatttgtaagtgtacccgtatatattggtcagctcctgtggtctccgttaatatcggctcgttttggcatgactttatcgaataaattaaatcaggtcaaaccaataatcgagtttgctcgaacaaaataggtgtgtgtgtgtgtgtatatgcaggatgcttaggagacaggtgctgggatgcaggctctccttgcatggtctaattggtatttccatgtcgtgcagaaataattgggaggagatcgtacggctccttgcataattgcattgtatattatattgggtactgtactaatttcttcatctagatatataactagatttagcatcgaccaatgaaacggagtaactggactgcacgcaatagctagctactccagcttgtagtttggtcacacaagctaggtgaggaccagggacaaaaggaagcagagagaggacactgcatgcgtgtcttgtgtcgtgcataatttggggttaaacatgcgttcctgctgctatcaatatgcacgaatccaaggcaaaccaaaacagtagcaaccgataactaactccgaccttaaattaccacggcaatttgtcacgaaccaacacaatcacaccaaatctctcacataaatgccaccgatatattacaatccactcaagaatataagtgtttagggatacaaaattgaggagaaagagaggtatagtttgagaagagagatcagacaagaggaagcaggagattgggactagagagtaggaattgagaggggaagcagcagcaaggaggaggaagaagctatcgtctgaggcgttctggtaattgattcatcgatgaccctggctgctggctgctggctgctttgcctcttttctagtctccttctccctagccgaatgggcccaaagccagcccacttgtctagcctcctggaaagacatcacagcaggccatgtacatgacattcttcccccgttaagaatcggcttgtccccaagccgatgcaactgactcgccagattaatgcccccaagatcccaaggtacctgcagggaaatgccttgttgggcagaatcccagaacaattgtttgatgaccttcgaaccatctgatgtagaccctgcccactgttgatccacttatccaacatacataaaacctgagcattacaaccacactctctaccatgcttttgctgcctcaaccaccaagccttcacgccttcttcaccactactatcagcatatactccatgagagcccagatgtaacatgcaaatattgagatcagtgggctgagaaacatgcatatgcttctttgtctgaatgagagctacttctttgtttgcaaactcccaaattgctaaaaattgtatggttttaccttgatcaccaaccaatcttgcatcaactaatttaaccactcgataggcccatgtgtgcaagactatgctgtcctcacaaactaaacaaatgaggcatctctctgaacatttaaccagttctattccacgagaattcttactgaaagtgctagcttccaaactgagatggactgcaccaagtttcagctgctccctttgtaacaatagctcatgtgtctgcccatgttaattattccattgaagaataagctcagatgtacatagcaactgttgtagcactgcccatattaaatcccaagaattggcaactgacagccataacaccttgtttgtatattctcttctaataactttcacatttgtccataacattagtttcccttcagatatacacttccaagaaaaattgagcccttgccctcctgctgcacacaaactgaatacctcactcctccattgcgaaggaggaggccaaggttgcaagttgaccaactttcttgttgaaaccctaaatgcctcaccattgtttgatccaaattgagtccaagaagtatcatctagtacatcattgttgttactctgaacctgaaatgaaattggaatagtatagaaccgagcatggcgatgggtacgtctctcatgtgacttgcaagtgcaattaccatcaacattagctccactgaacaaacaatcacaccatgcatcgggtgatagatgggaaatcagcatcagcagcaagaacaattcatgatccccatatgcccaaccataggttgaatgatgtgtgtgctgataggccttcctaaaggcaccagagagacatatctcataccaaatacaccatccaacaatcagattttgcagcaagccctcagtggaattaattgttctactcatgaattgggcaacgctgtagttcaaggagacttgatgagactcaccatataaattcagtgtttcaatttcagctcaaacacttgtttgaataagtggcggccagggttgtaagagttttaccaccacgcctccgctgccttgacaaagctgtggatcaagccatggtaacggccgagaacctgaggtcatctcagctttgttccgtggaattgctgctctccaaggtggtactggtggagggctagctgtgtattctgagctccggtcaaagcaaccatagagtacttccaatttcaatgaaacgaaagagaggccgacaactccaaagtagtcacggctcaagcaccaactccagttcctgggaggaattgcattgatgattaacaatggatctctgaagcataaatacatagtggtgaacttggtatctacttccatgagctccatccactcctccttggccatgtctttgccaccatcatcatcagccaactggttctcacacttcattgaacactcgatggttgttcccatgccaagcttggctgtgtcaacatggttagttgagccggcctctgtactgacctccaatgcgatggaagttggatcagtgttggcgctcaacgctgccacatctctagtggaatccttgctcaaggataaatccaccttggtgtggcgaaatgcctccagcatccgatcgatcttggtgcacaggtcttgaatggtcttgtctaagttctctaccgccttgtccatgtcagtctcagccttcttggtctcgttgaaaggaaccgatgtcaccatggctgctgatgtaattgagggtatagatgaagctgttgtagcagggaacacgcgttctggtgtagcagcagtactcttggccgctggcctggcggtggcgctacttggtaccattgtcaaacaggtggtgtgcgtggtggtggcgccatctccagggaacatctggacgtgctgcacatccattaagcagcccccgtcgtagatgtcgcgaccgtgggtggcggaccgagccctctccgcgtcatggctggacataaatgacacaagagccttgacttgccatgtgctcactgcaagaacctgcaccgccactgctccataggtattgtacacttgatgcaacacctcagatgtcactggatatatgatctggctcacggtgacgcgaaggacagcagctgaatcgcctcttggacaggtcgacatttcatcgaacaggtggtgggcatctcctccaaagacaccaccaccaagttgttggcagttcctctgaccaccagcgctctcccacttcatctccacaccagaaaccccacgaattgactgctctgataccatattgtcacgaaccaacacaatcacaccaaatctctcacataaatgccaccgatatattacaatctactcaagaatataagtgtttagggatacaaaattgaggagaaagagaggtatagtctaggaagagagatcagacaagaggaagcaggagattgggactagagaataggaattgagaggggaagcagcagcaaggaggaagaagctatcgtctgaggcgttctggtaattgattcatcgatgaccctggctgctggctgctttgcctcttttctagtctccttctccctagccgaatgggcccaaagccagcccacttgtctagcctcctggaaggacatcacagtagcccatgtacatgacacaattccgggctagtacgggaccaaaagcatggaaaaatcatgctttctccaacgaaaggataaggctcttggaaacagctactcgatcgtactcccatgaaacctatattcaaatacgtagtaatagaatacgtcacatccaatactatgttgttatattatggaacggaggtagtagtatcgatggtgtttttaagaacttctcccaaaaaaataataataataaatctctaaacagtttttctttttatttcattatgtaaaaaaatagttattgaattaaaaaaaaggtaattttatcatccttaaatttaccagaatgtatcacactttctaatgtaaaatttgataaaaattagtctaaactttaaatacatcgaaatactttttctaggatcataaaatttctcactaaaaaaaactaaaagctaaaagctggctttctcatcttcttcaaattgctaggagctaattaccgatcaataatttgccataatcttttgcggatctaaggagttgttggtacgaatatcgccgacgaggcgcgccaaagatcacccacacacacaacacgcacctcacctcacctgccctccgctgatcgaaattagagcaagcccagcagagcttccatccggacatccatcccatgtttggcgtatggaggtgaaaaaacacggtccagcagagtctccattacacacgccattttagatgtcctccaaaccaagccctctccatgccatatttggcgtttctctctcctcacgccattcccccaactgcccagctccgacgaactcgcgccaccatccgaactgtgccaaggggaatagagaggatggacataccgggtctgcagttggagatcgccggagtggaggccccgccgtccgcgccgccccactgctcccgccactgctcctccgccgcgcgccgccaccatccggactccgcctgcgccgcccccactgcaggcgccgctgctccttcgctcgtgctggagatcgccggagtggaggccccgccaccatccggcctccgcccgtgccgcccccactgcaaatcaaccggcgtcgctgcttcttcgcttgcgttgcccatcgcgactccgtccgtgtcgccgcgccaccctgccacctgcaccgctgtacctccgcccatggcgccctgcccccgtcggccgcgccatcctgccgcatcccctccgtcgctcctccgcccgcctctcactatctgttggtctcccaggagcgatggatttggtggattttgttttgttttgttttgtttttagcgagaggataaggtaaatgtggctgatgtggttttaaaagaggattaaaggtggtacacagtgttctcaaagtggtaactgcaattaaatcgaaccaacacctattcaaaccattgtaaatatatgcctcttaaaaaatcattagatatatatgggtagttaaaaaatattagtaaaatatagaatagtgtgatatgaatgctgtaatatggatgatttattggagtgggtaaaggtatagaggaggaatcttttttggatgaccattcaaatagaaatatagaagtccaaatttaaatgatctgctgggatgctcttaagcttcttctactagtcctctgttgcgtacgagcaggacgtccaaaggcttcgtcatttaatcgcgtctcgccttgcgcgatctccaatcgagctaatggtggataggtgatcgatgtgttggatattttctggtccggacacgcacactaaaccctatggttggtagcaaaacgcgctgcacggctgcactgcgtcgcgtcgcgtagcatcgcagtgccggtggttatgcttgtgcctttgtcgatggcgtttactagtacatggaaagttggaaacgggagttggttatcgatcatctcgccattattagcggtgatgacacttggctccatcaccatgattcacgattattcgtgtcatcgtgtgcgtgagggcaacagaaaaaaaaggagagaaagataggagtagtactagtagtacacgtgagtagctgttcgtggcatggatgaggtacggctttcaatagtggccggaggttgtggatttggagccttggaggacgtcctacaacggctacaggagtggagttcgtattattggagggcaatggaacgagatctcgacgacacgtcgatatggacacaccagcgcacagtgcatcgcactgccatttgagatgttgtgagtgcatccttttaaccgggagtccgggccattcgattgtctgcacgaggattactgtactgatgtgggccaggacactgctgccaatgtgggtacgtatgggcctctatggcccattaccatcatgtacttacatgatgtgggtcaggccactgctgccaccgtgggtgaatatgggcctccatggcccattaacatcaccagcaactgtatatggctcttactccactatttggtttctggactatgaactgaactaatcagcaatatgttgtgattcacgtcatgtcaagattcactgggcagaagttaaaatataaatggacggaagggaggaacaagtacaagcattcagataagaggatagacacatattgctttcaaatattcatatattctcactttcatagacatagggtgtgtttggttgcaagccacactttgccacacctaaggttaggcaaatttgacaggtgtttggttgtagccacagttgtgacaagattcccctccaacaaattaggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccataaaaacgcagattagttacaactccagtcccagaagagattaggtcttcacccagaacgctatcgtcaacatttacaaagagtacaccgaaacctagttacaactaacaagtattacaactccagcaatcttcacaaagagtactagtattatcaacatgcctgctacaccaaaatcaagtaacaaatgaaccaataggaacagcagtgaacctgtagattctcgcaccacgaaaggaacagcagtgagctacacaaaaaccagtagattctcccaccatgatacgcaaagcaaaataagactgtcagtgtaatcgtctattggctaaactgaaggagctgactttcatgggtgttgccaccaccagaggagcctcaggggagtcggttgttgcaaatttctcgtgcatgaaacggctgtcaacaatggattcgtctttcaggacaactttgtaacaatagcagctcttgagcccttcctgatcgcggtagcactcatggttgctgtccttcacctgctgaaagttccaaatgacactaaatttgccaactgtcgcaacaagatgcttttcttgcttcccattctctgttacctgggaaaatcagaacatatagaggaacatacataaggacatatacttaacaaattgaataattatgcagcatgtaggcattaatttagcaagaaagttaacatggcaaatgccaaatgccaaatggacataacagaactgcaggatgaaactttttataatgcacgattgacgtaagtgaaacaactgattgccactagaacaaaatcaacatgattgacgcaagtgaaacaactgatttactgcaattacttcatacactcttatgacaaggtcacaggttgatccgttaaaaacagagctagggcctaaggtgcagggttctttactttagttctactcattagccccttgacaagctgagaattggaacttcaagcaaccaaatgttccaaacaagcagtcaataagcttgtttttaatttaacaagcttatgtaaatattgaacatacttgctaccaatgaattaactgaaaacatatttattagccgtactaccctaaactgggatggatcataactttaccagtttctcccaaaaggtacagcatgattatttcaagatattaatgtgtcaattaacatacataggagatagagacatagagtgaacacattttcctggtcagattgtattataggcacagcaaattactgacaagcagccattttggatatgaaacgcttgcactgactgatcataagtgaaaacaaacttttactatagacaagatagataagtgtagatggtttgctagcatgcacatatgaagcaacattctgtttggctttactagattacaaaataggaacattcactaccgtgtgttctatctcaattatgaaaaacaatatgctgtacaaaataggaaattcacacttacccaagagaactgcccgccatggaatttgttctcggaccctgccaaaattgaatccaatggggagagcttcagcaatcttggtgctgcaatcctatttcccatacgcccactgaatcctgtcttctctttaccatccttgtccttaaagatggtacagatcaagatcaaatatgtatcagtagtgcccagaatccacttcccatcataagtaacatcaacatgtgtgattggtgatccaagccctgggaatgctgtcttcgccatccgcatcgaactcttggaatagagcctaatcttgccatccacagaaccaaccacaatcgaaccatcccctgtacttgcaaagcattggaaattggtgccccttgagaactgatggccctgcgaccattgcagcaccggtgactcagatgagctcccaattgtttgcaccctgcccctggaatccctcatatcccaccggcatagccggttgtcatccaatcctaagaaggttgatccagagggttccagctgcgcgcccttactgtcgttggcgatgtctcgcattgtgatgtcagttccatccttctcaaacctccactgagccacaaccttgccagtctctatatcaacatgatggacgccattggaatggcgagtgccagtctctccagggctcatcagaagcatattcgtctcgccacgcataagcagagccttctgcggtgtcatgtacgcgttcccaccaccacggccatcagatatcctcacagagacgcccttgccgtgcacgccatgccggaaattcttgaccacctgtatccctgaccctccaaccaagaagctgttgtcaagcgcgcccagcgcgaggctctggatgctgccgtccccggcctcctcctcgaactcctcgagcaggtctctcgccggggtcgcaacgggaggggtgaaggagtcctctgcgtcggcccagacggcgtcgtcggactcaccggggcgcgcccacgcggcgaagtcagcgccgaacacctccttccggccctcatccgtggcctcgacgccatacgtgttctcgaacaggcaccggtcgtactcctgccggaatcggcggaaggcggcgtcggtcggcagccgcagcgcccagacggagccgcccgcggcgaaatcggcccggcgctgcgcggggagcgccttgagctgtagcgccgggccgacgggggcggagaccctgggacccggaccaacctccagaacccacctcgggccgccacaatcgctgtcgcccgccgccgtcgccttgtcgacgaaggcgtaggtcgcccgccgctcggccggcacccagcgcgcggaggcggaggcgccgccgacgtggaggtacagcttcgccgcgttcggcgcctggtacttgagatcgagcgctttcagcttcgcgtcgaggaactcgagggaggagggggtagaggtccggaggatgtcctctcgagaggcggcggaggtggcggtctgggcgtcgtactcctcgtcgtcgtcctcgtcgtcggaggaggtgaggtcgaggtcctcgcggctgtgggcgccgcccatggcggttgcggtggtcgacgagaattccgatggatgcttctcgctgcgacacgggaggggggaatggagcggagatgaggggaaagtgagatcgcgggagaggggggtataagtacagaacgccacgtggccgcggtggcgccgtgatggtcggttggtgcgtgcgtgcgcccgacgcgacgcgcccggacgcggcggggacgacgaggtgagggcccacttggcagttgcttcgcccagggggtcaagagaaaagaaaagtaataagtctactttatctccctcgactcatgcgtctggttgaatcgcacccctcaaccgtaaaaccagaccgttgcaaatcgactccctcggtggtttcggaggcggttttctcttacctagcacttacgtgacgggttgacttggtctttatcctatgtgcatcgacgtggcgcttacgtagcactaaagtaaaaagaaacctaaatagaaaggaaaagaaattttgagcctacatgtcagttactcatctcctccctctttattctcgacgacgagcgagatgaagagagcggcgaggcggatggcgggagctcgccggagcgacgggacctcgccggaacggcgaggcagcgggagcggcggcggcgggacctcagtggagcgacaggagcagcaggacgtcggacatgagttgaaggaggcaaaatgaacttattccaaaagaaaaataggcaacctgttgggccgtgaagcccacggaaattcatggatagcatccgctaggcccatccgaggccacgcgtgaaaccagcggcccaatatatatcggctccgctcgaccaccacgctggccgcgtcactctcctccccctcgtatcgctcgggagcggaggtctcctcgcccctagagcgccgccgccaccgccaccgccgcggccgccgcggcggggacttgccggtgccaagtccacacgccatcgtcgctcgcacccttcccgcgcaggtaactccatgcaccttgaagtttcacctcatgcgttgagtgtccacgaccctcgatcccctccgctttcggaaccctagaaacccatctccactttgattccgtcggtttcgttgcttatgtggttcgatccgtcagccggttctagttgaggaaccgtaggaaagctcatctcgtgacgggatgtgatttttttttcttttttgggcggctctcgattagggctacttttggttgggctatttttggtttgtgcgcaagggtatgaaattggatgttgttagttctgtgttgctgtcctgtggagaatctgtgatgcttcactttaagcgatatatgttctttttaactcatactccctctggcccaaaataagtgcagttttagcactgttcatatccaacgattgaccgttcgtcttatttgaaaaaagattatgattagtatttttattgttattagatgataaaacatgaatagtactttatgtgtgactatttttttaaatattttttataaaattttcaaataagacggatggtcaaaacgccgagcacgcatatttatggctgcacttattttgggacggaggtagtactgattaaacctgaaaggtccgaggttgggttaaggattactgcaataggtaagaatctccaaagtcgatactgtggactattatggctgtttcatgttgtgtcgatcagcttcagatttctgacacctagctctttactactatgtggatgaaatgaattcagaactgcactcttagtaaaaagcttgaaaagcttcttgaattagcttgtagcaagtcatagtttatggtctgaaggtgtaacatttatcttttggtcctcttgcattcatgtagaaatatatttagggaagagctataattggttcctttcttacttcagggatttgttcacgatggcccgcttgtatgttggcaacttggatccccgagtgacttccggggaacttgaagatgagtttcgtgtgtttggagttctgcgaaggtcagtttctgcctaggcaatttttccacttcatctaattgggtgtttggtttttgcattgtgctgcattagtcttgtgtagtttttggatagactagttcattaattgtgtgccggaagggtaatagttcatcccagctgtgcataatgccataactgacttgtgcatattcatgcaactatattctgcttgcattataacatcagtcttatggtattttagtgacagaagttcattaatcgtgtaccaggaggaaaatagtgcatcccatgatagtcctacgtttggattgatgatatgtgttgttttaagtgtgacagaactctatgtccttttaccttttttttaataaaaaattcttagctaattggatggccatctattcctgactcaatatagtggtaccccttgtactataagttatttggacgttgcgggtatgtttgttgatgtaattttcaagtgtatttttccatgcagtgtctgggttgcccgtaaaccacctggttttgcatttatcgattttgatgacaagagggatgctgaggatgcactccgtgatttagatggtatgtaacggtgttttttctgcacactgtctgaagtttgtcagaaaattcttttgttctattttgatgaccttttatatgtcaaattagcaatacaggtagacttcttgtcctttttgctctttttgaatcaagctttgagttaggggtgggcattaaaaccgataaccgaagaccaaacccgaaaaaaccgaaaccgaacccgaaaagactgaactctcgggcatcggtcatttgttcgggtgtgacatctgaaagaccgaacaaacttcgaaagattcggtcatcgtgcaatactacccgaagaaaccgaggaccgaagaaaccaaatcaatacaatcactaagcagacaacgtgaccatcctatggaccaaaacagcccaacaacaaggtgaggcccaaatccacgtcaatgacccaatccccatgaccccaccattccattgaccgaagcactcctaaccctagttaggccacgcgccgccggcgcaccacttatctcgtcgcatcgcatgtccccttccttccacgccgccatcttctgcagtgctgccgcatgctgctgctcgccggcgtcgccgcagtgtcgcatgcaatcgtgtggtcacgtggaagccataaggaggccacaggctgctggcttgctgatcctgctgcacagccgcatgccggccgctgcgccatcgcgtgccgtctgcgtcgcgcggctgatttctgccgcgtcgtcgccttccgtcccgccagcacttgtcaccatgctagtggatatccgtcccatgtgactgaggtggagccatggaggttttcaggagcaagaagacgagaagattgaagaggacgcacgttctggttcgggcacctcggtttagaccgaagaccgaaccgaattttcggttaaccgaagtagcggttagtaatttttgcttaacaacttcggtttcctgtttccaaagaccgaatttttaaaagaccgaactaaccggaccgaaatttcggtctagaccgaatgcccacccctgctttgagtggccaggaaattttatctgtttgacaatgtctcttatctcgagttcttgaatttcttttatcctattgtattaaaatgcatcctgaccaatcatcttcataggttgtgcaagctttgtccctgtgtagttagaattaatttatgcattatcaggatttgttcaaatgcgtggttcctcttttaataggcaagaatggatggagagttgagctctcacggaactcaagtagccgcggaggtcgtgatcgacatggtgggtctgagatgaagtgctatgagtgtggtgaaactgggcactttgctcgtgaatgtcgtttgcgtattggtcctggaggtctgggtagtggaaagcgtcgtagcaggagtcgcagccgcagtcgcagccctcaataccgcaagagcccgacctatggtagaaggtaactttatagtgctcaatgttgtatataaatatagtagtatggttagtttggtgtcaactttattttccatgcccaatttttttttgatattttgtgttaaaggtggggacttacacatcaataactcttgtctcataatacgcttcgcgtgatccactttttacttgcagttaatccacttgttctattaaacacctactttgttgttgaatttattgtaatatatgatgtaaaagaaaggaactgagctaattattctgcgaacagaagctacagtcctcgtgatcgctctccaaggcgccgcagtgtttcaccagttcgtgggcgcagctacagcaggtcaccacgtggccgaggtggttctccttatgctgatgggtaaggcatattttgttaattttacaattctcgtcttgtatggctttataaatcatatattctttatcattcttatgcatgcctgcttttcaccttttttccagaagagatggtggcaggtaccgccgtagcaggagctagaccctgatgcctgtgcttgaccgtctgctctttggcttgcatgccatgaatgctttaagactggcatcaactgattgacttcaattaaggtttactactttatctgccttgatatttcagcctcttatttctgacgttaaaaaacttatgggatggatgtaatatgcaactaagacatattacctttctactatgtgctaaagagggatcattctgcttaagcgactcagccaactaccggctctgtctgcatggttttgttctgcactcttcattcctcgagcgtgttgcctgcttcatgtgaagttgcaagcaaaagagaatcttccattgtttcctgcctatgatgcctcgttgtggttggcactcttcgttgaagatgctgcatcgtcacaaattagtaacatatttcctctcataaaattgataacattttgagcaatactaactagtgattagtgcagctcgtgcaagtaaatagaccatttttttaatagaaccatgcatcaagagattgatacagcaaaataaatcttcatgtcagtcgttgggttaaaacatcgcattcatctgcagcctgtaattcagcgacaaaaggaatttgctgggttggcttccgcaagaggcagagactaccttttaagcggttccaccgactccaccccttggctttattctttctggtttttccttcactctgcgcatctgtcggccttcttcctgcactgcatcgccataatagtagcctctatatatgggaccttcagatgaaatattctcgttctgcattcttcctaccggcggccattagacaaaatatgttttttttttctttctgtttatgtggtttattacttttatttgtatctcaaccgttcagaacaagtggccagcacttcatgtctcaattgttgtgaattactcttttgacctagagctaataacagcctcagttcatatccatttcatatttatgtgctgtacgtcactcatctaatatatctgtactaagtatatgttgcttgtctggttctggaaccgtagagatccataccataaattagggtctgtttggggagcttatctgagaagcaactggttggtagccaatttctcagaatctgggaagctttgtttcccagtttctggtttctagtttattttctagattctataactatagcttctcagaatctggatcaaaaactagagaagctgtagcatcccctaccactagatgttgtgaaattcccatgttcggtgtgttccgtcctctctagtgattatatttttcctataacaaagttagctcaaaataagccaaagaaatgtttcctggaagagatttggatgtgagtttgctgttcctgagtcagttatggacgtatggtatagttaatcggagttcttgctgataactgtctgtgcttgcttccttttatttctttctttggtcaaatatgatattctgagatacctctcgcgtaaccaaatagatgtgttaacaatacaacacttgggatatttcctcaagaagaggtaaaccctggtcggatttttttcatatccattataatttcttgcacgggcacaccacacgatagcgcacgcccacatgttctctaccctggcctctatcacggctctaatcagagttgcttttttttcgtatcaactactagtatcaggctgatactagtagttgatacgtttagcaaacgaagagatgctgtctagttgcagataaatcaaattaatctagtgaaggttggcgtgcaaatatgttaaagcagtcgtgctcttgtgctagtgactgtcagatgacgcgcttcttcgtaaacacaatttactctactcccctcatcacagtgtctatctgtcacaagatgctcgcctgaatatccaatcagcaaccaggcaacctcactgccaaatgaactagataacaagagatcgatttctaaacagaaccaacgagtgtgttcagtatgctactgcgccagatgacgattcgttgatttgtagtactccctccgtcccataatacaagggattttaagtttttgtttgtactatttgattactcgtcttattcaaaaaattttagaattattattttttttgacttgctttattatctaaagtactttaagcataacttttcgtcgtttatatttgcataaattttttgagtggtcaaacagtgcaagcaaaaatttaaaatcccttatattatgggacggagtgagtaatagagtaagtagtggagtagtactcccttcattcctaaggtggagagggattaaactttagttcctaattcctaaacaccacctaaatgatctacctatttcaccagcaaaagcaaggagcagttactaccccatcgatcaacataactttgtatgcagtgctgcttaatacgaagtgccgtccatgatttctgccgcttcctaacaaaatac

SEQ ID NO: 72418 - DNA, 603 bp, Oryza sativa
atcccaccattctgatgcagattagaaaaggtagaaggagaggggttacactaaagacaagaccttaactaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatttgaacacttaagattcgactatcatcttcttattcctcgatccacttgacttgcagaagttgacaacatcgacgtcttcgagtttctccatcaagataacgactactcaagttgaaagaggaagggggaagaacgacaaaacgatttgcaaagaattctagataagggagaaaggaaaattttcacaaattatgttttcggaagatttgtccttaagggttgaccatttggcttatcctacagtcaagatggctctgataccaacttgtcacgccccgaaaattactagtaatttccgaacttatttgtgcat

SEQ ID NO: 72419 - DNA, 16172 bp, Oryza sativa
ttgctatgcggtttagcgtgtcacgctcggtccaacggatcgatcgatcatgcgcttttcgtcatccaaaatcattacgatttagacgagcaacaatgcaacactagtagtagtccttgactccttgcagtactaagagcacccgcaatggtaaagtaagatgttctctataaaacatgtacatctcagcaatagactagattaaagtaaactacctcaatagtatgtctatatgggtatctataactctctaatgcattgcctcgttttttctctatagactatctccaggttagtagatagctttgctctctcttcatttaatctttttcaagtaggaaaatatgctgacatggatctcttgtagagagcctatagataatcattgcgggtgccctaatgaaacggaatctggtcccttttgctgccctttctgggacgcaccacggcagaaaaaagggtcaaaagagccgcgggcatcatgcagtagtactaagcagcacaaacctgtgtctgtgtttgtccgtccattcgctttcgttgacctctagctctaatcaagccattttgcggtgaccacttggggagttggggacaaatagctactgcccctccatttcaggttataagatattttgactatgtacaaaattgaactgttttaagtttgactatgtttatagacaaatatagtaatatttataatactaaattagtttcatcaaatcaataattaaatatattttcataataattcttcttgggttaaaattgttactatttttctctacaaacttaatcaaatttaaagcactttcgtcttataccctaacctgaaacgcagggagtactaggcaagtgtgcagcagcatcgcatatgccagatggttaatgccacaccatttgcctgcagcagctcggctggaacgtgccagcgatctagagatggcaagacaaccaaccaaacaatggcacctcagtcacctcacggctttcctctgacagatgtcgtcattgggggtccaaaccgttagcctcgacatgtcgccacccgttgtttccacggccttttctgctctttttttcttcagccaggacctgatggatgctgatgactttcgcctagtactagtaacagtcttgtctactactactacacattcaaagtgttcttttcccggtcagttaaatcatttcggatcagaaaaaaaaactcattttatttctcatacccttcttcccctcgacgaccacctaccacccaccttctcatctctcccttctgataatcgccaaagaagagagaaaaagaaaaaaaaagaatctgaacaactctcgcttgcttaccattaaccacagtaacaagtgcaccactaacccccaaagccatcgattagcggcgactaataaagtaattaagcccaaggtggggagcatccacggggaggagtttctgcttcctccaggctctacgagtgcataaggtggagtagtactcccttcattcctaaggtggagagggattaaactttagtccctcgttcccaaacaccacctaaatgatctacctatttcaccagcaaaagcaaggagcagttactaccccatcgatcaacataactttgtatgcagtgctgcttaatacgaagcgccgtccatgatttctgccgcttcctaacgaaatacgatgatcaaattggaacttttatttttggtaatacgaagatcatttaggaatggagggagtactagtttgtaccagatgacgattcgttagttggttttgaacattgtttaaccgccagcacgggacgagcgaatcgagctgcctccgagtgcataaacaacaagcagagtcgcccactcgccaccgccaagtccagtttctctattccccagctgtcgcgcgcacgaggcgccggtggggatcccgaggaaggagagcacgtcacgactcacgacgtggacgcgcgtgagatccctccattctttttgtgactcgtaggtggacttcccctcgtgcgcccgcgcgccaggaacgcgcatagccgcagatggccgcgccgcgtcctcggctcggcaatttgctcgcgatcgccatcacccctcccgtccgtgcgtccgcgggaaacttcccttgcgaatcgcgtgcccgtccgtcctccgcccgcggccccgcccgcccgtgtgtggcgccgcgcgttttctgcgcacgcgcgaggcgtttgctgcagcgacagtgcacagcgctcggagacgccgacgtaggtagttgtatactaccatgaaggcactgcttgtaaatatctgagtgactgtgtctatggcatctgcttttgctatgcggtttagcgtgtcacgctcggtccaacggatcgatcgatcatgcgcttttcgtcatccaaaatcattacgatttagacgagcaacaatgcaacactagtagtagtccttgactccttgcagtactaagagcacccgcaatggtaaagtaagatgttctctataaaacatgtacatctcagcaatagactagattaaagtaaactacctcaatagtatgtctatatgggtatctataactctctaatgcattgcctcgtttttttttctataaactatctccaggttagtagatagctttgctctctcttcatttaatctctttcaagtaggaaaatatgctgacatggatctcttgtagagagcctatagataatcattgcgggtgccctaatgaaacggaatctggtcctttttgctgcccttcctgggacgcaccacggcagaaaaaagggtcaaaagagccgcgggcatcatgcagtagtactaagcagcacaaacctgtgtctgtgtttgtccgtccattcgctttgcacaaacctgtgtctgtgtttgtccgtccattcgctttcgttgacctctagctctaatcaagccattttgcggtgaccactcggggagttggggacaaatagctactgcccctctatttcaggttataagatattttgactatggttaaaattgaactgttttaagtttgactatgtttatagacaaatatagtaatatttataatactaaattagtttcatcaaatcaataattaaatatattttcataataattcttcttgggttaaaattgttactatttttctctacaaacttaatcaaatttaaagcactttcgtcttataccctaacctgaaacgcagggagtactaggcaagtgtgcagcagcatcgcatatgccagatggttaatgccacaccatttgcctgcagcagctcggctgaaacatgccagcgatctagagatggcaagacaaccaaccaaacaatagcacctcagtcacctcacggctttcctctgacagatgccgtcattgggggtccaaaccgttagcctcaacatgtcgccacccgttgtttccacggccttttctgctctttttttcttcagccaggacctgatggatgctgatgactttcgcctagtactatttatagtcttgtctactactactacacattcaaagtgttctttttccggtcagttaaatcatttcggatcagaaaaaaaactcattttatttctcatacccttcttcgcctcgacgaccacctaccacccaccttctcatctctcccttctgataatcgccaaagaagaaagaaaaagaaaaaaaaagaatctgaacaactctcgcttgcttaccattaaccacagtaacaagtgcaccactaacccccaaagccatcgattagcggcgactaataaagtaattaagcccaaggtggggagcatccacggggaggagtttctgcttcctccaggctctacgatccccaccgctgcgctgaccaccctcctcgtgccgatgctgcgcagaagatcggtctttggccgcctccccgccagattcggccggtgaagctgccaaggctgctgcgcggtgtggttgacgagttcttgctcgctgactcgctgtagctgatgccatgtttggggcggggaaggtggacgatgagatggcgctcaagaggcagagaaccgtgaggtgagcctgcacgagcaaagcaaaagctcttctttggtctagttttagcttttcagctcttagagatccaacaggctctgcgacctgcgagtgatttggcatttgctgtgagctttttcttgttgttctaggaggaaggacgctttagcctggattgtgccagctttctaatttcctgttactctgcaaacaatttatgtatttgacctgttttttagagcatagactccttttaagaacccaaattaatccattcgatttattctatagcatggtatgatgaaggttttcatcccttttagttgatctggccaggaaagattaacctttcgtggataagaaatatagggcttcaaccaaaattgatattagaattaaattgtgttaatgtacaaaaactgttctaactgtcagttctttatgtgatttagtttacaatgggaggttctatttcattcccaacattatttttcttattttcactgttttggatggacatacgaaaatattcatgatgtagagttcaaacatttatgtgaggctgtaattcacaggttctatgatgagaaggcaaaaccaactataccaactcaccagaaacaggcagggttcgctgctagtaaacttggtgtggcaagctcaggaaagaacaaaatttttgtgccaggagaagagctgtggtacaaaaggattttggacccatcaagtgacttcatcttgacatggaaccacattttccttttttcgtgcttcgttgctctatttatagaccctctgtacttctacgtgccaaaaatctcctatggcaccccaaattcgtgtattgggacagacaggcatttagccatcactgttacattcttccgatcaatctctgatttactatatttcactcacattataataaagtttagaacggcatatattaatccgagctcaaccatgagggtatttggaagaggagaccttatcacggatccaaaggaaattgcgtggcaatatttgagatctgacttcgtagtcgatgcagtggctgcattgcctttaccacaggtaacttggcgctcttccttttattcttgtcaactggagtataaccagtattaatgatcattattgttaggtcgttttcataactgagtatatttgttagctctgatgttgtcttatgttcatttatctgcatgcggacataaatatgctactgtgctaatatcaatcgtgaagttctattgtggatcacctcaattaagtttctttacagcagatgctactatagtatcttgtggataaataatgatttgtaactgtgttagtgctgcccagaccacactaaggacaaaataattttcccctcgcttaatacaaaagatacgcatgttctgcgtattctcaaaaaaaaaaaaaagtgtcacttgctcaatcatcctgtctctaagtcagcatgaaaatcctagggaatcatcatgttcaatcttggcaaatattcttcatagtttaagagccaatcactaaactgaaacattttcatatgatgcattatgaatttaataactattattttaccatcagtgccgaccacatgtattgtctcttgatttttcttgtgaattcctgtaagctaaaattgaacctcatattaatgttccactggataagtttactacaatgggctccaaaatgcagcaacctgccatagcatctccagtttgtttgagctgattttcaatggttataatcttactcatcgggatttctaggttctctatgcttcatagggcaattttgtacatcgtcaaacctaaaagcactaaataactgaattttatttgtgcagctgtttatattgctctttccttcaaatggaggaatcttcgattttgactttgcctgctgcttatgtatctttacatttatgcagatcttaatctggtttgtgataccagctattaagtattccactgatgagcataacaacaatattctggtgctgatagttcttgctcagtattttccaagactatacctcatattccccttgacttatgaaattgtcaaaactactggagttgtcgcaaagactgcttggcaaggggctgcatacaatatgttgctttacatgatagccagtcatgtatggtattcgtaagcgtttacatgaaatgttttctacatctcaaatattggtgttcagcaaatgtcgaattagatgtatttgcaagtctttaactccatagctataatgtctccaaattttcacgatctccattcatcttctttcaggtactaggtgctctatggtatttgctatctgtcgatcgccaaactgcctgctggaagagcaattgcaagaatgaaactggctgtgatattaaatttctagattgtgatgtgataccaaatcaaaactgggcaagcaaaactgctatcttcaatacctgtgacgcaactaacacttcaatcagttttgattatggcatgtttcagcctgcattgtttaatcaagccccagggcaacgtttcttgatgaagtatttctattccctttggtggggtttgcagaatctgaggtatttccttgtcaaaacatcttcgtgtcaaactacagcgctataagaaggaacttagtttacagtttccttgtgaaatgtgtgtgttcagaaatttcatgggaatcacggagatttttgtgtcaagcaaagcagtaaattaaatatggaagtttagcctagttcttttaatgggatcattactttaccaattttcaagatctatattcattttctaacgagctatatcctcctcttcctttgcaacagttgctatggccagactattactgtgagtacctatattggtgagactctatactgtatattcttggcagtacttggtctcgtcttgtttgcacatttgattggaaatgtacaggtaatttttaaatgtttagtgatcatgtctacactacgattgattcttttggcacttttttatacactgctactatttttccagacctacttgcaatctatcactgtgagggttgaggaatggagattaaaacaaagagatacagaggagtggatgaggcatcgtcaactcccacatgaactacgagaaagggtgagacggtttatccagtacaagtggctcgcaactcgaggagtgaatgaagaatcaatattacaggctcttcctgcagatcttcgtcgtgacattaaacgtcacctttgcttgggtcttgttcgccgggtaaatacttttgcatgcttttataaaatacacccaagtaaatatttgaaactgttgtgcgatcttttgatgtttttcttttaagcaatgaatggtactagaaagttattgtatatactggtcctcttctcttttaaaagattattagagtatatagttagttttagtgctgttttggtctcagtatatacctggagtttctcatgtactcactaaatttgccccttgacctacctcatcaatggaatatttactggttgcaattacttgattccttcatttatattagaattgatcttagcatcatatttggcaatgtcacaatgaactagaagtgattggattcttatatagcagcagtaactatttgatcctagttaagctagtggtgccgggttttgacaatagatggcccttgatcctaattaagtgtagaaataggcagtctgagattgttagtttgcatagttaccgcagggtccaaatattctggagattccaaacaactattttgaaactgtccaaatatacacttcttttttttaaaaaaatgcatttcttgggcaatttacactacaggtttgccttatacttgaccggtgtgctaattttgtctttacctaccacaatatttcaggttcctttcttctcccagatggacaatcaacttttggacgccatctgtgagcgtcttgtatcatcgttgtgcacacagggcacatacattgtccgtgagggtgatccagtgaccgagatgctcttcatcattcgtgggaaactcgaaagctctacaacaaatggtggccgcactggcttcttcaattcaactaccctgaaatccggtgatttctgcggcgaggaactgcttgggtgggctcttgtccccaaacctactgttaatttgccgtcatccactcggacagtgaaggcactcatagaagttgaggcattcgcactccaagctgaggatctcaagtttgttgcaaaccaattcaggcgtctgcacagcaaaagattgcaacacactttccggtactactcgcaccactggagaacttgggcctcatgcttcatccaagctgcttggcggcgatacaagaggaggaagatggcaagggacctgagcatgagggagtcattctgctccatgagatcagatgactcaaatggtgaagatgactcgccacctaagcagaatctcgctatgaagatcatgagtgggagtaggaaaggacctcagaacatgaaagagttgcctaagctaagaaagccggatgagccagatttttcagctgaaccctgtgagtaaggtctaaaatgcaacagccattgcttctgctaactctgctgctaccagttaaccattgctatactaccatatactgttggatcgacggcacgagttgtccaattgttgatgagaaagttcattaacttggaaactaaaaaacatggagaagcagcgaattcacgaagggatcgaggctttgagttgactagatgttttaggcgttggcaacttgtacatccagatatacacgtctgtgcttgtaacattcttgagatcttagaaacggccgcacccttacatttgactgcagagaaagagcgtaaaagaactgaagaaagatcaaacgtaaaggcagtctgtatttttgggagtctgtaaagcgttagggcggctattttttgcttttaactgatagacatttcgttgtattgtgcaatgtatttttgtggccaaaactgcaggttaacatctatactgtgcatacgttgtgcctcctttgtggctctctctcttgaacatatatactgtgctgtggtctgtggaatgaggagctgttccatttggtaacaaaccatggatacaatcagctgggctgcgtatcaaatatccgttgctacaagaaatttgataatttggcacttttatcgttgtcgacttgctttaattggtaatttttgagagtgacttgtgagatcatagtaaataaatgtagattaggatattaaatatttttttcttttttttaaggccaaggggaccatccaaatatattaagaaggaataaagtaaaaaaaatgacagaaaccacatgctaaccacgtaagcactaaaacgaccctgctatgcgtagtcgatcgtcgccaggtttacgacagcatcacaagaagagactctgaaaacggaagtgtcaaattatcaaatctccatacaagcgtggcacgcagggtggcggccggcgggtaggggagggatatgcatgtgggactgtgggcgactcatcagccgtcgctcgtggagaggcgccccacgcgcgcgcatggtgcgatgcgctcgttctttcgcgcaagctgtgcacgcggcgcggcggcctgggcaggacggtgccgctagttcacggggtggttcgcggctagcccaggtgaatcgcgggccgcggctctgcaggatcgatggcgccgccgccacgtgatggcccacgatacgatgatatgcaagcgtgtgtgtggcccaatccggcgccgcctcgatcagcctcgcgcctgtacacgttgccggtcgctgtgctgcgccctgccagcgcgcggcgcctcggacgaacgacgtcgttgttacgctacgcacgctagctgcttgggcttggccagccgtctgcttcgccggcctttatcccagcacgctattcctcccctgcatcacacgctacttgtacggataattgagtcctactactatagtttcccaacccctcttctcgtttttcacgtgcatgtttttcaaactactaaatagtgtgcttttttaaaaaagtttttatatgaaagttgtttaaaaataatcaaattaatccattttttaaaaaagttaacaaatacttaattaatcacgtgttaatggatagctccgtttttcatgcatgggagatggttcccaacacccacctccgaacacacccttaactcgtactacaatattaccaaacggataaacttttctttagataatggaatgaaatagcatcccggcctttactcgaaagagctacagctaattattacaaactagctgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaaaataaatagatgacttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcacttcactttatcttctcttcagggcggaggaactatatatatatatatttatatagagcaagggtgagtactttcgtactcagcaagtcacgggaacttaggtgtttaatgcaagcttggaagagaggcaaggtcgttttgcaaatcttttatttgaagactttttgaaatcactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttcttggactcccagagtccagctgcccagcagcaaagcaatccgcttccactcgggaagcctagtctatgatgcccacggacatcccgaatcacacagattcgtttctgaccactcaggtcatccatctgccacataggctgattctggttacgattcccacaccacaataacttttcacaaagcacaggcaaacaaatctacgcaatgggaaccacctcacatccgcccatgactgtgggcacggctgttcgaacagttagttaacctctgcagaggggtacactttacccacaagacacgaacttactctagacactggccggtgtcagaggttcgcgacaaagcctttcccaagccgacccagggatacctcatgccacatagaaggatcaaatcctcacataaacataggccattttaggcgttcacaaatcaaaccccaaccacctcgatcggtaattcagcaagcttctcgttcttgcattaccaggaacccggtttggctccaaccgaccccgtcccggcgttcccaactattggcatgcgaggtttccctgaaccgactagttacttggccagggtgtcccattccaccttgtggttgcactttgattatgttcgatgagtttcccacaggaatcggtccttatatgcgaatacgggacagtgccacataggcacaacccccgcatcgcaagttttcacaattcattttattttcaaacacaccgacaccacatgtcgggttttgaaggcttctcaaacccattccccaagttttcgacaaacagcggtgtatgtgggatatttggtatacgcgctcagagaacacgaataccgaggtaccacaagggtggagcgacaaggaatcagggtagtacgacctacgggaattagtgcgactactgggtaggtccgtcggtttggcacgcaaaccgaggccaagcaagttaagtgtgtgattctaataatgcaagttgcaaacaaaataataatgactttttagttataggggcaattgatcaaagggtgaattgccttgctcaaagtcttcacgaagcttcacgaatcttcaagaaaacccgcgatcgacgaaaatccggtaaccgcaactatacgcaaacaatcgaaaacctaaacaaaagaccaaaagaaagatcctatttagactaattagtagtgccattaaatagatctcaattttatgggaatactggaagttgagcggagtcaatcggagttgcgaattgggtgatatgaattttggaagtttaattggagtttctggaataggagaaatggtttatggaatttgtagaaataatattctcaagaatattattgacagtcactgtcatgcgggaccaaaggaaatggtttatggaattttggaataaggaattgatttatgggacaaaggaaaaaggatttattaaatccctggaaaaagaaaaggatggagggatgttaattggacttgggccgagcgaaggggcgcggcccgaagagatgcgcgggcgcggccgaggcgagcgggccggcgcgcgggagggaggcggcccaaggccgaacgaggcgcggcccacgcgacgcaagccgatggacgcggtccaccgagtcgggcgcgaggcgggacccacaaggcgacgacacggctcacgcgagcggggtgcacgcaaggcggcgcgttggatcggtggaccgggagacctttgaccggtctccgcggggccgggcaggtagatgtggcgtcctcgtggacagccacgttggcacgggcgagggaggaggccgggcggctcattggacggcccacggcgcgcggcgggatccggcgaacggcggcgagccggaaggggcggctagcactggcggcaggaggaggagaaggggaactcattccacggctcggatcaggaagaggacgcgcgacgacggccggcggcggcggccaatctcgccggcacgccgacgtggccgcgcgcgagaagagcgaagggtgcgcgggctcgggcttagccgaaccggtatggtgttgcgacgcgcacgcggtgacgcgggacccgatggtcaccggcggcgcacgcacggcagcgttatgcggcggcggaagcggcgacacggcgcggagacaagggagaagaccgacggccttggggcagccagggggaggtcaaggggatccccgggagcgtggcagcgagaggaatcgacgggagaggagccgacgacgatggattgcggcgcggcaaccaccggagagcaaaaaggggaaaacacgacgagacgacgagggttcgattcaaaggggtgggagcatctccggggttcaaggaatccgtttccggcgtcggattggacggagcggcaccgagattggctggcgacgagaggcggcctccgggacagagcaagagcgcatggcgagctatggcgagcggcggcgggcgcggcgcatcgcacggcaggaggaggattatggtggggagctcaccaacgaagaggaggcagcgttggcggcgcggtcggtgtcgcggcgaggtggtcgcgacgccgaggcggcacggcactgagagggcgcggccggggaagaagggagggagaggtggtgcccggagctcctcgtcacgcgtccacgcacgcaccggctcctccggtgctcggcaacggacgacaacggcgagagcgggacgagcagcaacaaggcggcgacggtggttcggcggcaatggcgcggtgggtgtgaggactgaggcgagtgaaaacgagagaggaaggggtttggggtggcttggttttatagcggaggtgaggtcggtttggggaggggagaactgaccttggcggtcaaggggagctcggctggcggcagcggcggtttcgtggacgatgcgaaagcggcgacggcgtggatgctttgggcgacgaaggcggtggatcgagcggcggagatcgaaccgctggagcgcgggctggcgtggtcaagtagatgaggcgggtggcgcgagcggtcaagcggcgcagaggtggtgacgccggcagtggtcgggaaagggaaaaagaaggggaaaaaggggcttggtctcttgccataatgaggagagggagagtgaggaggaggaggagagggagagcagctgcttctcccactcttggacgggtgcggcgtggagtggcgggggggccatggatgacgtcgacgatgacggcggcggtcggtttggcatggagcgggggcaaggcggcagcgcatggcgtcggcagcgaccggccggtcggccacctcgcgaggcgcgcgcggtaatgggcgaaggcggtggaggttttgggcggcgacggcgggaagcggtgtcggcgcgagagtgaaaccgagagggagagagaaaacgagagagagagaaggaagacgagagagcgagagaaacagagagagcgagcgacggctctctctctcggctcgcatgcgtgcaacgcacgtgcgagggggaaagatgatgggctgggaggggagatgggccgggggagaaaatcggtccatccaaaaatacagggaggtaaagtagacttttacagagaaaaccgatttggatagaattgtagatatttagggtttggattcgaattcaaatttgacattcgaacttgagggtttagggatgtatcaagggaaactcaaggagaagtcatggaaaagattcaaaaggaatacttgggtatttgttctcgggaacatagggtggagtcaaggaaaggattcgaggcgggatttgaataattctggattcgtagaagtatttggtgaggattcaaaggaaggatttgaatttcagaatttgatttcagagactcgaatcggaagaggaattttcgaggtggaggattttgatttcgatgagagggaacaacgggattaaattgagatccctggcacaacttagactctcacacaaagaacgaaaattttcgtaattaggattttgccgagttagtttttaacgactcacgaaaagcggagcgttacactagcactctgtaagagtgaagttcaaatagaagcaaacacaccaaccaaactagacaaaataacattattccagtctattggtaaatctccatccatgattggcaaacagttgcataaccgtcgtttcaaccttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctactcagccacagtgcccaacacaaggcagaagctccaacaagtatcagtttgctctttttgtttatgactccctgaagccaatcatcaaaaatatgagatatgctagtaggaatatataaaccaaaagaaaactgaactgccctccaaataaactttgcaaaatgataatcaatgaacagatgttggatagtctcattttcgtacaaaagcaacatcttaaattaccagtccaattccgtcttgctaaattatccttggttaacacaactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaataatcaaaagtattattcaattgaatatgaacaatagatgcacacaattcatgccaaagtgttaaattttgaccaactaaagctctcctaaaagaaacattgagcggaacagaagccatcacactagcaacagaagaacttctccttctgacaatagcatataaagatggatacttttctctaaaggccgtatttcctaaccatctatcttcccaaagtcttatgtgttccccattattcacaatccaagaacccatagttaagaaagttttttttgactttcatgagtcctgaccaaaaatgggagtcaccttgtttcctgtcaacttgggtgatagacttattataaagatactttctcttcaataagtct

SEQ ID NO: 72420 - DNA, 17686 bp, Oryza sativa
  unsure (1)..(17686): unsure at all n locations
gtgggtctgacgttaatgagagcaacatcgtgcccatcactttggacaagttgacgcctgaacaaaagaaggatcttgaggcaatgatgcagcagacacaaagctaattcttgaactcattcatggagactcgccaaggaacaattgttcagaggtacaagatgaaactagttgttgatgttcctgggacaagttcttccaaggatggagaagtacaacaagtctcggatggtacgactcaatcaggtgataaaggtgcagcagatggttctcaaggggttcaaggtgatggttctcaaggaacttaaggtgatggttctcagggatttcaatgtgagaatcttaaccatgatggcaacacggcacagctacagtttaacaacattcaagaatggattgactatgtcgcgcaacatgctttgatttatcaatctggagtgttagtcaacactttgtcaaacatggttgatggctcaatagcttaataccaggctacaggaccggtctatttgccaggaggtgttttcacgaactatcagcccttgatcactaataatcagccagctgtttagccaattcctcccaatgcaccatcggctcaaccgacagcacctgtatcagctcttgcacctgttgcaccatcatcggcaccaggtcaactaattaatcctcggttgttggtgggagagcagccacaacatagtggacaaaaatgtgaatcggctaatccaagaccaagttgcagctatgttcttgccagctcagcctactgttgacccaatccagcaacagccgattcaacagacgccaccgaggtagcaggttgtgcagccgattcaacaaacaccaccaagacagcaggttgtgtagccaattcaacaaacgccatcgaggcaacaggttgttcagccgattcagcagcaaggtttgatgaatgcatcggctaggtttagaacacctgacaatcagctaaggcagcacgctgcgaatcaagttgtccaagagcatttggttcataatgtgcaaccagatcaaacggtgaaacctcaagttattcccgaacatttggtgcgcaatgtacaaccaaacattcagaattatcaagggggcaatttaaattatcagtatcagcctccatcgccgcaagttcaatatcagcaaggaggatcggcttagcctcagttcgctcctcaatacaatcaattcgagcccgtgccacaacaatcacagggggtgcctcagcaacgaccatgggccgatatgattgcagatgtgatgagagagcagtttgggcttaagccgaaggatgctggaaacttgtatcggcatccataccctgagtggttttagagagttccattgcctaaccgattcaaggttccatatttttcaaaattctcaggcaggacagtgtttcaacctatgaacacgttagccgattcttagctcagagtggtgaagcatcggctgtggatgccttggttttcttccttgccatgtggatcaatcaacagttgggccgatttggagaagcattttcatagctatttctatagtggggttcatgagatgaaactgtcggatttaacggcgagtaagcaaagacatgatgagcctgtgtaggactacattcaaagatttagagagatgaggaataaatgctacagcttgagtttaattgatgcctagttagccgatttggcttttcatggtatggtagctccgatcacggagaagttctcgtctcaagactttgatagtttgtcacatcttgcacagaaggtaaccctgcatgagcagaggtttgcagaagccaggaaaagcttttaaaaggtcaatcatgtctgtccctacatgtatgggtctgatgacgatgatgatgatgattttgaaatagcagcagccgaatgggttagaagtaagaaggttataccatgccaatgggtgaagaattctggaaaagaagagaggtatgactttgatgttaccaaggctgataagatctttgatttgctacttcgggagaaatagattgaacttcctgccggtcatacaatcccatcggctgaggaattaggcaagaggaggtattgtaagtggcataattttgggtctcattctaccaatgattgtaaagtcttcagacagcagatccaagaggctattgaagggggcaaaatcaagtttgatgactccaagaggccgatgaaggttgatggcaatccttttcctgtcaatatggtgcacacagctggccgaacagccgacgaaggaagggctagaggttttcaggtgaattcggctaggattatcaataagtatcagaagaaatatgacaagcagcgggagaggcattatgaagaagacgatggtagctttaatcctcattggggttgtgagttctttagattttgctggaatgaaggtatgaggttgccgtctattgaagactgccctgggtgcagctatgttacagaaagttcaagccgatcgtataatagaggcaatcggctaaggcaaataagagttcctgttgatcaaagattgggtccagtgaaccaagatcgtggccaagaggacaatgaagacaggaagactcaatggtgtccttctggtatttttacaaagaatcagaagagaagggttcaaatgttgaggaacagggaacgctttcaggaggttgagcaagaaatcaaccattggctgaaggagacgaagccgaagcaggagtggcgcgttaagaatcaagttcctacagcagacgaagccacaaccgatgaagcaaaaagattggctaaagggaaaagtgtcgtgactgcatcggttaacatggtattcacgttaccttctgaatttggggtcaaacaagccaatgttgatgaagttgaggaagaatcagctaaattgattttatcatgagaacaagaagtctttaagaaaccagaagggacggagaatcggcatcttaagccattgtatgtaaatggctatatcaatgggaagccgatgtctaaaatgatggtcgatggtggggttgtggtgaatttgatgccttatgctacatttaggaagctgggcagaaatgctgaggatctcatcaagacaaacatggtgctcaaagattttggtggcaatccattagaaaccaaaagagttttgaatgtggagctgacagtcggcagcaagactaaccctacaacattttttgtcttcgatgggaagggttcctacagcttattgcttggaagggattggatccatgccaattgttgtattccttcaaccatgcatcaatgcttgattcagtggcaagacgacaagattgaaatcgtgttagccgacaagtcagtcaacgttgctagtgccgatttagctctttgggagatgcctggtctcgattgcttatctggaaaagtttgggatggagattttctaaaagtgtccaattgtgatatacaaccaattgaagatggagagcccaagcttttattttgagggtgtcgtggagggttcaaatgtctacaccaaggacacagtagatgatctcaatgacaagcaaggacagggtttcatgtcggctgatgatttggaagatattgatataggtccaggtgatcgaccaaggccgacatttatcagtaagaacttatctccagagtttagaaccaagttgatagagctcttaaaggaattcagagattgctttgcttgggagtattatgagatgccaggactcagccgatcgattgttgaacatcggctacctatcaaactaggggttagaccacatcaacagcctccgagaagatgcaaagccgatatgctcgaacctgtcaaggctgagattaaacgtttatatgatgctggttttattcgtccttgccaatgtgggtttctagtatagttcctgttatcaagaaaaacggcaaggttagggtgtgcattgatttcagggatttaaacaaagctacccccaaggatgagtatccaatgccagtggccgatcagttggttgatgctgcttcagggcacaagatattgagttttatggatggaaatgcaggatataatcagattttcatggccgaagaagatatccataagacagattttcatggtgcaatcggcttatttgagtgggttgtaatgacttttggcttgaaaagtgctggagctacatatcaaagagccatgaattatatatatcatgatctgatcggctggttggttgaggtttacattgatgatgtggttgttaagtctaaagagatagaggaccacatagccgatttgaggaaggtttttgagagaactaggaaatatgacttgaagatgaacccgacaaagtgtgctttcggtgtatcggctggccagtttttgggatttcttgttcatgagagggggattgaggtaactcaaaggagtgttaatgcaatcaagaaaattcagcctccagagaataagacagaattgtaggagatgatcggcaagataaattttgttagaaggtttatttctaatttatctggaaggttagaaccttttacaccattgttaagattgaaagctgatcaaaagtttacttggggagcagagcaacagaaggctttggatagtattaaggaatatcttagatctcctccagttttgatccctccccaaaaggggataccttttaggttatatttatcagccggtgagaagttaatcggctcagttttaattcaggagcttgaaggaaaagagagggttgtgttttatttaagtcgtcggctcttggatgcagaaacaagatattcccctgtggagaagttgtgcttgtgcttatatttttcttgtacaaggttaaggcattatctattgtccaacgaatgcactgtcatatgcaaagccgatgtcgttaagtacatgttatcggctccatttttgaaaggaagggttgaaaagtggatattttccttaacggaatttgatcttcggtatgagtcaccgaaggcagtcagggggcaagctatagccgattttatcgttgatcatcgtgatgattcaatcggctcggttgaggttgtgctgtggacattgttttttgatggatcagtatgcactcatggttgtggtatcggcttggttataatttctcctcggggggcaagttttgagtttgcttatactattaaaccttatgcaactaacaatcaggctgagtatgaggcagttctcaaagggttgcagttactcaaggaagttgaagccaatgctattgaaattatgggagattctttgctagtgatcagtcaattggtaggggagtatgagtgcaaaaatgatatattaatgatttataatgagaagtgccgagaactgatgaaagagtttcggttggtgactttgagacatgtatctcgagaacataatattgaagctaatgatttggcccaaggggcgtcgggatataagccgatgatcaaagatgtcaaaatagaggttgccgcattaacattcgatgattggagatatgatgtgcatcattatttgcagaatccatctcaatcggcttctcagaaattgcgatataaagcgttgaagtatactttattggacgacgagctctattatcgtacgattgatggggtgttgcttaaatgtttgagtgccgatcaggctaaggttgcaatcagtgaggttcatgaagaaatttgtggcactcatcaatcagctcataagatgaagtggttacttcgacgtgcaggatatttttggccgacaattgtcacaccctgaagttctttcccaagcctaaattgaagttactagccgtcaacccgtgccttacacaggttattggtagtggtagtataaagatcaaaattttaaccatacgttcactacgttggccatattcgaattgtagcatgttagattgaaataatagttaactactcccttcgtcccagaatataagcatttttagagttagacaacggttattaagaaagttggtacaattaaataggggagtgttgtggctgaaggagaagtggagatagctggaaaaattgaatggtggaggattgtgattcgttaagaagagaatgttggtggtaaattgttatattttgggacaaattctaaaggctagaagttgttatattttggtacagaatgaatactacttgttaattattaatttcgaatcaaacaaatgctaaatttgtgatacatccaacttttttatttgatattgtggaattctggaattaattaagtatttagttgtgtctgtggtcgagtttaaatttaagtacaccctgtaatttaataattttgaaattaaaaaaaaatagttatactcagtatggaccctagaagatataagatatatgtaattagcttttttgttttatcattcccaaaactcataataataattagtgatctatggtctcttgcctatttgtaccggttaagtacaaattaaagagtctacgatattgccaattgcatgttttattttttcacaaaccccaaataaaacctaatgttgtgattttgcgattttgccaccatacatgctatttaaggtgaatttggtcacgtctatcagatcaagcatagattgtttactcttgctgcaagtaattctcatatgaacctacgtagtacatgataaatatttgtttacgtgcatgattatttgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctagtaagtatgcttctctctctctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacccttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagtaagctgcaaactacatgtacatatgcattgcatacgggatataccgcgcatatggaaaattaaatatagttgattgcattcagagaattatagatcaatatatttttatctgcttctactgtcattaaacaacttgtcaaaatcagacaacttagaacatgcaagtttaatggaataaaaaaacacattcaatatgtaaaagatgatcagcaaatagttgatcattccaatcaaaaccataaattgagtgcgtcctaattaaatagactgctaaatatgtattgcaaattgaacacgcaaaccatgcaaattcaaaggaatacgtatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaacagggatgaacgatacctctggagcgatcactgattcactggaaacttttaacttctcctcatgattgaggcaaattgtcgctgatcgggaccacagtctgggatcaaggtcgactgcagcctatgcatatctcatcgccctcgctcacgttcttctcgatcgcgttcgccgtttctttatcgcttcttaatttccaatctgatttctcacgatggaacttggagataaattagatggattctgtccttccatcgataactggatagataggatttgcaaggagcccactgagtttaagattgattggcccacgatgttaaagtattgcaggatctacggtgtagattaaacgacttatctaattgatgctcagatctttctggttaacgtgagagctccaaaaaagtgtccgattagtataggtatagatagatagataaatggtctcaaggaaataccggtgtaaagcaagagtaaaccctaataaattaatgcaaataataaccggatttggcatgtggaatttttcttgagttctacatgtcgaaatacgctaacaagatttttagtggaattttgagagctctggaaataattttaaccaattaaaattgatcacaagcaatatttaatcccaggaaaactcatttccttttttcctttttttctttcttttctttttcccttttctctttcgaatgggccgcccgcccattctctcctcccttccctttccgctgggccggccgaaggccgaggcccatctgagccggccgccttttctgtctctccgggtcgccgacaggtggggcccacctgtcgggcccgtctgccttctccagacggagccgacgcgccctggaaccaccgacacgcctagctgtcttgtcttncgggtcacgtcggccacgcccgtgcgtgcgcccgtgtattccgcacccactgcctatctcttccgcccgcgtccgctctcgtgaccgccgggattcgattatcgaattccacctgtttctcctngcccactaccccacgtnggacggcgatatccgctctctccgtcacgtctggacccctcctctatttaagcaccatcgccacccctatctctttttccccatctcgccgagtcctcccgtgctttctaacgccctagcgccgtcgccctcctctccaccgccgctccggtcgccgctagccgccgctagatgccgtgccgagccgcgccgtcgacgccgtcgcgttcgccgtcgtgcgggccatcccgtccacccctcctccgtcggaatccaccgccggaattcactccttgccgtgcgccggtgagcaccgccatggccgccgtcctcggccggcgctctcgccctcttggattttcctctctccctctaacccctctcctcttcttcgttagatggttccggagctcgtctcgccgtcaccatcgccctccgtcgctcgccgtcgtcgatcgtcgtcggtgaggaccctcctcccctttctccctctctcccgcgccgactagccaccacgccaccggccaaccgcttagccgccgctgtcgccatccacgtcgctgcgacgccattgctctccgccgccggccggtcgccgccggtcactgccttgcgccgcgctgcgccggccgcgtaccgccccctccgccgtccgatccaccccgagtggatcggggctgtcggttcggctgcccgcgtggctgccgcgtgtgcaccgcgtcggcgccacgagtgcaccacgtggcgcaccgctccttcccggtccgtggacccagtccaccatggaccgccctccccgagtcactgccatgtgggacccgcatgtcggcgccgcccctctctctctcgggatttatgtattgcgcaataaatcaattaaggatttttctgttatagtaaaaacacagtgaatcttctaaaattcatatctaattcatctgagctccgtttaagcccattcaagtctcagtaaatcaagaaaaatgcatagaatccattaaaaatggttttgttctctgtttcagtagtcttatagcctgtttgtattgtttgctttgtatgtcgcttagattccggctctcccgatgctccggtgtagtttgaaatagtctccgagattcctccagcggcagagcaaggcaaaacatgcttgtcacttgatcatgttgatcctatattgcaaatgctctattgttttccttcaaatgctgcattgttttatattattaccatgggatgtttacctactgttatagccatgttatttttgtaccatgttcctttgttagcctgggatataacatgactacatattgaactaggggttgcttagccatgcttagttcaactagcacagaatggggaaaattatatttaatgtatagacttcaggttctagtgttgatgttggattagagccaccgtcctggtgtcgcttcattaaaatatgttaaatggtgggctatgggtgcatggttttgctagtcgcacccatggcaattaaggaccggttcgcgggaaaccctggaagaattcctcgtacttaccacaagccagcgtgggcaacggctgggcttgtagtatagctttcctctagttgatgcatccaggcaagggtgggcgtgatggagtttggatgggccctgcgatggcctatgcggcttccggattcaccaaggcacgagaggggactgcccgctgccttgcaaggagtgggggtgaaacctgaggtgtggtgtgcttggttagagggggttatgcgaagggtcctgtcacggcctctttccggtatgtctggtggcatgtcggcgcacggaaacgtgtcgtggggctgtgtcttgtgggtacagttgtatacctctgatcagagtaaaactattcgaatagccgtgcccgcggttgtgggcggtcaaccagattcaccgtgattagtttcaccctagtctagtctaatggaattgaatagtataggtggatggttgggcctgttgcaacatggtgtagcgttggacagtggatgtttaatattgattaattattacaaatgttttactgcttccaactattgtttataaatgctcgctttatgcaaatgaaccactatagctatgcctcgatacttccctgcatcatacccctattccggtataacgtgctgagtacagtgggtagtactcagtcttgctctatttttcccaaaccctagagtttgagtatgcgtcagatggtggcttctccgaggagtaggcttcgtccgtgccgtcgaggatgcctgtggagtggggatcccgctgcggtgcaagtcaaggcatagccccatttatcttttaattctccactgcatttatgtaagacttttataatgtttgtaagacgtggatctgtatgtcaactttatcgtttgtgtaccccggccggtcctggacggggaatttaatgcacattctgcttggaatttgtcaaatcaagtcagtctagggttttagtaaaattatttgagatttatttgacagtcagtcgggatttgatgggaggaatgcattaggtcctaactcaggaatatgggttgcaaggtctttatgctcttattgttattattagtaagtatctaatttctcattattttatcgctatgtaagtctatcttatttattcgctctcatgcaaaaaaatgatctatgcataaaattccgctcttattcgcttatttaatttgagtcctttactgcttcatttaaattggatttgagcatgcattgatcctacccctttgtcttctctagaggggcgaccacccaaccaactaccgcggagaaggcattgacgattttgtggcagagttggctcgcatgaccctggtggtgggctaccccaatgcgtcggagtactcgactgttccgccgctcagtggcaagcttcctcaccgtgttcgtctggaggttcatggctaagtgggcacctgcctcgctaacatggtggttgtggcatctggaggcacagcagatcacgcctgtcaggaggcagcatatctgatgatggccagacttcgtgagcgcgacaactacatcttctgcaacacggcgtaccgtttccaccctcgccgagcaagtggtgacggtgtcagcaccttccgtccgacagccggtgagaacgacaccaccttcggtcacatgtgcgcaatgatgaggggaatggacaggatgcactcggatctgcacaaggcgtccaaggccttgaatgatgggaagctcgtgaggatcatagctctgaaggatgagatagcacgcctgaagaaggagaatgctcacttgaagggtctccccattcccggaggagtccggatccgcaccatgccccgcaagtcgacgactgcacccgtgcgcatttagcttgcgcccaggaacccacctccgcccgcagctctcgcagctcctccagttccgcccgcagttcccgcagctcctgcagctccacctccagtcccggctccagtcccagtgtcagctcccgcgtctgctctctccttcgctccagcatcagccgccaggggtccagccagtggcaacggaggttggttgcctgctactcccagtggcagccgcgaccacagtagcagcagttccagtggctcagagctgggcagcggcgagacgtatctgctagactccaggagccgctcagagggacctggcgacgagcaggaggacgccttcgactccaccgaccgcaggagccgttccgagcattaggctcgctttcccttagtttaccgactgcttagtatttgtctgttagtttgtgtgtttaggtttgttcgcttgtgggtcagtcgacatttgatatcatgtgcctatgatatggctgtcttaataaggatttgcttgctgtttaaagtgtttcaattcagatcagaacaattgcagtttaaattcctataaaataaagcttagttcctgagcatctgtttttcttcttttccaccccctccgtctgctcttccttcagatggccaacaccaggaatggcagccgtgcagcaggtgagggcagcaacggcgaagaacgcaccgacggtgggtatcccaacagcgcctccggcaatggtccgcccccgctccccgagaatccgactcttgccccagtaatggctcatcaaactcagatgatggcagccatgatgcagcagatgcagcagcggcaccagcagatgcaccagaggatgcagcagcaagccgagcagcagtagcaacagtttggtccccctccccctcagtccaagctactagagtttttacgcgtcaggccacccaccttttccagcaccaccaaccctatggaggcaaatgactggctccacaccatagagaagaagctcaatctcctacagtgcaatgatcaggagaaggttgccttcgccacacaccagctccaaggtcccgtgtcagcttggtgggacaatcacatggccacccgtccggcaggtacggaggtcacttgggtggagttctgtcgcagctttaggaaggcgtaggtgcccgacggggtcgtggcacagaagaagagagaattccgggcactccaccagggcaaccggacggtaactgagtacctccatgagttcaatcgcctagcgtgatatgcaccggaggatgtccgcactgacgcagagaagcaagagaagttcctagcaggcctagatgacgagctgaccaaccagttgatctctggagactacgccgactttgagaagctggttgacaaggcaattcgtcaggaggatcagcgcaacaaagtggacaggaagagaaagccagcgcagttccggtcaaaccaaggaagtcaccagcgaccgcgcttcactcccggacagcagggtggacctaccaccatgatcgtccgccagcatcgccctttcaactcgagcagcttccacccgggcgctagtggcagctagaaccaccagggaggtcagctcaactgcagtgcagctctgcgcccaccaatggcaccggcacaatcagttccatcagcccaagccaagaaggagactagagcaaagccaaggtcctgtttcaactgtggcgagcatggccactttgccaacaagtgcccgaagccaaggcgtgccgggccaaggtttgcccaagctcgtgtcaaccacgcgtccgcagaggaggcgcaagcagcaccagaggtcgtactgggtacgtttcttgtcaactcagtccctgctacagtactttttgattctggtgcaacgcattctttcatttcaaagaaatttgtggggatgcatgggttaagaaaagaagagcttagtacaccaatgagggttcataccccgggaaatagttcaacctcggtcagttatagccctttagtgctaatagaaatacacctatcacaatttctagccaacctcatccttctcgaatccaaagacctagatgtcattcttgggctggatgggctgaccaagttcaagggagtcattgattgtgcgaatcgcacagtcaccttgaccaatgagaagggagaaaccatggtgtacaagtcaccagtctcaccgaagcagagaatctccttaaatcaaattgaggtggaaaaccctgtgaccaccgaggagaagagttcgcggaaattggaggatatccccatagtctgcgagtacccagaagtgttccccgaagacctcactaccatgccacctaagagagagattgaattccggattgatttggcaccgggaaatgccccaatttacaagagaccgtacagaatggtagccaatgagctagcagaggtcaagaagcaggttgatgagcagttgcagaaagggtacattcgactaagtacttcaccttggggtgctccggtcatttttgtggataagaaggacaagacgaagagaatgtgcgtcgattatcgcgcactcaatgaggtcacaatcaagaacaaatatcctttgccgcgaattgatgatttgtttgatcaactgaatggagctaaagtgttttctaaaatagacctgcgatcaggctatcaccagttgagaattcgggaggggatattcccaagacagccttcaccactcggtatgggttgtatgagtgcacggttatgtcttttggacttaccaatgcacccgcattcttcatgaacttgatgaacaaaatgttcatggaatttctggataagtttgtggtggtattcatcgatgacattcttatctattccaaattggaagaagaacatgagcgacatctccgtctggtactcgagaagttggaggagcaccagttatatgccaagttcagtaaatgcgacttttggctatcggaggtcaaattcttgggtcacgtcattacagctcagggcgtggcagttgatccgtcgaatgtggagtcagttaccaagtggaccccacctaagaccgtgtcacaaattcggagttttcttggacttgcgggttattaccgtcggttcattgaaaatttctccaggatcgccagacctatgactcagttgcttaagaaagatgagaaatttaaatggacagctgagtgtgacaagagttttgaggagttcaataagaaattagtatccactccagttctgattttgcccgaccagacgaaagacttccaagtctattgcaacgcgtcccgtcatgggcttggatgtgttctaatgcaagagggcagagtggtcgcttatgcctcgcggcagttgcgtccgcatgaagggaactatccgacacatgacttggagttggcagcggtggtttatgctttaaaaatctggacgcgttatctgattggcaaccgctgcgaagtatatacggaccataagagtctaaaatatatcttcacccaacctgatgtaaatctccgacagcgaagatggttggagttaatcaaggattacgacatgagcattcactatcatccgggcaaagccaatgtggtggcagatgcattaagcaggaagagctattgcaataccttatgcactgaaggcatgtgtaaggaattgcagcaggagcttgaacacctcaacttggggcttgtagaatacgggtacgtggctgccctagaggcacgacctacgctcgtggatcaagtcagagcagctcaagtaaatgatcctgaaatagcggatatgaaaaagaatatgagggtcggaaaagcccgggatttccacgaagatgaacatggcacaatctggttgggagaaagattgtgcgtacctgacgacaaggaactaaaggatctgatactcaccgaggctcatcagactcagtactccattcatccaggcaacaccaaaatgtaacaagacctcaaagaaaagttttggtgagtcagcatgagaagagaaatagctgaatttgtcgcactctgcgacgtttgccaacgagtgaaggcagagcaccaaaggccagcaggttttctacaacctcttcagatcccgaaatggaaatgggaggagattggaatggacttcataacaggactgccccggacatcatctggccacgattcaatctgggtagtcgtgaatcgactcactaaagttgcccatttcattccagtgcataccacgtatacggggaagaaattggcagagctgtacttggcaaggatcatgtgtctgcatggagtacccaagaagattgtatctgatcgagggagtcagttcacctcaaaattttggcagaagctgcagaaagaattggggacccgtttgaatttcagcacaacctaccatccgcagacagatggccaaaccgaaagggtcaatcagatcttggaagatatgctacgtgcatgtgtgctcgattttggtggagcatgggataaaagtctgccttatgcggaattctcgtacaacaacagctatcaggccagtctacagatggcaccgttcgaagcgttgtatggccggaagtgccgcacacctctctactgggatcaaacaggtgaacgtcaactgttcgcaacagaagtgttaacgaaagcagaagagaaagtcagaaccgtcagagagaggctgagaattgcccagtctcgacagaagagctacgcggacaaccgccgaagggagctcacttttgaagcaggggattatatgtatctccgtgttactccgctccggggagtgcatcgtttccagacgaagggcaagttggcaccacgcttcgtgggaccatacaaaatcttggaacaaagaggagaagtcgcctatcagctagaacttccatccaacatgatcggcatccatgtcatgttccatgtatcccagttaaagaagtgcttgagggtacccgaagaacaagccgattcggagcacattgacatccaagaagatctgacctatgtggagaagccagttcgtatccttgagaccagtgaaaggaggacaagaaacaaggtcaccaggttctgcagggttcagtggagccaccacttagaagaataagcaacctgggaaagggaaaatgggttaaaggccgcccatccgcacctcttcaccagctcttccgaatctcggggtcgagattccgtttaaggggggtaggtttgtcacaccctgaagttctttcccaagcctaaattgaagttataaatggtctcaagaaaatacaggtgtaaagcaagagtaaaccctaataaattaatgcaaataataaccggatttggcatgtgaaatttttcttgagttctacatgtcgaaatacgctaagaagatttttagtggaattttcagagctctggaaataattttaaccaattaaaattgagcacaagcaatatttaatcctaggaaaattcatttccttctttttcttttttttctttcttttctttnacccttttctctttcgaatgggccgccagcccattctctcctccctccccttcccgctgggccggccgaagg

SEQ ID NO: 72421 - DNA, 756 bp, Oryza sativa
  unsure (1)..(756): unsure at all n locations
gcgcccttgaaatgacatctacttgccgcangcctgcaggtcgactttagaggatcccctactaccgcaaaagaggtggaccagtacatattccatcccagaagaagttatccgtcaggactggctggccggtactatcaaatttataccaatacaactaagtatggaacagtacatatatactaaatatatctactgagatcggtccccataattatatcgcagtgctacaaacaaccaccaggaaccaacttgtgtggttattacgtgtgcgagatgctcaaagtaaatggaaggtacaaaacaaccagtaaccgagcaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctatgccgattcatccttcgtgatgtctgcaacgcaagaggtcttttctacgacaaccagagtgaactcacaatggacgacaaatttaaacctctcagagagtgggagaaagaacatatgcaataacatgtacactacttatacatatgcaataacatgatgaaaaaactgggccacttgctattatatattcgaatgtaaattacgattgaaaataatgggtatggattacatgtttggtactgcgggacttggcttatcttatatgcttactacttcgaaata

SEQ ID NO: 72422 - DNA, 2139 bp, Oryza sativa
ccgggactaaagatcccgggggggcttgacaggtcctgacagcattcgaaccgggactaaagatgatctttagtcccggtttgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgttcatccggtctgtgatcagtcacaaaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccatcagaaggtcattcagacggcaaccatacaaatctccgtccatttatgaaaagataggataagtccccacacaaaagagagagaggggtgcatgtggtatccccttgaaatataaaaggaggaccttgcccatagggagagcaggcttgggttgggactggaccttcccagatcgggaacccagaaggagggagaggctggctgatactttgtagctccttcatacacagatccaccaaaacacaggagtagggtattacgcttctcagcgggcccgaacctgtatacatcgctggtgtttcatgctctttcgagaggtcgcgatctttccacatatagacagagcttgggatttcaccctgagcccccggccgacccggcataggggggcctgtgcggtctcccggtgaggagcccccacactccgtcacggttggtaacacaaaccgggactaaagatcaaatatgcccgttacccttttgaaccgggactaaagatcatctttagccctggtttttattgcatccgggactattgtggaaatcggccgaccgacgaaagatggtttctccaccagtgatacatgccgatgtactagcaacgatataaatttaacatacactataaattgttgcattgcgtttgtatatcataaccagacaacacagagaggcagggggacgtagttttttgtatggctgcgaatcagttttgatatatattactatctcatataattatttgatggttggaacaatataaatggcttatgtttatatatagacaagattatcttacgattcgcacagttttttatagggagtaattttcacgcctcgtgtttttatatatggataaaaaaatactatatgaattggaaagggcatatttacggtgactctaatttacaggttaagtcatagacttatgagcattcgtatttacggctatttatccttttagtagtaagacggcgtatttgtcaacaacgagatgtccatataacttcgtcaactagtctagtttttttaatatgcttataaagatatggtgtgtgtatatgttcatatcggtaagtgtttgcgttgtactgtgtaattctaaaaaaaagtgagctaggtagcgttacgagtatattgttgggaaaattgatctctcggtttgaaagatcacgctagaccgttttccacccgttgtctacgcaaaatcagagcgatccaatctgttaattcccgattaactatgcgccgtgatcggtggcacccaatttatttctattgagtcgcccccgattccccacagtgctaaatataaaaggggaggccggcccaacagtagatgacaatctctctcggtctcaatctaaacccaatcaacattggcg

SEQ ID NO: 72423 - DNA, 1277 bp, Oryza sativa
  unsure (1)..(1277): unsure at all n locations
acgtttgatttganatcctctacnccatgcaaggagggcgactgtagaggatccccgaatcggtaacttatatcaattactcctaattgatggatggttgatggttgtgtattggaggatggatcatggctaggtgatgacaattagttgctctattcctcttcctattccatttgtaacctacatcaattactcataattgacggttggttgatggttgtctagtggaagatggttgatggctaattgatgagaattagttactctattactcttcctattccatgactcttactcttcatcttccatttctcatataaaatgagaatggatttgatcttccaaaagagaaagtgagacacactttcatccattttccaacgctgttgatgctacggtaatcccatcccgacgagtgtgtgcacacgcattgggagagtaggcctccaaaaccacgcgctgatgcgacgtttgcacggacgggcgggcgatcaggtttttgggagcgtaaggcgcgactactcactgttcgtcaacatctacttcaccttcaccaatatgtcgaacacttgagacaacggcaacactgcatacaagcagaagaaggctcccgtcaacatcaacggaggtaatgctgcctcaaactccagcggaggaccattcttggggtataaccttcttacattattcaattagaagttttactggtgatgttcatcgcaatgtcaacattgtgttattatgtgactgttgaggctaattctacatgaagcatgctcatgttgattacattcaccattatcgctggatcaaatcccattgtaaatatcatgttgattatcttgttattttgaattaaaatatgccgaattatgaccaaatttccaccagctatatggtccgcctgcgaaaatatagcatgcccgcctgcaaaattaaaaaatgcgcctgcgaagatagtacaaatatcgaaatttgtacaatattaatttctaataaatgtttttcattgattaactaatggtgcgtaatattattagaaaatacaagctttgttctgacaatctcactttattgcaaaagggaaaggttcgcaaaatattaaatttttaacatgccacttaattcgctttaattcattagggataaattgcccactccgagaatttgttattggcctgtatatggcaccttttgcacaaaatttttaacaaaaaactcccgcggagaatgtaaaatgcccctattttaagggggtgtggaaacgggccccccct

SEQ ID NO: 72424 - DNA, 2850 bp, Oryza sativa
agtttagaaaaatagcagaacactttctagaagagatatttcagtattttttcacatagtcaacagtagaaagaatgagatgcctacacgcattgtcttcaaagaaacatatattgtacccattggaaaattgatcagttactgaccagcgaattagaaactataaaatcatgctcaatcaccttgagctctctattggagaactatgtctctgcttcctcttctttttaaggattaactgaaagtaaatataaactttgggctgcgaagatgacaagaacctctattttctgtaatgctttagttttgccctgaacaatgaacaaattagcacaatggagtatattgttaatgaaactcgataaagaaaataatcagcttatcccttgtagcaaggttgggttcaccatcctgattgtgcagcagtaagtgtaatcagatcattaacaggcattgttaattcaaaatcaatatctacccttaaatcttgaaatgttcctgagccacaaaatcataattagcttcaatttggatagcatatcaacgcatcagtgctgaagggtacatagttttaccttaaaactggagagggaatgaagttcataactatctcctacaacacacatttttatttagtggtaattcatggttcttttagttcataagttgactagttgataattattaggatttactgattcatgaaatacgaacacatgaatccataaaaaacattcctaattactacccactttggtcagaaacttgtggaactttaagtatcaaaatctttttcaatatttagattggaaaataaaaaaaacatatatgtagaatactagagttttcttggtaagtttcaaccaaaatactgtatttctgcgggactctataaatattttaaaatagaatcagttgttaaggttctgtgtgggaactgtgtcaatgtccaagacaatgtttttgtctaaccatgtaatgtatttatgatcacaattttgttacatattccttataccaatcctttaatttatggctaaatatttcctgctctaacaggaacttggagggacaaccaccatgatggaaagagagaaggcttccgttcaagagttaatgactgttgtgaatgaaatgatgcgaaacacagaatttgctattaggtcatatatgatgctgagaccaagatttatccgtccaggtgctggagcaaatggtggtggctcaaatccttctggtcctgctggagctcagtccaatcagccagtagcattggcttcaaccattgatttctatagtggtatcccaaagcggccttcccattttatgcaacagactatcaacaggtttgagaaatatcttggagaatgctgcaagtggatcgcggagctagagcagcttgttcaaatggagaacaataaaaggcaatcagcctcattagaatctctaccgaaggttatgtcgaatgtgcatgattatttcatctatgttgcttctaaggtaaatctcctttttcatacacacactgcagttgaactgttaaaatgcatttattttgaggttctcccccatgatataaatcatttattatgtaatatagtcataaaaataaatgtaaatctgtaagtcaaccaaattttttttgtaacagctgtatctcgtgaaaaaaataagagagattgcttacttttaggcttgctgcactgccttggtgcgatacccagtattttctaatgtttgtattttttttaggtggaaaatcttcatcaatatgttgagtcattgaaaactgaatatctacatgagcagcggcgattgggtaatgccaatgatccatttttagaggcaaatagacgagaagcggctaaacaagaagcagctgccagaagggtacatccaacattgcatttgcctgctcctgtacagcccacaactcaaattgctggaacagtgacgagtcaaccacagcaatcattgattccttctggagcgacttcttcaagtgcttttccatcattcagcactccagcttccgctccatcttcttcaagtctcttttcaactccaacaactccaactctatccagcaacctttttggtacatctggatcagcccagctgtccacaccatttgggacagtctctactccaacgcttggatcaacgccggctccatctggatttgggaatacaactccatcttttgcttcaacgcccgctttaggtggaacctcactgttttctacgccgttcggaggtatacaaactctcaccatactatatttatatttcctaactgttagatagtcatatgcttatgataagtcagtagctatctgaaaacaatttggtacttttatgttgtgaaattctcattttagatgatctcgtcatggtatataaacatttctgaagtgttggcacatctacagtttgatttcatcatggcaattcatagctctaaatttgttgttatgtttttggtctgaactgaaatttgttattggcagcagagtacacttagttgtccattatttttccaagtgggttatatagctcaggcacacctgccgtgcatgcccttcactgtttctactcatctatggttaccgtccatattgaaattcaccagcaatattcttctttttatcctacttccaattgaacttacaaatatatcttttcctattctatacatgctatgatatcctgatttttggaaattgcatgacattctaacctgtgtctaccttaggtggagctacagcttcaggatccagctttggtggtacatctgtaagtataatctccatcaatttatgcagtattcttcccttttcagctatagca

SEQ ID NO: 72425 - DNA, 8910 bp, Oryza sativa
gaattcctgcagcccttgaaaggacagaattaatcaaaaccagtctacccccaacagacatatgttttcctttccagctgctgagttttttctctattctttgatcgataactttccaatcattattacatagctttctaaaatgcattggaataccgagatatttaactgaaaaagaccctaacttacaaccaaagatattagaatattgcttataacactcctttgcctgaccaaagcaaaataactcacttttgtgaaaattaattttcaagccagataatttctcaaagatagacaaaatcaattttaaattctttgcttgttgtaaatcatgctctaaaaaaatgatggtatcatctgcatattgcaaaatagacaaaccatcatccactaggtgagaaaccaccccatgaagagatccattatatttagctcttttaattagtaaagctagcatatcagcaactaaattaaagagaattggagatagaggatccccttgtctaagccctttatgcgtttgaaaattattaccagtttgatcattcactttaataccaacatgaccaccttgaataaaagaggcaatccactcacaccatttaggagagaagcctttcatcctcaaagtctgttgtacaaatgaccatttaaccttatcataagctttctcaaaatcgatcttaaaaattacagcacttttgtttttacgatgtaactcatgcaaagtttcatgcaaaataaccacaccttccataatatttctcccaggaataaaagcagtttgagtaggactaattaccttttgggcaacagtcatgactctatttgtagcaactttggtaaagatcttaaaactaacattaagtaagcaaataggcctatattgctggattgtcatggcctcaacacacttatgtaaaagaatgatcgtaccaaaattaagagagtataaaggtaaagtaccattatgaaattctttaaaaagatctaataagtcacattttataacattccagaaaacttgataaaattcagcaggaaatccatcaggatccggtgctttgttatgttccatttggaagatcgcctccttaatctctttttcagtaaaaacctgcgttaaagcctcattctccaattgagaaacttgaggaatgtcagcaaatttattctcatcaaactgaagagtagaatcatcaggaggcccaaataaacctttataataagtggtaatatgcgatttcaaatttgcatcaccatttattaattggtcaccatcatgtaattgaaaaattctagtctttctatgttttccatttgcaaccaaatgaaaatattttgtgttagaatcaccctctaaaatatccttagatttcgccctctgataccatttaacttcctcttctctcagaattgtagataatctatttctacaaaaccatctaaaatccaattactcctgactcaaaagcatagtttctgcctttttatctagcaaatccaacttatctaaaatctccttttttttcttttttgtacaagccactagtatgtttagaccaacccctaagatgctgtcttaaacgacgaattttcgcctgccaccgctccatggcagaattgccttcatcaacactagaccatatctcctttaccatatcaacaaagccatcacgtaaaagccaaccaagttcaaacttgaaactatgttgagcattactcaaagaagaagtgtttgtatttaaaagtaaaggagtatgatcagaaatatctctattaagagccaccacagaagataaaggaaatttatgttcccactccgtggacattaaaaccctatcaagtttctcatatgttggattcgctaaattgtttgcccaagtaaatttcctaccagacatctgtaactcccggagacataacccatcaataatagcattaaaaaggaagggccatctatcatcataattatcattattcttttcatcagggctacgtagaatattaaaatcaccaccaataagaattggtaaggtttcatgactgcacatattaactaattcagcaaggaattgatccttaaattcactttgagctggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctaggaggcttgcaatgccacaaaaattctttgccagcacacagatttttaagaatagccggactaaaatctttcttaatagtctctgacaaggcaataaaatcaaggtgatgttcctttgttaaatcagaaataaacttatgttttttcgggtccttaaacccatcacaatttcagaacaaccctttcatttaaaaatattattttttttctttccccttttagtctttttcttactattaggagaggtatctaaagaatttaaagtggtctgagaataattatcatccacagcactaaaatccatcacttcctccattaattcaccacacaaatgttgaagtagagaattatcatccacctgatcatctaatatcttactatcaacatttgaagtatgtacctgattaacagaagaactaacatatttacttaacctcttttcctctatactatttaaatcatttataacatcatctaagataaaattcgtacccaaagtgatcacaccaagattatcaagagcagcagaaatttgttcatttgtaaattgtaaaaaagaaacattatcatgaaagttaccttttgcctgcaagttgtccaaattcttatcagccttcaatttctcagctctttggagaacaagttgatcactgtcacttgcccttctcttgctcttcctggagagagaaattactgcttcaggaatagcagcgagcttttcccctagactttgctgggtattaaccttcttaaccattacagaatcctcatctaagccatcaaattcctcatcagatacattcaagccatcagattcaggtatcagactcaaatgagcagccggtatagaaggaccacccctctcactaacctgaccaccagaacctattaaggaattgttaccaggatcacctccagattccttccccaaatcctggttcagattcccctcctccttctccaaagtcccatcatccagattctccatatccattggtacaggctcgtcagacccattgtcaggctccactataaaagataattcgtacaagtggtccccaataaccacatcaaccacatctgggataaacttaaccgatcggaacttaatttagcttgtggtcaatgctctggtacaaatttctttaccccggagatgtcggccaagagcccaagacgataggcatcgtggttgcgatttgtgaatgactcagcatgagcatcataatcgtggagcaataatccaatgcgaacatgcgtaatgaagactgtacataatcgtcgtctattattatggaacagatcgatcatcgatccatcatcgcaggtggcggtgatctgatcttgccgaacaagcacgcatgccattggctcctaagaagcttttttttttcttttctgcgaacgcgtaaaaaaattacgcattaatatattaaaaaaaaaattatagttacacaacacaatcagccagactgacttataccagaagaaaaactgaagtttaaaaagctactgtagctaaacacaaacttctcccaataagctttctccaccccgatcccgtgtttgcccgttgctgcacacagagattccgcattcggcggcgatgtggtcactgcgatttggcggaagctacccggctgacccgggccggccgatcgatcagctctcgtgccgtcgcgtctccacgtcaccccgattgacaagataacataagatactggattgatattgagtggccatcgcctggagccctgtaacatgtatgattcatgcaaccagccgcatggaacaaacctgcccagctgctgctgctgccgccttgtctcggaactcgatccttggcatcatcgttctttcgccggttgcacggtgagacgatcgttcgcaatattcttcttgctggaaattggacactggacactggcactgcaatttgtgatttggttgtatcagcgagatattttaggctatcttagggcctgtttagttggtgaaatgaaaattttcggatgtcacatcggacgtttgaccggatgtcgaaaggggtttttggacacgaataaaaaaactaatttcatgactcgcctgaaaaccgtgaaacgaatctcttaagcctaattaatccgtcattagaacatgtgggttactgtagcacgtatggctaatcatggcctaattaaacttaaaagattcgtctcgcgatttacatgcaaactgtgcaattagtttttctttttatctatatttaatgtttaatatatatattcaaagattcgacgtgatgtttttaaggaactaaacatgcccttagcctattacttcactgatttgtgcatgtgcagctgattcaaatgtctaccatttgtcgtccagccgaaccctgctagtatggacctccccgggatatttagggcccatcctagtagggactcggtccatccataaaatggtccgtgctctagaaatcactgttgccaaatcagctgatcggtctgcaactgcgctacgataattcagtctccacatggccccacatgtcagccctaaggattagagcatgtacaatagcagactattagctagctacaaacatattttaatgagataaatgatgagagagaagagcagcgtgctataaaactatagccagctgcagcacagactctaagacacaatatatataggataggtgggaccatgtattaataatatagtaagtaattattgtatgaattggatattagattggctatagatgaattggagttagtagtgggctatactattaaacttgctcttaggctgtgtttagtttcacgccaaaattagaaatttgaagaaattaaaacgatgcgatagaaaagtcgaaaatttatgtgtgtaaaaaagttcaatataaaagacaagtttgaagtttgaagaaaaaaaattggaaactaaacgggcccttacacgcccacgcgcccccacaagccgaaaccgcctcaacccaacgtccccaccgcaacctcccccacatgtcagcgtacgtggactggggtccccgtctcaataaacccccgcgcccacgcccacctcgcctcctccgaccaatccgcgcctctgccagcttgtcgcgacgcgcgctcccccgccttcctatttcacccccctcctccgcctccgcgccactccaacccaatcccagccatcaatacctgcctccgcttcgccatctctcccgaagcctcctctctctctctctctccccccgattccaccacacgcaatccaattccaacctcgtgtgcttccacttgtgcgtttcgcccgctgctgtgaacgtactgcgagatggcagcggcggcggcggcggcggaggcgaagcaccggaaggaggaggaggaggacgaggaggagatgacgctggaggacggcgacatcgaggagagcccgcgccgcagcttcgacgacgactacgaggacggcgggagcggcgacgacgaccgggatgacgacggcgaaggtttgggatcgcctcgctcgttccagtcccgccagtggccgcagagctaccggtacgtcgttgcattctccgcttcatcctcctcctcgtttactgcgttgtttttgtttttggtggtggtgatggttcatggtagttctatcgatttcaaccgctgtttgtgaaatctcatgttgatgggtagatttcgttgaattgtactggacggaataacttgtgagtttcgtgatgggactggactgagcgcttgttcggataatactagattgatcgttgacgtgtttggttgggatagttcgggcaaacagttcatgtttgatccgagtggcctggattctagaatttaccagcactcgtagaacatctgattgattcgacagtgctccgacagcacgggtctgaaaccgcaacgtgcgcggtcgcaatcactgttcgatcgcctcctcgctcgtactacagccgtgcagacatcgtttgatctgtctgctgtactgcgttcaattagtgcttagtgggggcggtttgctctggtggggtttctctggcagtttccactgttgcttgtgaaaattgtatgttgacggggacccggttgtgttttcaatttcctgatgattgggatgggatattgttgcgctagttctgatactactaactttgaccattaacactatctaactctgctggtggtaaactgtgcttgctgtgtccccaggttgggatgtggggtggaattcctctcattttgcttaagaaacacagtgctatggtctataaaaaattcacagcctgagtgctgtaatctcctttcctttctcttgttttagcagagtactactgttgcatttctgataatagaaatgggggctttcaagccctagttcaaaaaaaaaaaaacctctgctggtggtaaactattaacgtacaaaatcattttatggctgcactctttgtttgatcgactcctcgtgcagacatcgtttgatttgtgtgctctactgcgccatggttagtggtggtgttgctctgccaattccaactgttgttagtgaaagttctgtgctgatgtggacttggttgctttcattaacactgactctgatcatggtaaactaatatgtacaaaatcatttttgctttgtcgatcaggggattgtttgtactgacacatcgtatagttgtttttggttgtctcaaaaaaattaagacaagggctttgctggcaatctaatacccaagcttgatgaatgccagctgttaaaccacatgttttgttttcttcccaaccgttatgtgcaaacattatgatggtgatatgctgtttgttttgcagagaaacaactgacacctatacaattgctgcatctccgagctttggttacttgggtccctctacaagcaaatactcgatccttgatggtggtcgtagtagtctgggatccgacctgaagttgcccttgttgtctgataagctagatgggaagcaagactctgtcaagagcttgagaaagactcttggttcagcaatagataggaaaagctcgttacttacgcaacatactggagaagtctacatcgctcaaggatgcagtgtgacacagacggtgttcaatggtactatcattaacatgttagattgctcaattacctgcctaagataaaagaaatgcttaatgttttacttgttcttttggtaggggttaatgtacttgctggtgttggacttctttccactccatttacaattcatgaagctggatgggtaggccttgcggtcctagctatgtttgctattgtttgctgttatactggagttctgatgaaacactgttttgagagcaaagatggtatttctacatatccagacattggcgaggctgcttttggaaggattggtcgtctgctgatctctgtaagtcctggtttctttcctatcaagtgaattgtattgcattgcatgcaagattgcatccgaatatctcagcaccaatcaaagtcatttttaataatctgtggattttcattaaattaaaagaatgacaatctgtagaaacttctattcctttttttttttgcaatgtaagaacaaccattgatggtaataaacgaaataattcgtgcaagtgtatcaaagagtaagactaacctggacaatggagacacgaccactgtgcaggctgtattagttttctattttgtataaccttgcttgtatgcgattattgatgatatgatccatgcttatgaaaagcgctctcttaaggttcagtaactggtagaaacacctgcctgctcaagctctggattttctttttccttttctaaaatgctgactcccactaaaaaggagtgcatatggcatatttgtaaactataaaatatggcatttcaatgtttgatacctcatgactgatgaaatgcatattatattgatctttatcagacttttttgtgcaactaattttaacttctggtagagaagaaacaatggctgattctttttctttaatgtttttgcagattatactctatactgagctatatgtaagtagctttcacctggctttatgttgcaaagttttccatctaatcctatatagttcatccccactaagtgtagttaatgctatttctctcttctctcattaaaccacatcacctcaattatttttagcctttagatgatacatctatggttcaaattgtctcttcttcttctctcataaaactatgcaatcttaattatttttaggctcaaaattgtaccaatttgttttagttttgatcatattacatattatttgtacatattatataacttaattttccgtagcaatgcggcggggtattcatctagttatttttattgatcaatccaactgagcactcttttatcttattcaatcctttctaaaaaaaatattatcttatatatgttattcattggatgcagtcatattgtgtggaattcattattttggaaggagataatatgacatcaattttctctcatattggttttgattggcttggcgtccatattgatgggaaacatttctttggagtgttgactgctctaatagtcttgcctacagtatggttgagagatcttcgggttctctcctacctttctggtctcaacactcttaacc

SEQ ID NO: 72426 - DNA, 3707 bp, Oryza sativa
ttttttttggacggagaggatggattctttcagtcatatgaatacagatccctttattccaaatcatgttactgcaaggaagaaactcactcgctgttccatctgaaaattaataaactactggatttgctttccataccgagctatgaggtgtcctgcccaatcactgaaacccccaactccttcgaccgtgacagtggaagtttcagagaagcatccaagctaaccacatgtagaaataggtcagcattagccatattcttttaggtgcaggaggcgattatttcagtggcgttaagctgcttgtgctgtcgcaaaccacaggggatgaacggagacggttccacggcgtcgttcgatggcaacagcaggcagggacacagctcgtccattttgacttttttgattgctttggagtacggtcttgttttctcaatcgatagatcaaataaaatccctatcaggcaagcgccggtgtttttaacctaattgcattctgaagtcagtctctaggctccagtccaccgcagggtttacaatattgatgataactgcttagttgttgcggttatttcgagttatgaacgtataaccaaaaaattgatagtattaaaaatggtaaaatatcttaatatgtgtggtaaatatcagtttacagtactaatgatagccacgtgtttattgcggttattctgacctgttgaccgaaaacgtatgggtaaaaatttgatagtattcaatagaattattatgtaaagatatcttattgtcgttggtaaatatttattgtcccactctttacctttaagcgcaactcatttttaaataaaattttggtaaaaaggatgtagctatgcaccacactcttcggcttgcgtcaatattctacatttcacctaaatttattgtgcatactcaacgtctcccttctcatacgcccctcttaaccgtaaccccgttttcgtagggcattgatggtactccaatctatcatccaaattacttcatgacacatgaaactaacagaagcaccttatcgtattcacttcgtttttttacaagccaaccacagtgccatcaccactcaactaatttatctttattctgttttttttattttcaaaaattatccggtaaatccatttccaattttctcgaatatgtaaaagaactccaaaatcatttctccaaagttcaagggcctctggcctccacctcaccaaacgccgaaacggtgaggtgaacaaccacgcgtctataaaaaacacttgtctcctccgccttccaccttctctcttttgtactcgctttcgcagctcctcttccccggcttctccgttgaccgccaccggtgacctccccgccggggaggtctccctcgccggaaacccccccgcctcccaccttgtcttcgcggcggcgttctcccgtcatctgatcggccggcgcctttggtcttcgactgcttccgggggctactcgattcggttcctcttgatcccgctacggcttctcttgttgctcgccatggcgaaccgaatcacggtgtcctactccggctacgtggcgcaaagcctcgccgcgtcgctcggcctgcgctgctcctccgcctccacggcggcgggctaccgcttcttccaggacggcgggtggcgccccttatgcatgctcacctccttctcccccgggcacgccgagcaccaccggaacggcggtgggggcggcgaacaccgccgtgaagccggggaagggcgaccgcccgaaggccctgccgctttccgccgccgcagggggccactcgctgttcctctcgccggcgtacgcttcgtccagggcgcagccgccttcgctgcccgtgggtttgctgtcggtgctcgcgcagggggcgacggggtcgaagggtgggatctacggcgccgcgtctctgtcgggctcgtcgtcgtcgatctctctcgggttcaaccctgcctccttcctccctttcctgcagacctagaagtggctcccctgcagcgaccttgccacctcctcgtctgcgccgccgtcttctccttctccttctcctcctcctcccgcaccggcgccttcgattcgtcccaagaaggcgttggtgagtagtgcttccagctccccggcgattgcgaggagcagtggtggtagtggtgccgcgatgagcaggagcaactggttgtcgaggtggatgagctcctgctccgacgacaccaagacggccttcgcagcggtgactgtgcctctgctctacagctcgtcgctggccgagccgaggtccatcccgtccaagtccatgtacccgaccttcgatgttggtgaccggattctcgccgagaaggtagagcttgttgaaattggtgtttagtttggtaatcttgtcttgctgtgctatgttttgtgagtgtctaattctatgatgatcttcaggtctcgtacatattccgggagccggaaatcttggacattgtgatcttccgtgcaccaccagctcttcaggtataatttctgatttctataacatgttttttcacatacttcataatgatcttgatgtaaatgtgatgattgaattggaatgctactgcaggattggggctacagctcgggtgatgttttcatcaagagagttgtggccaaggcaggcgactatgtcgaagtaagcatttacctcaatggtagtggcgtctgtttgtctgtgttactaacttgctatgctgcaaaatgtttgtattggttgggttataattgctgctctctttgttctttgataggttcgtgatggcaagttgattgtcaacggagtagtccaggatgaggaatttgtgttggagcctcacaattacgagatggaacccatggtatgtgtcttcttcctatgctaaattgtgtgcatctttccatgattatactcatttcgatcttgcatagtagtactctagattgagcagattcttattgaaatgtttgatttttatcactggagtaaactaatgtgaaatttgacaatcaaaatgtagaattttagattgcacacttgagtaatcaaagtatcaatttagctgcatttccagagtgactgatctcctggaccagtgttgagttcacatattagtataccataatatccaatcgagtattatatatttcttaggtttattaattagcatttgtaattcgtttggcatattggttcatcaaatgcagttttagcaatataatccttctgttttcagttgattaatagctcattattgttcctgcagcttgttccagaaggttatgtgtttgtgctgggagacaaccgtaacaacagcttcgattcccataactggtatggtcaaaactaaactcaaatctgcatcagaagctttcatctcatagaatatgctagatctgattcgaatcaaatctgacatttcagggggcctcttcctgtgaggaacattattggaagatctgtgtttcggtactggcctccatcaagaataacagatacaatatacgagcctcgcgctgaatattctgtggctgggttgtcgtgaggtgtatccagaccttctggccatgctggatagccgatgtgtcatactcttttgtggagctccacttatgagccgagctccagttcacagctctcactggtggttatagaggggttggaaattcactttggctgaccaatttggtttttcaac

SEQ ID NO: 72427 - DNA, 4855 bp, Oryza sativa
  unsure (1)..(4855): unsure at all n locations
tagcgccgcccgcgccgccgccttcctccgccaccggccggtcgccgccggttgccgccttgcgccgccgctgcgtcgagccacgccgccgcgtgccatgggcgccgggccggcttgagccgagcccgtgcgcgccggccgcgagccgcctcccccgtccgatctaccgggcggtagattggggccgcccgttccgtcgcccgcgtggtcgcccgcgtggctgccatgttggtgccgcgtccgcaccacttgtgcgccacgtggtgcgccgcccccttcccggtccgtggacccggtccatcgcggaccactaccccgagtcactgccatgtggggtccgcatgtcggcgccgccccctgtctctccagggtttaaattattgcgcaataaatcatttagggcttttctgtttatactaaaatcgtagtgaatcttctaaaattcattgaaaattcatccgtgcttcgtttaagcccattcaagtctcagtaaatcaagaaaaatgcatagaatccattaaaaatggttttgttctctgtttcagtagtcttatggcctgtttgtattgtttgctttgtatgtcgcttagattccggctctcccgacgctccggtgtactttgaaatagtcgccaaggttcctccagctgcagagcaaggcaagtcatgcttgtcacttgaacatgttgatcctatattgcaaatgccctattgtttcccttaaatactgcattgttttacaatgttactatgggatgtttacctactgttacagccatgctatttttgtaccatgctcctttgttagcttgggatataacatgactagatattggactagggattgcttagccattcaactagcacacaatgggggaatcacattaatgcatagacttcaggttatgttggattagagccatcgtctttgtgttggtcaattaaaatataccatatggtgtgctgtgggtgcgtggttttgctggtcgcgcccatggctcttaaggaccggttcgcgggatgccctggaagaacttatcatacttaccactagccagcgtgggcaacagctgggcctgtagtgtagctttcctctagctgatgcatccaggcaagggtgggcgtgatggagtttggatgggccctacggcggcctatgcggcttccggattcacctaggcatgagaggggactgcccgctgccttgcgaggagtggcggtgaaacctgaggtgtgttgtgcttggttagagggggttatgcgaagggtcctgtcacggcctctttccggtctgtcgtggtggcatgtcagcgcacaaaaacgtgtcgtggggctgtgtcttgtgggtacagttatacacctctgattagagtagaactattcgaatagccgtgcccgcagttatgggcgatcaaccagattcgccgtgattagtctcaccctagtttagtctaatggaattgattagttcaggtggatggttgggcctgttgcaacgtggtgtagcgttggacagtggatggttaatattgattaattattacaactgttttactgctttcaactactgtttataaatgctcgctttatgcaaatgaaccgctctagctatcctttgattataccctgcatcatacccctattccggtatgacttgctgagtacggtggttgtactcagtcttgctctattttccccaaaaccccagagtttgagtatgcgtcagatggtggcttttccgaggagtaggcttcgtccgtgccgtcgaggatgcatgtagagtggtgttcccgctgcagttcaagtcaaggcttagctccagttatcctttatttttccgttgcatttatgtaagacttttataatgtttgtaagatgtggatctgtatgtcaactttgtcgtttgtgtaccccggccggtactggatgggggttttaatgcacattctgcttggaattctattcgggaatttctgggcgtgacaattccacaagttgctgcttatatatgttgattactaatagataacctctcaccacgtgaaggtggcgtcgggcatggccattccaatggacccttcagggacttaccactgcaggccgattccagcaggatactccaaggttgaagttgagttggtggaagccgcatacgaggacctcgagttggactaccctggagaaaacggtgagatacatctacgagacacaagccacgctattatactatggtgcaagtggtacatcatcctccctgggcgacaagcggtgtctcgtgcaccatctccttcggctccgccatctcctcctcaggctagtgcaccgtctcctccccatgctccagcaagcaatttcccttaggcaagatccttctcggctacttgtatcaaacactgaacaacgcgtcggccaagattgttgtcggctcaattgtcaatgcaggcgagccatggtggttgttgcaaacttggctaaatctagtagtcatgaaaactgtcaatcggccatccgtgacagaagctgaatttccaagattaaagccgattacagatgatgatgaagaagagcgcacctaccacaggtgcatgtcctatggggaatatgcatccacaccagccgatgcaggagcaaagttatcggctgagctgctcaaggactggttctgcagcttttatgaaggcttccagaaagatgcccgtgtttggttcttctatgaagattcatcacttctggaaaatccatcggacttcagatttgaagacattaaccataaaagataccaaaagtccaggtaagttttctcaactacaatcagcccatgcatcttacccgttggcatccaccaagggagaaacattccagtctcctacgaattctaccatccaatgagttcagctagacaacttggaatgggccaactcccaatcgacttattctttgccaacaagattcagtaccgaggaaaaatctcatcaactctgatgatggatcggctactcaacatcccaggacctcccttgggcagtattgagaacatagagctggcaaggttcaggagtaagaactttgacagatggtggggtgaatggtaacaatatatcttccatcaaccagcttctatgtacatgacagaactgttccccgatgttattccttaggtaaatctttactttatcaatcttacttgaacaattgatagccgacttgaaccttgactaatcttttcttctgacctacagacaatagaatcctctcctcctcaccagagtaacaatggcaaggatattgaatacgctcctggattaatcccaaatggaggtgtaccatcccttcctgtcatcggctataatgcccccaggtcttcaactcttcttcaagggctcatcagagaaccagccgatgctggcaagaagagaaaaaccagatcatcggctatggacacatcagctccggctcccaagaagaaaaccaaattaaggaaaactaagccagctgatgatctgcctgccctagatccatggaacacattatggactcctgccaaagattgaggtaactccaactgataagcaacctctcctcttctactgacgatcttataaggtcccacaaaacgcggtgccaattttcctttggtgtgaaaacgatgaactcctcgaagaggcgtgacacgaaggtacacataatctccttcgtcaaaacatagatctctacgacgatagtcggcataactcttatgacaagatggaccacacgcaatctttcttgaatgattntcaccttttcttctgcttcccttaggatatcagtcccgaaaacctgggacgttctccgttgatcccacaaaagcggagtgcggcacttccgaccatacagtgcttcgtaaggagccatctgaagactagcttaataactgttgttgtacgaaaattcagcataagggtagattcttatccaacttccaccgaaatctaaagcacaagccctcaacatgtcttccanaatttgattcaccctttcggtttgtccgtctgtctgcggatgataagcagtactaaagttcagcttagaacccatctcttcctgaagcttcttccaaaaatttgaagtaaactggctgcctcgatcagacactattttcttagcaacgccatgcaaacacacaatccttgccatatacaattccgccaaccgacttccagaatatgttgtctttactgggatgaaacgagccactttggtaagtctgtcgactatcacccaaatagagtcatggcctgatgacgttctgggtagaccagtgatgaaatccataccgatttcttcccatttccattcaggctgcaacaaaccggcatgtttctgatgttctgccttgactcgctgacaaatatcacatactgctacgtattctgcgatttcacgcttcatacttgcccaccaaaatctttccttgagatcctggtacatcttggtactaccagggtgaatggagtataaagtatcatgagcttctttcaaaattgcatcttttaaatctttgttgtcggggacacagattctctcacccaaccatacagttccttgctcatcttccaagaaaccgatagcttttcctcttctcatattctttttgatttctagaatatcaggatcattaatttgggcttccctaacttgatcaattagagtgggcttcgcttctaaggctgcaacgaaacctctactgacaatccccaaatttaatctttcaaattccttgcataactgcaatggcagacttgggtttccccgggcgttttcttcgtacattgaatagcctttctgctagagcgttgtacaacattagcctttc

SEQ ID NO: 72428 - DNA, 4148 bp, Oryza sativa
gatctatgattgtttcttgtgggtctcattttactggaattatttcatatgcttgtcgaaatagccgcttcctttaagctgtactgttgcttagttgctgctgttgctgtaatctgtccggcccgaaaggctttctgaaaccatgaacctttaacatcaatatatattgaaaatgatactatgtttgctttgtattgaaaatggtactgtgtttttgtattgaaaatgttactgggtttttctataaagtgaatcaaacttaaataattttaaccttataaaaaggtaaagctttctataatatgaaatatactaaagtgcatagatttaagacgggtagaccaaaaccgaaagaagtcaagaatcatgattgatccaatcccggaagaactgattgcaatctcgacggatccaaaacagggatgagcttgcaaaatttacgaccgcgagcaatggtagcgacccacagtttcaccttccctccatcccaaatcttattccagccccatcttttcgcttgtgcttatgcttattagccaactttaaattttcaatattaaaattagagtttgaccttaaagttttctcatctaagtttattatgtagcctttacttttagatacttaagaacacgtatataaaaattttactcacaaagtatttttccgttacaaatataccgctggtttattcagccaaacaatgagtccgaaggcggcggaactcgccggtggtggtgccgcttcgcgccgccgcggcacgacgtgtcgacgtcgccttcgccctccttctccactcacccgacagaccacaccgcaccaccaccactcgtcaaccccgatccactcgatctctctcaccatcctgtggcccaagagaagaaaaagcaccggcgaacattggacggcatgaggcagatcgagctttcgatgccaacaaaacaaacaccaaacttttttcgagctgaaaacacaaagggggagaaaggccaacaaagttgtgacctgatgaaaagagtggagggctctcgtctcagttcggcaaaaggaaaggctggagactgaaaaagatggcgggaattgacatggagccaactgggaatccacgaaggcacgaacggaatggatgccagtagcgccactaagagcaggtacaatagcagaagccagttgcaaatatattttaaggaggataatgaggagagagaagagcagtgggctataaatttgtagctagatgtagcacggactccaagacgcagtgtatatatgacaagtgagactaggtattaataatgtagtatgtaactattgtataaataagctattagtagattggctataaatgaattggagttagtagttgactatactattaaacttgctttaaatataccaccagccgcaaaagttggtgaatgtagtattctgagcctgtgttcagtagcaacagaattggctatctttatgactcctttgttgcaccttatagtttagtgtgttaactttacagatttagcacataccaggatcttttctcctgtcgttacattttgcttaatccagtcatccagataatcacaccctcctaaaacgctactcctagctacaactttgtttatttctgggagtgctaagtttcgttcacgtttcattgcaatctgaaacagtaatacgcaaggaatacctggatcatacgatacgaatatctagagacaaaacatgatttgagtgattgatgatcgagaaagaagctcaaaaggtcttgaaaagtcgaaacgtccatcactgaaattcggtttcatgccctcagatcccattgctgagtaggacgcagattttcttccttcctaccatttcctttctcttgcttcctttttggtcatttgagatagctttatccatcctttagcaaaaaggaaaccaatagctagcaatacttgccatcatatatacctgggcaatggccggccaagcaaactcagttctctacattgaacacttcaggtttgagtagacatggcctctcggtgtcttgttaccacaggttttgaggatgagtgcagagagatccatgatgcgtgcaaccagccacgccgtttgagcgttctcttggctcatcggagcccatcggagaggcagaaaatcaaggcgacttaccgtacagtgttcggcgaagatctcgccggagaagtgcagaaaatcctcatggtcaaccaggaagatgaggtaagtgccctctcggttttgcactccttgcttcagactgattttcaagttcttacctctccatgatctttcccttcccagctctgcaagctgctctacctgtgggtgctcgacccgtcggagcgcgacgcgatcatggctcgggacgccgtcgagaatggcggcgccacggattaccgggtcctggtggagatcttcacacgccggaagcagaaccagctcttcttcaccaatcaggcataccttgccaggttcaagaagaacctggagcaggacatggtcacagagccgtctcatccttaccagagggtagcccttgcttgttgcttaccattctacctcagtttccaattgtgttctttaccttttagccagctgagctcaactcctcccctgctttctggtgacaattcaagcagctattggtagcacttgcaacctcccacaagtcgcaccacgatgaacttagtcggcacattgcaaaatgtgacgccaggaggctctatgatgcgaagaacagcggcatgggatcggtcgacgaggctgtcattcttgagatgttcagcaagaggagcatcccacagctcaggctagcattctgcagttacaagcacatatatgggcatgactacaccaaggtaagcaaactcaataacctgatggcattcacttcgcatacaacattactgaaatgactgccttcggacgttatcttgaaacaatctgccaaactactgaaatgatgactgttttctgagcttatcgttgcaacaatgcgtatgcaggcactgaagaaaaatggcttcggtgagtttgaacaatctttgagggttgttgtgaagtgcatctacaatccttccatgtatttctccaaggtgatggcagctgaaaatttgcagtttgtagttggtacttcatatcatgtctctgacccatccttctatttctttgtctcgtcagctgctgcatagaagtctgcaatgctcagcgaccaataaaaggttggttacaagggctattttgggcagtgacgatgtcgatatggacaagatcaagtcagtgttcaaaagtagttatggaaggaccttgaggatttcatccttgaaagcttgcctgagaatgattacagagactttcttttaggtgcggccaaggggtcaagggcctcatgaagtctgtggagagagatccttgaattatctagggaaagtaaagggtgcatatactgctttgcatgtaagagcaaattgaccatcaaaaacagcagttttatgttatctgagaataggatttaggtgagaacatcatgctcattttgtttattttgggtgaaaaaagttatcagttcaactaaacaattgttttgacatttgtgatggcaaaatagccaagccttatcttcaatagataaaacatagaagtagggtacgcatgttttggtggactacgttacagatataatttcagatgagcttcttctttcggaagtactgttgtagatgccaaagttgcaaaactgagactataatgcaaacaatgagtgatatgatgctcaaccatgtagccctagcattcgtcttctcactggtatctctcatatttgcttctctgcattgagaacaaccttttaagactatttatgcccttagttatcgatcaaattaaaatccatggatagctctttgagctacaaaaggaagtgtacttacttggatctcagcaagagcaggttttcatgtattgcttggacagaggtttcaagcttgactaattctagttcaactccctgttcaggaatgttgttgttaaggaggaataacaccaaaatgcagaacataagcataatatcctaatttcatgaacattacctcgagcttttcctttttagcaacagaatcccaatcttttgttgcaatgcc

SEQ ID NO: 72429 - DNA, 24175 bp, Oryza sativa
acctaacctcacctgatcgatcaaccaaactaaccgcaccaagccagcaaccactcgagcactcgcggctaaacctataacaaaccggcgcccccgtagcgtagctatacggcgtacaccacgcgcgcggagttgcagacatgagagcctactcggcgacggcggccgcggcggcggtggcgtcgctgccgtcggccgcgccgccgctgactcccgacgcggcggcggtgctgtcacgcgccgcggcggacgcgtcgaggcggcggcacgcgcacaccacgccgctgcacgcggcggccgcgctgctgtccggcccggcgccgctgctccgcgacgcctgcgtggcgggcctcgcgtcgccgcacccgctccggtgccgcgcgctcgacctctgcttcgccgtcgcgctcgaccgcctcccgacgtccacggagcaccagcaccaccacgcggcgccgccgctctccaacgcgctcgccgccgcgctcaagcgggcgtacgcgcaccaccgccgcatcggcagcggcgtggtcgaggcggacgaccaccgcgtcggcgtgccgcacctcgtgctcgccatcctcgacgacccctccgtcgcccgcgtcatgcgcgaggcatccttctccagcaccgccgtcaaggccgccatgctgcgctccctctccgaccccgccgcccccgactccggcgtctacgtcaacgccagagtgctgcaccggcaggtgtcccaccgggaggaggaggtgaacaaggtggtggaagttctcaagcggggcaagaagcgcaacccggtgctcgtcggcgacacggtggacgtggacgccgtggtacaagaggttgtcaccatgatacagaggcaacggctcggcaatgcgcgagtcatctccttccagagagaattcggcgacctggtcgatctcgacagggcggagctcgccgccaagatcaaggagctcggcgaggcgataagatcggagctactctcgccggcgtccaggagcgccggcgtcgtcgtcaacctcggcaacctgcagtggctcgtcgaggagagatgcgtggcccccggcgagcaagagaagcggagggacgtggtgctcgacacggcgcgcgccgccgtggccgagatggcgcgcatcctgaggcagtccggcgagcgcgagcaccgcgtctgggtgatcggcacggcgacgtgcgccacgtatctcaagtgccaggtgtaccacccgtcgctggagagcgagtgggacctccaggccgtgcccatcacgccgcgaccgccgccgccgccgccgtcatcgctcggcctctcgccgaggtttgcatccgtgacaaacacagcatactgcctccatcatcaacctcgcctttttttccacgacgataacgatgtgtttgtgttctctttgtgttttacagtgttaatggagttaacagaggcatcctgagcagctcggtggaggtgttgtcatcggcgatgaccaccagtgcaatgcaaagcaggtcgccgagcctgtgcagcgcctgcctcgacggctacgagcgcgagcgcgccgacatggcgtcgtcgccgggctgcggcgcgctccatgccacggagcagcccatgtcgcagtggctgcagatcgggacgccgagcagcgcacggccaccgttcgaccgcgcgcaggttggttcggtttggtttttttgccgcgcacgacaacgacaaactaagccgcgtcgtgttccgtcgccgtgagcagcgcattgacgtgcggaatctctctctctgtgtctgtcgctttgcaggacaaggcgcgggaggctgacgagctgcgacgtcggtggctcgaccggtgcgcgcagctgcactcccacggcggcggcggctgcggcggtggccggccgtcgtcgatggtcacttgctcggaatggaacggcgcaagcgtcctcgccaacatgcaggctataccagtaaggccgccgccaccggcggccgcggcggcgcctgccgccgcggtggacaccgacctcgcgcttgggccggcggcatcaacggcgtcgaggccaccggcgtactgtgacaccgacgagaagctgctcgtgaaacggctcacggaggcggtgcgatggcaacccgaggctgctgccgctgttgccgctgcgatcacgaaggccaggtccggcgagcggaagcggcgtggcatggggcccaccagggccgacacgtgggtcctcttctccggccatgacgtggccgggaagacgaagatggcggaggcgctgtccatgtcggtctttggcacgaacgccgtcgcgctgcgcctcgccggcaacggcggcgagcccatcgcgtcgtgccgcggccggacggcgctggactgtgtggccgacgccatacgtgccaacccgctgcgtgtcatcgtgctcgacggattcgaccaccacgacgacgacagagtcgtgcaggcgtccatactacgcgccgtcgagtccggccgcctcgtggactcgcgcggccgggacgtcgccctcggcgaagccatcttcgtcgtcatgtcgctggacgacacgaggcggtgccaagaggatcatcagttcaccgactcgccatggaaccttgagctccgagtccggaacaacgcacggaagcggaggccggagccgcagccgctcgacggcgccggcgaccggcggttgaaaccgcgcaaagactcgcctccgcttcaccttgacctgaacctgtccatgtgcgaggatcacaccgacgacgacgacagcggcggcgaggaatcccggaactcgtccagtgacctaacggtggagcacgagcaggagtacggccaacccgccgctgccgccgccaagttctcggctccgtcgagcttctccgagctcaccaaagccgtggatgcaacggtggtgttcaagcccgtcgacttcgggccgctcaaacggagcgtctccgacgtggtctcggcgaagctcggggacgccgccggcgccggcgccggtttgtccgtacacgtcgacgacggcgtgctggacaggctggccggcgcggcgtggacggcgggagagtcagccacgtcgttggaggcgtgggccgacgaggtgctgtgccctaccatacggcagctgaaacgtagcttgagcgccaacgatgtcgacggcgcgacgacggtgagcttgtcggcggtggaaggcagcggcggccgccggaggaaggacggcgaggtgttcccgacgtcggtgaccgtcgccgtcgacggaaactgatgacgcagtccacctggcatgcatgcacgtgtttactctttttttttgggttaaattggtcatcaatatgatcatcatcattttgtacattagtacatgtaaatgttcagctgtcagaagttagagatgtacggggctaggaaggagtagttgttttgataatcacattttggattcatttcaacaagacaagcatgcatgggtcccttaatatttgccggtccttattatcattgacctaccaactatgcatgcatggaccaaagagtgtcatcttgtagctagcagtcgttcgtgacgtttagtcagcaacctaatgaattggaacaaagacgtttcggcgtgcatttttggtgatttcttaactagttaaatgatggaggatacatcaatatatatatatatatatatatgcaatatttcaaggttaaggatttgataagtactgttatattggggtaatggcatgtatatgtagggggcatgtagtaacgaccctaacgtattacacgtcactctaggtttggttattcacagcgttttgccatcttttgcaattttttcttgcacaaaccaccttaaccacctgcaaactgacacgacatttcatgttaaaaacctatccagatactgcatatcagtagagcccaagtcccatgcatgcaatgtacagtcatatactggctagtatttgatgattgcctgtacgaatgcaggcaatgctaacagagctcttacacataaggttcacaacccatacagtcccatgtacgaactagcctgtttatacacactcctactacctgccatggactcactgaatacatgccaaatgcaagtcctgtacacctctgcacacatacacagtgacacagacacacacacacagatcgatcgagcccaatgctttctgcaggacatttctgaatcctagctaaaacgagtgcaagcaagaagcaactgtatgccatgcatgccagtagtacattacatacaacctatcagcagctggtaaaaaaaaaaattcagtagccgcccgaggtagaaagagagaggagctaggtagatcatcaaaggtggtcaaaaaagggcatgtcccgcgtatgcgatgccgtctcggatgccggcaaggacgacgacgacgaagacgtcgtccgaaaagaagctaagctaggcagtgtatgctatgttgtacgtatgcagcagcagcaagcagagctagcgcacgccggccggtagctgccgccgctttagccaaaaagacgcgagttgatccaaaaaaatgaggaaaagtaactgcggcgagaccatgccgtaactaatcaccttttaaccccgcccgggttaatctattgttcggtagtacatctgccataatcagcttggagaggactactaggatttttacagtttcacacccatcttcctctcttgtcgtcagtgaacccggtcgtacggctggaatatttggctttgtgcgtatataggagtacgtcttttcatggaagatactgctgtatcacgctcgattcttcagtttcttgattgatcagagcaacccagcagaaattctaccccagatttaattttcatgatgattagtacatacctccatgattgactaatcttcataagggcatttctatcttaattaggaaagagaatgcagcgataatcatattattgctggggagttgtatttggttaagtgcttcagggtaattaaaactcctgtttagttaattaatttaatcatgtacccactgaccaatgttatcctctaggaatgcatgcacacacaagaataagtatgtcgttacaatatgatatcttgcagtacatttcgttctcgtgaggtgaaatggaagggaatagatggaatgatgatttgtcgccgtgccaaaattcccctctggtaaagagagcagttggtaattaattagctaacagtagttagtgatcactagtagacgcctgagacaaaatggttgcatgtttagggataagggccagaggacaaatgcactgaaagctaaagtttcgttataactactctctgctacggcctctgaagtctgaaagtgcatgtattaattaagaaaagctctcagctcagctggcccatttgccatcttctgcgtatcgtctactgtacatctattaaccagtaaataatatgtgaaatcatgctcgcataatcaaaaaccaactctataaagtgtctactgaatgctgataaagtactagtataattaagctggagggtgttgtggtaaccagtttcagagcataattcccaataaactaagacacaaatggtaaattgtgatcatttgttaggacatatcactacaacaaatatggtcttttaggacgaaaagttattgtgaagcaatgcaaagttattgccaacaaatctctgaatcaagatagtgacgtgctggtaaacttgtatctttctgaaagtctcaaagaatcagtcaccataagcttatcccttggtagtaggtgcaatgagctctgagtgggaggagaatagatggacagacaagcattgcagcaggagcagcagcaaagtggatcgatagctagatgccagggacaaaattgctgcatgtttagggataagggccagaggacaaaatagcggcacgttaagcaggtaactaccttagctagagcttagcttttctttgcctttgccattgccaatgcaacccagcatctcactgcagcagtgtgggggggctcactgggagtgggagataaagtggtaaattatacccctccctgctttggtggtttggccacagcttatgaactatagcagctgagttagcagaacagatagaggagaaagaatcaaagacgaagctgcaacactgcattgcactgcactgcactactgcagccatcctccacgcactccgtttcaatttctgcgccatcaaagtccgagccggtgctgctgcactggcatgggcaacggcagctttgcttcttaattttccactgcttgcccccacaggattcagtgccatgccattgccaatttaccatgcattgcctggccccaaaatgttgtggttggtaggatcgagtcgcaacgattagcagcagacttacttccttctaaaaatgaataaaacaacttctctctgtaaatcttgatgtactatctctatttcaaaatataaacttttgaacgaataagacatacgcattacttatatatgtcccatctctcaaagacaaagttaaggtttttgacaggtacttatcaaaatttttagtgtgtatattcatacctacgtagagatatcaaaattcccaataaaagatgtgatacctcccgatatgtttttaagaactgtaaaatcattttatctagtgaaattaacatttttttgtgatagagggagtactgcatgcctacagcgacgacagtggcaaaagcagcagcagatgcaacatgtattgtacagctacaactccagaatacgtagtgcccagtgcttactgtttggtgttcagtgagctggggccagcggcttcttcaggagtcgctctcacacagatagatgcaaacaggcagtgcgagaattaacgctgcgtgggtcagattggatgtcgaggaatagtaatgtgaaattgattgaggcccttctactctctttttttctttaaagttggtgacagtgtatgattgttactatttatgtcggctaatattgttttcaaaattatctggttgtggtcagtggatgatggttacatatgcaatgcgacgttctagatagtatttcaaattttactagcaaaaatactggtcaaaattaacttctaccatgataataaatttatgaaaatatccattttactccctcaaactattttatcaaagcatttaacccattaaactacttttcgacttttttttacactcctaaactattgaaatcgattcactttactccttaacggtatttgtttcttttccctgcataagttgtattttgtatagaaacttaattggatgatgatagatgtattacaacttgcgtccagtcatttagaagcaaatcgaacagataaaggggaatcactataagtgtggtggttaagtcatgagtcgatccatcaaattcaaactatagtggtcacgaatattacgaacacatagatgtgcgttcaataggattttagtgagtctaaggatttacagatggtctctttgagtgtgtgttagtgatacattagcggatatgtaagtaaggtgtgagtgtatagaggtgtttatgcgtgtgtttcttctgtgtaatcgtaaaaatgaaaaagaaaaaaagctgatggtttttttcactcctggcatactgtggctttggggccgataagtgggctaaatagatgggccgagcaaaacggcccaagaaacgaagaggaggatgaaatcataggtccagggtaaaaccttacccaaatccacactgatctcgtcatggcagctccaaatccttctgctactatggcggcggcggcggcgtccacgccggcgagggcttggtggcgggcggctgctccggcgagtgcctcaactgcagctgtaagctgcttccgagttggggccaagagcctgtaagacctcctctctctaagcttcttagctttcaagcttaattagtggggtactggggtttcttgtcgaaacattgggttctggtagttttttagcgtcgggatacacgccactttagggcaaaggaggtatcttgtgttcatgaatcttgctatcggctcggaaattgcatgctttgggggtgaagtgctttgattgacgctaaggaagcaggttccccatccgctcagttcatcatctcgtggaactgaactgtactagacaagaacagttcaagtaaaattcaaagttcagtgtataaattgctagcatttttgcactgaattatgaaaattctatgctgttttggtgttctgaagtgaatttggtggcacgggtgtcacacttaggaagaggctgaattcgagtccgaactgaagtgaaaatgctgattccaagatgctatatttcgtatcatgtgacactaaatcgtttcaacttactatagctagccagctaggtccagttttgctaagttctcaatgcactggttgaatctagtatttactctatactcatgcttaaacaaaaatgtttcaataacgttttacttttcatgtgatttacaactagattgctcaactagtcaagttactttcattaggttcaagtactatatatcagtcttttcttctttttttcgaaaaggctaacgaaggaggttgacgctatattataagcaggagaaaaaaccgaaaatcagcaacagagttgactgtacatgccaggttgccgaagcacatgtgaacaccaaaaacaaaacaattagggcaatattctcgctacgtgtttagcgccacccattgaccaacttcgtagctcatccattatgcagttgatcagctgttagatatcattcttctctacgcttgttcagttagtcctcactctagtagtgagtagtcagtactagtgtaccttattctagtagctagacagtgacatcaacttaacaaaatgtttactttcaatgttttgcctggtcttaccaaaatgcttatgtactttcaacaaattgccttggtcagtgtgctttagtatgttgtaataatttatattctcatttcaacagcacagggcttcagatgacaagcacccgcgcgaacaaagttcggacagttcatgtcaaaagcggggaggcagaaggaagtccaagcacagagagcatcacccgcgacgaggaaactctgcagcgtgacttgcaaacagcgattcaggaagaaaactatgcccaggccgcgaagctcagggacgagctccgagtcctccaggaggacagcaggtcagcagtgctggcagcgaatgcgcggttctacaatgccttcaagaacggggatcttgtcgcaatgcactcggcatgggcgaagggcgaccatgtgtacgttgttcatccttcggcaggccggatatcgggctacgacatggtgatgcagagctgggagatggtgtgcgacgcggactacgagttccctctccagattgatctgcaggatgttgaggtccatgtgagaggtgatcttgggtatgtgacctgcctggagctggttaagaccaaagggagcagcagctggggaaggcaggttgcgaccaatgtgtttgagaaggttgatggcaaatggttcatttgtatccaccatgcctctcacttcgatgagtgaggctgaatttcttggagagaggaagagctgcaagtgcagatatggcgtgaggttttgcagtacaggcgtgagacatatacttcgctgttttcttaaggtccttgatatgacctttttgtagaaccctttttgtaccaatactatcatcgaatgatgctgctattttgaggagtattagtagtaggtacagacaaccagaaccctgatggaattgtaactcggcgtggctgagatattcgtcagactgttaagtcccttttcctactgttgtacgctgcaatctatccgcgtgcagatgtattttgccaacagatttttgccggttgttacagcatccaacctgttcattgctttagctaacgtcgatttgatgatgaaactccccaaggctcgtgatcaggggcatcaaaaagaatcatgcacattgcaggaagctgcagttgtaggggttgcacaggttgagcgacaatcaaacagattttaagaaaaactccaatgaacaagatgaaatatggaaccctcgcacatccatacaaacacacttgcaaatatcagctgatataggaaatagctgcgagttcagttattctcgtccaagcaaaaatagtacagcttaagttcaggacacaggatatgcgcaaaccaaaagtactatttcaagagacatactgatcgaacattcatgaaaagtatgtaacgcttgcagggagtaacaaaattaatttggccttggtgttgcccactcaacacgaaggataaggttatcataaccataaccattgagcttgctgatagccttctcagcgtcctctctgtgaacaaagttgacgaagccgaaccccctgcttgctccagtcttctgatccaccgcaacgtagacacggctaactggaccaaatgtgcggaatagctcaagtaggtcgggttcacgggtgtcctctgatagattggtcacacggacagagttctcatcattcctacgcctcatgtcatgtccaaccctatcaacagcaccagacctcatgcttggaggaacatatgctcccttcacggcgccacctggaggtccagagccatcagcagtgggaggcctgtccacaaaagcttctgtctggggagctagatccttgtaggggcactttgaggtccagtgatcacccttcttcccacaggttctgcaaaccatgagaactgcaccactcttgcttgccagtggatcaccagaagcacttggttcttcagctttgctccctaaaattaaatgaacagttagcaaagaagaagacaggcatacacatttacaagactaaagcaaagttagctgagcctttggggaaaaaagggagaggttcttcagctttactctataaaattaagtgacagttagcaaacaagaagacaaaggcataaacatttacaagactaaagcaaagtcagctagtatagatcatttggaacaaaaaaaatgaaggatctcaacaaggctgcactccactaagaagatttgtgtcgatgcattagaagaccaaaagcattggttataacaagcataactaaatgtgacgatactatgtacttcgaagatcaatttggtataaggacgactggacgagggcatgcacccatgatagatatcgaattacctatgcataattcttgaacaacaaaactaaagatacaatgccactgcaatatgaaaattctatcatcagacaatacgcatgactaacacaccaaaccacaatcaattacacaatacgcacataataggtattcacaaaagaattgttttcctgatccaccactatccagtattttcaacacttctcttaggaagaataaagacgtgttaatctgcattatcgatgtcccctgtctcaatattcgattaaaaacaaccgcagcttctctaaagatctaactgaaactttacactcaagtccaaaaatattaactttggactcttattaattttccactcaatgttaaaaatattcaaccccagaatcgcttcaaaattaaacaaaacttcaaatgacattcttgtgtcaccataattacccatttaaatactcctttcaatacatgcagattaactgctcctataaagctcaatgattaacattattgcacatttctttctacctagatgtgtgcctgcaaatgataaaactgaaaccaagcaagcaagaaaaattataacagagtcctgacgtatgtagtgttcaaggaaagcagcaccagctgtttcctaaatagatcaccagcctcgattctataatctatctcacatagaggaatagacagcacgaaacattccaatacatcgtgtctagttctgatgaagatcgcgcacaacgataaacaaataattcgattcgagaacacgtcaatcgacgcagatctggacaggaagggggatgcacaagaacagtgacaacctggggcgcgtgggcgctcaaggacgatctcctcggtggacaccatggtgagccgcgcgccgacgtcctcctgcacggcgtcgccgaacttgggccacgagcggcgctcgatggcgctcttggagaggcgggcgcgggcgatcttgcggacgcggaaggtcctggtgaccttcaccttgttccccttgtcgtcgaagcgatactcgaccaccttcttgaacccattctcgtcgggcccggagaccacgcgcggcgggagcaggaagtcgaggtccccctcgtcgtcctcctcgagctctccccacctgatcttctgcgtcgccacctccacggccatggcgctctctcctctctccgctgcgttcgctagggtttgcgggggcggcggcgtgggagggagagagtggggaagaagacctcggcgtaggaatggaaatggaacgagcggctcggatcgttttgtgcgccccgatctgtaaggcggtatccacgttgatgggctttttagtctacgggccggataagttaggcctcagagacattctattgggcctagtaatattagtgttctcactaatttggatttgtacacacataaccaaccaccaacattcaaccatgcaacttcctcaaaatattataactgatgaaaccattgattcaacaaaatatcacactaatccaacactatagtatgaaacatgcaaagcagatagtagtaagtataatactatgttatccctccgtttcatattataagtcgctttgaccatttctctagttaaaacttcctaagtttaacccagtttatagaaaaaaattagcaacatctatgacaccaaattagtttcactaaaactaacatttagcatttacaactcaagttatattttttctataaatttaaatcaaacttaattttttatctagaaaaaatcaaagcaacttataatatgattgaaacggatggaatagaaaattttagtgctagtaaaggctagttgggccttggagcagcccactcgacattaaggatgaggctatcgtagccatagccattgagcttagcgatggccctctcggcgtcctccctgtagacgaagctgaggaagccgaaccccctgctctccccggtccggtgatccaacgcgacgtacgcgcgggtgagcgggccgaagctgccgaacagctcgcggaggtcttcctcgcgggtgtcctccgacaggttggtgacgcggaccgagttctcgtcgttcctccgccgcatttccgactccctcggcttcgggggcacgtacttgcccggccgggatccgccgccattgtcgccgccagagttgggaggaatattgttgtcgacgagagcgtcgagctgcagaggggcgaagtccttgttggggcacttggatgtccagtgcttgcccttggcgttgcagatcctgcaaaccatcagcgcggcgcccttgtccagtgcggggatgagtggatcttccgatttgctccctgcagtgtagaacagttagcgaataaagatttgcatgcagaattgggtgtatgtttagaatttatattcctcggatagatattctatacatgaatagtttaaatatcacactgtatttttagaacggatcggaattgctacaaaacttagtatcccttttatgtcgaaaagaaaaggaattagtatatcctttgttcagtctcagatatactacatggcctagtctaaatagatctgtaacacgtatctatacacggctaacatgaaaaagacaaattcaaaaaaaaaaacgatcaatccattgttgcagattgatctagcaaagttgcaattaacgagcaacgtatatacgtagtactagtgaagaagagactactgctatacctggtgcgcttggacgctcgagaacgatctcctcgggggagaccacggtgaggcgcgcgccggcgtcgtcgttgtgcgcggcgtcgccgaacttggcccagccgcggcgctcggcggcgcgcttggtgacgcgcgtgcgcgcgacctcgcggacgcgggtggtggtggtcacccgcaccgctttcccctcctcgttgagccggtactcgacggttttcttgatcccgttctcgtccggcccgatgaccacgcggggcgggagctgcagggcgctgaggccgccgccgccgccgccgccgtagtcgtcgtcctcgtcgaggtcgctccaccgcatcgtctggtgcttagccgtcgtcgccgccatgattccgttccggggagctcttctgcgatggttgtgcgacgtaacacgatgcaccgggagttatcacgtagggtttgttaggaggaatcgtggtctaggattctggtgcttttataaaggaaggggagagatcggatgtgacacggtgttgcggcccggcccaatagggattctggtcggtttcgctagaaatcaggcgtgaccgcgtgagaaaagggaaggaaaaggcataagatcatccgaggtcccttaacttaccgaatccgattttcatccttcaaccgaaaaaccagatacaacaggtccatcaactgtcaaaaccggtgcaatatatgtccatggcggtggtttagatggtggttttcgctgacgtggcacctacgtgactatttagactcagtcttggtaataacgtggcgcttacttggcaatttgatttagaaaatattaaaaattaggaacccacatgtcagttaaaaaaatagatttaaaatgatgggacccacgtgtcattctcaccttcctcttcttcctcctctctcccccaactccctgtattcactctctctcccctctcctctgtcctctccgccgggtgacgccgggcgaggaggggcggcgccgttctgctgcgcatcgcgggcggagcggccgacggagtgttgctgccgcgctcgccggcgacctcgtcctctgcctccctttctcctccctctgggcaagggtgttctgaacgtgtacgacctgagcaacagcctcgcgcggcagctctccacctccttcctccgcaagccaatcgaggccatctggtgagtaaatcctgttccagatctgtttgtttattctggtctaaacgatttggatttttggatttgggtttggctcaatctgatttgttgtgtaggcatacgggcgtgctggtgtacgggaacaagtacttgtacggcggcgggatccagtcgctgccggtggggaggacaccgtacgggcggccggtgcgggtggtggagccgggcgtgacgcacatcccacgttaggtgttcgaggacttcctccgtgagaacttcagcaacgagtggcgcaactcctcgtcggcgccggcaccaccgactacaccctcaacctccccggcgaggtgatgtccagacccatggcgggcggagcggccgacggagtggagctgccgcgctcgccggcgacctcctcccccggccacctccgccgcccgtggcctgctgccgccggcgctccgcctgcccctccgctcaccccgcggtctgccgccgccccgccgctccacccgtccctccgctccgccaccactccgccggctgtgaggcgagcgccgtggcgcgagaagcgcccgaagacggcgcgatgaggaagaagagggagagcgtggagcaccgccttgcccctcgcctgatccggccgccgccgctccgccggcctgctccggccgcggctcgccccacccgtcgcttgctccggccgggagagagagaggatttattttgtgtgtagctgacatatgggtcccacgatttttattattttttgagatataaaattgccacctaagcgtcacgtcaatgtcacatgagatgaagaccaagtcaaagaagccatgtaggcgtcacgtcggccaaaaccggactgaccgagggatcttgtttgcccggttttcgtaagttgagggacgggtcatacccggttttgcagttaagagacgaaagtcggactgaccgacaaattgaaggacctaaagtgaacttattccgaaggaaaaacggtcaaagcgcgtgcggctgttgggccgcgcgggcagctaggcgtgcctgggctggtctctgaccgtctgacgcctgttggcggagttcgcgttctgcgcggtccagccgaaaccagcatgccgtactagtcttttataggaaaaagtacatcaaacgtccctcaagttgtcatcgggttacaaaatcgtctcctaaccacacaaaactgttcactttaaatcattcggtggttttggccctggttttatctggcgcgtgggacccacgtgggtcccacatgttcgactgtccacgtcatctctctctcccccctcttctctcccttccgcaagcaccatccacggcggggcttgtgctcctctctctagtgtcccatgggtgattcgaaacggcggtggaggagaagccggaggtgaggcgggtaggcgtccaccggccggaggcgatgaggccggtagcgagtgcacaagaagagggaggaggcggcgcgggagaaggccggggcaccgtgcccgccgagtctacctccgcgcccaccgagtccaccgacgtcgtgtggccccttctcccatgtcgccacgtcgcatgtcgcctgcctcaccccggcgcccagctgggcgacgttgagctccttcacggtgaggaggggaggcattgtgctccctcctttgcgcccctggccggagtagccgccacagtgccacccgtcactggttattggacctcctcctttcccgccttgcctggccggcctcctctgcacccgttggccaccctgcctagagtcccagacgaggagaagagtgataaagaggaggaagagaagagggaaaagagagagacgacgtggacagtctgacatggggggcccacgtgagttccacgctgactcaaccgccacattggacaaaaccagggtcaaaaccaccgaagaatctaaagtgaacggttttataagttgagggatgccatatatctggttttatggttgagggatgattttgtaactcaatgacaagttaagggacctttggtgtactttttcctctttcctatggtcacacggaccgatttatgtaggcctatgcccatttgttagcagaaaaagttcaatgtgcatccctcaaatatgctttgaattttatttgtatccttcaaccgtaaagccaggtatagagattcccttaactactaaaaccaaatcattttatatccctaagtggttttaatggtgattttgttctatgcggcactagtacttttgacttggttttttatgtgacgtgacacccacgtgatgctaacgtgttaaaacaaaactttcatcttgcactggtctgctttaagggcctattcgactgattgttctgctgctggcctgctgcggcgcagccggcaccaatagtgtcgcacgcacacgacgcagccgcagccagcttgtcgaacatgccataagttgctagacatatactaaagaaaaaaaaataaaacttttcacgtgcctatttgtccgaatcaacttacgagaagaaccagaacaagtcaccgggaataaggaggggagctcagcggcaccatcatctttcacaccgcgctcacccccactcctaccagaaccatgcctacccaccgacaacaccatgaactgtgttgccaatgtcgcagatgcatggtcgatggctggtgcgcgaacaatatctggttttacggttaaaaaaaaaagtaaagtggacctttacctccagaggctaaccctgctccagcccagttattgggttgcttcaccaggatgcatggccttctatagtaagctgtttgatcagccttccggctatggtcggagataggcatgtaaaatgatggaatgtagtggtgcctaattaattatgaatcaactgaaaaaactttaaaaaatatattagtatgattatttaaaacaactttcttctagaaaattttacaaaatacatatttttttagtgatttaagaaacatgcacgtaaaaaacgagtgaggagaagtcgagaacatagagaaaagaacacatccaaaataagtatatgatacagtacacccaaaatgagtacataacgcatgctgatgagtcacgggctcacggccaagatataaagaagcaccgctacgtaatattccagaacatttgattttttttttagagagagaatccagaactttgaattgtagcaagtcgtcgtagcacaattttactaccgagtactcgtatttccagaacatttgaattgtagtgaaatcaccggaccattttagcacgcaccacgcagccgcctaaccattttcacggaggtagtagtacgcgtagtaatagtacggaggacctcctcttcggtcttcagaagtcaccctttctagaagaagaagacgatggtaacctgacttctcctgtgatgcgcagcgctgggtcccacacttgggttcctccgcccgccgccatgtccaacgtccgaccggggggcggggagcgcggtcctcccatcccgtcatcaattcaaaaacttgaatgccccttccgatgatgtcgcgctgtgtgtcagccgcctgcagccggcaactaccccacccaccccacgccaccgcggctcgcacgtgccgctgccgtctccccaatccccatcctgtcgtcatctgccgcctcgcgggccagccaatgcaccggctgtgccatggcaggtgggccttggcggaggcgggggctcacatggaaattagtaggagtaccaacgtggtgggggaggtggttagccggcagaggcgtcattgctgctgcgtacgcgcgcggcggcgtgctaccaaccgtgtgcttgacgccactggcagcagagcagaagccggaataaaggcagtgctcccagtgggtttgggttccgccttgcgtgggtggctggattggatgccccactagaccactacacacattctccgatcccaccctttccacatgacgagagctaccgggaaatttgcaaaggaacgggaaggaatcgacgaatcgttaggtgcacttttggtccttcaccaatcactctggcaacataaacaattgcctgaaacaaaacagatccgacattgctccaagctaaccttgctgtttatgactactgtttagtgagtaatagagcttgttaagccaaagtcaagcaaaataaaatagttcgacatattgcacttttcaaataggtaggatcataggaaaaagaaaagaaggcgtaaaaacatggttgttgattttatactaattttcactgttatagtttttctcactataacaggacgtgaaactgataacttaagggggagttgcattttttttcttctcgttattataaattattagatcgtattttctcaacctaaatcacaacttgtgtctatcaacttatttctttgcgtgcatgaaatataagtatagagttttatagatttatgtgtatgtgttatccgttgttaggtttgcgcaggctcaaagaaattgttagatctgccactgatatcactaccaaatactcccatagtatctttaaaattcagtgtcaaattagttatctactcttcctatatatttgaattcagttactcaacatatatacgttgagccacatcatctataaaataaggatagctggatcactactcttaatcacatcggtcggaacacttctatgcataattgcatagaacggattgactatgtaggtataactgtaggtattgatagagcaagtgatccaatacaacctgactatggagaatatggggtactgggtacccacacgacttctatatttgactagagataggaggtgagccaaatccatgtactatgtaatagagtaggacttgatcacaatgttgtcttatgttctataacataatttagaatcccgaccggtattaagtaattgattaggaaactgatactgtgtccggctaggtattactctttgtaacactacccctaacctatataaggtgagcgggaagctctccaaagacataaccagagatagcaagataagtcacaattagattatcatatcaatatatacacccgacagatacaattccgaaataatagtaaggtattacctcttatcgagagagccctgaatttgtcttaattcttgtctctgcatccatcaatcaacttttagatctcatgtgctattctttttaattattgcccatttccataatcgacactgacattgctatcatgctcatcgcaagctcaaacaatgagatgttttcttaataagtacgcgcgtgattgtgattgttaactttcaagatagacatggtttgacaataacatttctttaccaatgacctgattaattagccatttattgtatggttgttggtagttaaggctataaggaatcaacctttgggcgcaaaagagtataaagtatagttttaatattgtggcaccacaccttccacatattttccttcctttaacttgttctataccaatgataatgacggtaaaaagtttcacctcttcgagaagttattgattttatcaaacaaatagaaaatgtatctattaatctataattaaatctctctacttccactgtaaaaaactcaaacttttgaaacaacctgctgtgcaaagctttatattaatacagaaagggaaaaggtaacactgcaaccctgaaaaactataacaagaaaagaacaaaacaaacacacaacccaagagaaggctctagtatcaaatcgaccgctattgagcatgaccgatcgccgctagaactataggggtcgcacacacccttccaaactcaaattccacataggaggtcgttgacggtctcccgattatcatcacgtataaggattggggagaggttgaggacgagagagaccgctattgagcatgaccgatcgccgctagaactatagggggtcgcacatacctctccaaacgcaaattctacacaggaggtcgttgacggtctcccaatcatatcacgtataagcattggggagagggagaggacgagagagaagaagatccactcgtccctcgagccaacctgacgacaacaaccaaaataaggccaaggaccaagctggaggaagggcggcaatgagcgatgaatacttcataggcaacgtcttcaaggaggtcatgacaccaaatggcaccactgtcgcatgtctagatgaatcgggttttcacccagagagtcttaccatgaagagggggttggtagctccacaacactttaaaggggatttcacaacattcagagatgtcatatttgctggctaaaaaaaaagaaatcaatttttaatttttgtatgtatgaatctatatataaaacaacttggtttattttaggatcgaggagatactatactttgaagatggctctttcgagttcatactatttcgaaatattggattttttttctaaaaaagtataacaaaattctgtaaatattgtaaactcttagcactgtattccggaccaaatataagattttccgtaggttgtaaaaacgggcgagacagcgtcaaaatcagcaaacctggacgtgagtcgtgacagagcaaaaaaacaccatcatcattcgtgtcctttccattctctcctgaaatccatccccggccagacgtaacggtcacgcgctattggcaccccaagaagatgcaaagcagcagcacacacagcaataaagcaacgcgcaaatcggtgtagtcaaaactcatctcctctatataaacccactgaaaaaaaaagtcggcacgttttttcccccaatttcatctcgggccaaaaaaaaaaactccagctcgccatagctcgccataggagaggggatttcgaagctgctcttgcttagctgcggctgcgagtgatacggagtagttccggtgatggagcgagcggaggagacgccgagggcgccgtcgacggcgccgtcggcgagggtgtcgatctgggagtcggtgcgcgcgtgcggggtgtgggggaaggaggtggacaaggccgagctgcggaggcaggtcgtcatgccgctgtacgcgcggcgtgcggtcgcggccgccgtgaaggccaaggacgaggccgtcggcgtggcggcggcggcggagaggggcgaggagggggaggtggaggtggaggtggaggcggccgtgacgccggtggtggtgttcgtcaactcgcggagcggcggtaggcacgggcccgagctcaaggtgcggctccacgagctcatcagcgaggagcaggtgatgacatcgccgattggctcggccactcgtgcaaccctgtttccaaattttcacgcttctccccggttgttcctgtgtgggttgttggcttgttgcttgctcttggtatggttttcgcgagttgcgagtcattgattacttttgagattcctttgaaaattcgcagcgatttagacgtatttctgtggaattacactgtcggtgacgtatgaactttcgttctagagtggtactactaccggaaagaggggcaacagcctcagctccgcgtgtgatctgatgaagattttctggctcgaccaatgccatataaggtcaattcaattgctactttatagaaaatggattgctagtagtatcgtactagattttgattttccatctccaaaatgaattttaaatttcctgttgttatcacgtagtactccgtaagtagaatcatgaagttcatcgtgcaattggtactattagcatttatgttgcttattggagtttggacgtgccaacgaaaaagcgtgtgttctgaagagggggtgtagacgtgtggttggggtcttggggataggatgaggagatggagatactaacattgcggttggatgataggtgttgtgaaagcttcagcctccagcagattgtgcatttgtgcctcactttctcgcatggccctggaactttgttgatatggagggatgaagaaaaatattgaagatggtaagcggcaggttggcagggagggaagatcaaaagtttaaacatcagaattttagctccatgcttgcttctgaggtgtaagtggctggagactagttcggcggcctctaatttttggcttgacatgctattccaatagaatacagtcatttgattgtactgttatcttttacggagtttttttttttttgctcaacatggaattactggattttatctgggttcattatgtatcaatgtttggaacctgaggatgtcctatgtaagcattttgcacttacactttgaagattattcgtaactgtttttttaatatgatcaactgatcactttatgtattcacacatgttttcagaattttttccttatccttttgtatgttctgggacacaatattacatactgatgaaactatttccaggtctttgatctctctgtcgtgaagccttctgatttcattaactacgggttgggttgtttggagaaattggccgaacaaggtgacaattgtgcggagaccattcgaaaaaaattgaggattatggtacgtgtgtaatggactttattaggggtactgcatttgttataagtttagagttctctgcacgtttgagtagtcaagcattagcatctgttaaaacttatgaaaggttgttgcttcctttactatcctatctacttataaaataatttatgacagggtgtccttgttctttccttatttactgaatttctcctatgttggctactcattgtcttccaactactttgcataacatccttgcactagttctttctgacaggttgctggtggtgatggcacagttggttgggtacttggctgtctcacagatctttataggttgaaaagagaaccagttccacccacaggtatcatcccacttggtacaggaaatgatcttgccagatcatttggatgggtaaggatccatatatgatgcaattgttctatttatatcctttctttgtaatttacagtgttaactaagcttttgagggaaggtgagcgattcactcatactacaactaataagcatatgaacagggtggctcttttccctttggttg

SEQ ID NO: 72430 - DNA, 2677 bp, Oryza sativa
agatatccatcactctatgacacatccaacggcttgattgtctagatgttgtccttcttttcatacttatagctgcatcagttgagtttgatcttatgagtcgtgattagaatctcaaatctctagcctgtctttggttgccgattagggtagtatcggagtttcagctgatcttacctaacttaactatattcatcttatatgctttactgatatgttaaatctgccctttatgttaagatcttgttgcgttaaaagtatattaggctttctgtttgatatattctacttgcattaatatcttaatatagagtggtatcggagtattagccgatacatgctagatctatctgatcggctatgctatgtacatatatagtctcattattaatatatatttcgatttaagtgatttatactatctcggcatagcgaccgatctatcccaatcacaaggattgcgtattgttaatatctacagccgatcgagtagatttagtatatccgacataaggattgtgtattgttaatatctacagccgatcgagtagatttaattctgtcttacttattaatgactgccgatcgatgcatatatgacatcggctcaaagataaatgatatgtcatcggcatttagccgatcggcgtttatggatttaatcgcggtttctttgtctttgtttcttattgattgcaggatcaaattaattggcacgctcacacacccaaaggcaagttttggacctgcactagagttaagcagatctcccaggcctcgtgtttttacatcaacaaaacccaaattcatccctacagccccacatccatacagcacattcgcattcatatttcacattcacatccacattctacattccacattccacatccacatcacatttcacattcacatttcacaattcacattcacattcacattcacattcatcacaacaaataaaaacctacaagccattcatcacaacatataaaaacctacaagcctaagtcaaaattcgtaaatccaaactcaaaatatatatcctaaacatttgcatataaatcctaaacatttgcatatatatcctaactcaaaatatgcgtaggttaaaattcctaagtcaaaagattgtaagtctaaatttttaggtcgaaaaattcctatgtctagattatgaacattaatatgaaaaattcctaagtctgcaatatttaagaattcataagtgcaaaaatataaatgcgattgtattttacctccaacatggggtgagcctatgattttaagagtttctcatcctcaagtcatcgagcatgtaatagaaaacatagaatagaatccataataatagcaaatattcaaatgcattacacataaagtacacttccatagttcatgcataaacactaattaaatacatttttttcacataaatctagctagtaggtttttttttcctaggagctaatttcttcgcggcttggtgccgagggggaggggcagaagattgcactcgttgtggggccttgttgatgttgtattcgccacgacatgatgacggatgaacccgcaaaactcgtcagtgagagctttgaagacgtgtggtagaatttcacttgtatcgagacccaatttctgcaacgcaaggatggaagcacgtagaaatttacttagtacttaaatagaattgctcaatgttatgacttaggtacctgaagcatgtcatacctcagcattgcggtgattgtatccatcctctacaaaatatagcatgtaccgcatgacgtagaatccacagaggtcgatggcctctggttgacgaaggatatatttatgttcgaagatccgaaattcagttgcatcaatcttgcatctcccatacgatcttccggacctacagtacttcttatatgccctatttagtgcactgaaaatagtttggtacttgtctatccctctcctcaggctatcatatatgcaaattgaactatcgtcgatgttgattacgaggaggatccaatgatggctacacatagtgacaatttatcaataacttgatatgggtcgaggggcaaacataactggaaatcgatgatagtgacttactgagaaaggtaaggaaataaaatgtggtcacatccattaagtttggcgagggcatcaaagagatagcggtcaatttcagcttcggatgtgcattgcttgtcaaagtttacaacggctgggtctagaaaagctatcttatggttcatggatctaacctgataagagcaatgcccgcaaaaggagaacacagttgagaattactgagtacgtagaatgctatggattaagaacgacaagatatcaaaggactcaaaatgaccacaattgcaggaggcagatatcgaattcccttctttggtacaacggggagtcctctaaattctacaaagcatgtattactggggtggtgaaaatccacatcagtgtagtaggcaccgaacatcccgacccccttttttggcctcctccaaataccattcatgcagccaatgcgcttgagttcctaaggattcaatttccgtgtcaagcaccatcggttgaccaagttggaatcgcagtacaatcggggcctcttcaagttcatctagattgtataggcttttcaaaccagctgacttgcagaaatcaa

SEQ ID NO: 72431 - DNA, 3295 bp, Oryza sativa
gcttcttaggtgacttcggtggtgcgcacttgatgaaatgctcgatgacattcggaggaattggaatctttggttcctcgagcttcttaggaccaaaaagtgaagtgatgctggcattgattgtcttcttaggcagcgatgttgttggctttgacactaagtatgaattggaatgtgtgagtcactatttgcttgatggaacagacatctgtgatgcacttggtgttcgggtcttttttctgagtgggggtggacttgtggacttctccggacgatgtggttcattaggtgtgttttcacgaggtggactgaaggtcctctgtcgaggcggagaaggagctagatttgcacctcgtccgtttgaagggctggaagcaccgtcgcctggatcccctgccccatcgttcaacgtgataacgatgtagcgtttgggccatatgatcaggttgtgaagagcagcgcccagagtgtcaaccccttcctccggaggaaactgtagcacataacctctgtattggcttggcacgtcttccacttcaacccttgagtggcctacaggcaatggaacaccatgtattgtttgccctgcacatattggatgtgccacaccgcgtgcaatctcctgagtaatgttgctttgaagagggacatggagcacgcacggcatatgtgttgttatgtcgtccacaacataacgtgatgtgtcctgttctggaggggggttatccgcggacgcgcaagtgctccgtttggcacctgggttaaccacttggtcaccagcttgcccctgttgtcttggtaacccattgggaaacagcactgcaagttgttcctttacctgacgggccacctctaatctcatacgtttggcctcctcttctctcatgggtcttcttggatgggcccgatacatgtgtgcatcatctgggaacccttcctttcatggatcggaaccaacgcctctcgtgcgtccagggtgctctttcatccccagtgccaatgtgaactcatctttttctcttactggcacatatttaccctgtctcgccaagaaaacagcctcggtgatcttttctttcagctcttgctatcgaggtcccagtgcaaccaactcccctgaatccgatagttgagccttcctggcgtacgcgtagtgctttgtccgggtcccccatccatctatctcaacaactatacctgcttggcacagttgttcctccttctcttcccatttggggatattcttagcatatctgctcggcccaagtcggtagaaagcttgttcaacgcggagttggccttgtttagggtgctcacttctcttgcctcttgagatgttttccagttcacaaactcatcccattaatctgtcaacttctgatacctgggtttctcaaaatccagggtccggttgcgttggaccaacttcgcgttcaagtcagtcctccactttctgaataatgtgctcatcttcgataaggctcccttctttgctagctcttcttggccttttggaaaggtgaatgtcagcttcaactttcgccaacattcttccttcaggttatgtggcaccgtccagtcgagttgtgttacatcatttgttttccaatgtctatacttgatgggaatgaaatccttgacgatacatccacacgccctaccatagggagttactgccgtcgatggttcgtgtggccacccagtttcagtgagcactgtcacaacgtagtgaccatccggcatcgagctaggacccctaggctacctcccatatgagacggttgaatcctggcccgaaccaccagtggaagtgccaacctccttggaaattgcaaattcgattagttcgaatggtccattagagttggaatttgctaatgcactattgcgtgaaatatacgtcgaaattacctcgctgccttcggaatgctcttgatttaagtttaagaatgcgctagggctggcattatgttcaccctcagatccggagctagcgaattcttcgtgttccatctagtcatcatcgagcataataacattactaatgttgaaaaataacatggtctaaaggtgtaagatattttgtgctctcggaactgctacaagcacaaaacaggaatatatttgctctcagatggcgggttgccaacttaatggcctcctcgccaaaatatggcaggctgccaattgcacggcctccatgccatggtgtactaggtcgtcatcgattatgtgtggcagtataaacagagacgagaataaagggcaattcaaaaatagtgaacaaaagagaataagggagagagcgtgtggataagagagatagagggtgaagtgggtaagtggttggccgggtaattaaatagtaggagataggtgccggttttataccctaatccggcacaattcacaaatcacacaaataaatgaaatactgccacacataatctcccatcatatgaatttcatcatcgagcagcaagttatattcacatggggagtttggaaagattgggtaaatgttcagatgtgcattccaagatatacttttcctttaccaaacaagaaatgaggatgatggatcatggaaacagaacctaagggcatgaacatattaatactagtaatataacctaagtaagcaagtaagcaaccttaagtagccacattttaaatcagcagcagcataaaaaaaagctattagcaatccagggagcatgctcatataagtattggctcacacgaaaaactgtactcttatcataataccatagatctgatcaactgtatgagatcatacaaaatactggtaatatgtaagacggatgctctcctagtgtcctgacaaaaaattgcaggccagcattgttacagaacaaagtggccttaactttagtgagtttatgattaaaatttagacaattctgatcaactaggcaaaattttaaatttgaaacaataggaaaataagtgtactctccatctccatcccaaaatatagtaacagattagacactgcctattactacattacaatagcgtgtcgattcagtaaataggcaactgcatcaaaaatcaccctgggaaaccatgctaggccatgcacagtgagaaacgactgtcctaaaatattaatatttagcataatcgacagatgtagtattgtatccaggtattagtatttagcataatcgacagtggaagtattgtatctagataatatccaggtgcacccccataatcgacagaggtagtacttagcatattcatgtctcagacccataatcgacagagg

SEQ ID NO: 72432 - DNA, 6226 bp, Oryza sativa
gcatcgatgcgcacagcactgttttgatttgtactcttgttgtcctgagtcttggtgtaaatggtatacccgttcatatcatagccctggtacatgtggattgtgttggatggcccccgagataatgaaaaaagggcaccatcgatgtctgcagttgtcaggtactccatcaaccatttcccgaattgaagtttatgcatcttcgcaagccatgctgctcctttcctgggattgtctctgcggagtacatccaagtgcatgtgcacgtacggagacaccaaagctgactgtcgtaacactgcaaaatgggcgtgtcttatggtttgtcgatcaggggtgaaaattctcctgtgacctaatgttccctttccaagcatcctaccctcatgacgaggcacaggaacaccgataggttgtagatccatgtaatctatacagaattcgaccacctcctctattgcataactgtcacacccagaaattctcgaaccagaatttctaagctgaatgtgcattaaatccctgtccaggaccagccagggtacacaaatgacaattgttgacatacagacccacgtcttacaaaaatataaaagattacaaatgcagcgggaaagattaaagcgagctaaaccgggaagcttgacttcagcagcgggcgacgccactccacaggcaaaccttgacggcagcgacgaaaccaacctctctgagacggctctaactaagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggtgaaatcgtgacaagaccctccacataaccctcccctaaccatccacaccacgctaaggtttcacccccacccctcaaaaggcagtgggcggtcccctcttgcgccgcagtgaatccggcagctggacaaccggacaccccggccgacccaacttcatcacgcccaccctcgccaccggtgcctaggaaagggtcgagctatacttcagatcaagcagttacccactcccgcttgtggtaagcacggtaagtctcccagggtttcccatgaaccggtccttaactgccatgggtgcgaccagcaaaaccatgcactcacagcccgccattcagaatattttaattaactgacacccttgcggtggcaccaatctaaagctatgccaatagacaaagtctatgtaataatgtgatccctttttgtgtactagttgagctaagcatggctaagcatttcctaaaccaacatctaatcattttgatacccaggttatcaatggcatatggtaaacaataaatggctgagtaataggacccatcccacatgacattgtaaaagaatgcaacatttaatagaaatgcagggtgtttgtaaattgggtacaatatgatcaaatgtaaagcatgacttgccttgctctcgaactgatgagacctcagcaacgtcttcgagaaaccgcggatcgacgaaacggccgaaacccacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataactgtgtttttactaataaagaaaaagtccttaattaattattgcgcaataatacccagggctgacgtcatccaaggggggcgccgacaggtggggcccatgggtcagcggctcaaaggggagaggaagggggcgccggcatgtgggccccacgggcagtggctcaaggtggccggtctaccgtagaccgggaccacgcgggtggtccaccgccggtccacgggaccgacggtccggatcggccgggaggccgatcggacggcacggcagcggctaggcacggcttcaaaaccgaccggccggccatggcaaccggctgtgacgcgcacggtcgccggcgacggcaatcggcggcgcgggaagcaacggcggacggggtacaggacggcggcgtcgaccgaaggtgacggcgagcgcgtggagagaggcggcgcaaacgagagagaggggaagagggaggaggggaggatcctcaccggcgagtatggcggccggggcggaggataaggtggcggcgacgacctggcgatgaagaagggccggacgggtggcggcggcacctacggagggtgttgagaaggattaggagtagagagagtgaccacggcggccaccattgttggccggagacgaaggagaatggatagctcaccggcgtgcgaggagaaccgggctccggtggggtttagcggaaatcgagcggcggccgaggtggctcacgcggcggcaatgctaatgccggcggcggcttggcgcggcggcggctctagcggctgcggcgcgcgaccggaggtggcggcaagcggcggcgctagtggcgagcggcgcgcgaccggtaggaggcacgggaaagcgcggcgaaaaggggaaaagggagagggagatgcgggaaagctttataggggctcgagaggggcggacatggccgggaaaccccccgatttggccagcgacgtgggggaagagagagaaagtgggggggattcaaatcgaatcccgcccatttgcgggcgcgcgtgcgggcgggaatggcggggagggcggcgacgtggggacgcggagtgggggtgcggcgtggagcggagaaggcggcggcgcggacggtttcggcggcggttgccgtcgtggggcgggcggctggaggaaggggacgacctgacaggtgggccccacctgtcagcgtcccggagagaggggaaaggggaacgggccggcccaaaggaaggaggccgagcgcgtggagagagtgagccgacggcccaatagagaaaaaagaaggaaaagaaaaagaaaaagaagaaaggatttttcctgggatttaaaattgcattttggtgatttttaattggttaaaattatttccaaggctctgaaaattccactaaaaatcttgttaatgcattggagcatggggtactcaagaaaaattccacacgctatttccgattattaattgcatttattaactagggatttagctctaggttaattaagataatttcttcgggcaatttatttaaccaatttttaaagcaagaaaaaggggaaacttcagggtgtgacaataaccctcgacgatgctgccttcgggtcttgatctattcctgacatatttctttatgatgcccataaacctctcgaaagcccacatgctatgcagatatgctggacctaagatctttacttgttccacaagatgaacaatcagatgcaccatgatatcgaagaaagaaagagggaacaacatctccagctggcaaaagttgagaatcgcgtcctcctgaagcttgcccaatgaagccggatcgataaccttttggtttatcgcattgaagaactggcacaacttgatgattgggtcttggaccttttctagaaggataccctaattgcgaccggtagcagttgcgtcataagaacatggcagtcatgtgacttcattccaaccaacctcttatctttcatgctaaccagtctcttaatgttcgcacagtaaccggatgggactttgacaccccacatgcattccaacatactcgttttttctgcagcactaagagtgtagcatgccggagataggtaatagcggtcatttcctctgtcctgaggatgcagctctttcctgatgcccatgtctttgagatctttccgtgcttgcgaagtgtctttcatcttgccaggtgtgttcaacaataccccgagcacgccttggcacacgttcttctccacgtgcatcacgtgcatcacatcgatcgcatgacgaatatccaggtctttccaatatggcaagtcccaaaagacagacttctttttgaatagaggggtctcaccgctcgatgtggatgcacatgtgcttccgctcccttgcatacttttcattactccaaatctgcaaattcaccacgatacagaatgcaatcatttagacaagcgtgaattttctgtatgtcaagactaaggggacatgtaacttttttgggttggtacgtcgattctggcaagacattgtctgtaggaagaatttctttcaagagctctagcaactcatgaagctcttatcagaccatccgttgctcgccttcaagtgaagcagcgataggaccacttggagcttgctgtgctctgccttacatccattgtaaattggagttttggagtccttcaccatggttgtgaacttgtgatattccctatcatcagtgtcaaatctctccccgtcgcgcaacatctgatctagattaggttcaccgtgatcgacacatgtttggtcctcctcctcctcgtagcctacatccgcatcatgcccatgacagttgccagcactttcctcaccttgattctcctcgctaaggaaattgtccataaaaccccttgtaaggatatgtgaatggacccgctgagctggaagttgtctgtctttcttacaatcatggcatggacaccaaatatattctggtgcatcgactaagtttgtgctggtggacgtggcaacgagagccgttactcccctgaaatactccacagagtcacgatccgctatagttatccattctagatccattatatccagtgggtacctgcggttattatcatttattacaaaccatgaaggaaaaaaacaatgaagatttcatcatttacaagcacattagaataaaaacaactaggaatgaccattttaccctacgacaaaaaagaggtttttgcacacacccacggcaccttaattagatagtcatggctaacaaaaatattaaaaaaattctattttttgtcaatccgaaataatatttggctaatgtgaaacattaatgacgatggcatagatggaataaaccattaattcaaatttagcataacacccgagaacagatctacgaatgacttatggatccatacaaattaatgactagtgcattttacatgtattactgcatggcagttcaattcaacgagcgggtgtgaatcggggtgagaaattctgaatatttaccttgtaggctttaatcttcaaccaaaacccaagaaaaatcaagcaaaaccgcttccacctcctctagcggatcgatgggcacccttaacataaatttgagataaatcaaactatcaatggatattttcgtggccttaacatagtttgacaagcattaatttgactaatggccatgacgtagatcgaagaaaacattaacgcaaatttagcatttcatccaacaatagacacaaaagagataaaaagaattatccctaaaaacaacacccatagcgtattttacatgcatacgtgcagcacacgacaattcaaatcaacaaccaagagttaaacgaagcgagaaataatgaatatttacctttaggcttcaatatttaaccaaactgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcataatttttaatcatacaaagagcatttcagtaattaaccacatattaaattaatcattaaatggtctaattggaattttgttaagtactttgagtgtccaagtattttca

SEQ ID NO: 72433 - DNA, 5101 bp, Oryza sativa
gtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggttttattagtctttttcttcgttttgcgtgttagcttgtcgtttccgtcgttgcgaaggttcgtgagtgcgtccgaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaagaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgtggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatcttgactgtaggataagccaaatggtcaaaccttaaggacaaatcttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctagttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggatgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcctaatttttaatcatacaaagagcatttcagtaattaaccacatattaaattaatcattaaatggtctaattgtaattttgttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggtttgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacaatagcacactattgggataacttatgactcactattatttaaggatggcttaatgatagttcacg

SEQ ID NO: 72434 - DNA, 1465 bp, Oryza sativa
attacaaaagtgcatatttcactatgtgaaaggaaattcattaattaccaactacctattacattcgcttcaaattacttgtcattttaaatttgtcttaagtccaacaataaaaacttgaccatcaattattacaaactcatatgagtttaacatcatgagatttatatttttatattcattacgaaaaatacttgcatatatataatttacatgtttttaaactatagaaatttctaaaattaatgataaaaaaataaacatgtttgacttgaattatccacagtaggaatttcgttaactcacttctccatacggtgcaattgtttgagttcgctatcccaacttccaaagtaatcgtccgtcgccgcctgccaattgacaaaggaaaggggaaaaaaaaacaccgtcctttgttcatacacttcattgtgaagtgtgaacgtagcattttctgaggccattaaactagtcgtctctcctcttctttgtttccctccacagcagcttcggttacttcgaaccttccatccataaatccttcctttctcctcataccagaacgcatagcggcataggacgacgagctccctacacagacgggagagagagagacagagagacgagggagaagaggatgaagcccaagaacggcggcgcggccgcggacaggaggctgccgccgaggtggatactcctctgcgcgttcagcttcggcctcggcatgctgttctccgaccagtgagtgatcgagtcgatcccctagccttgattagttcagttcagccgtcccccgtgttggggtttcaggtttcttgtgttttgctatcgccatgcggccgtgcgcgcgagcgacatgggagagagtgctctgctttggtgcgactgatgtttggatgtttccggtgatcaggtttggatcggtgccggagtggcagaaaccgttggcggcgcagcgccgggtgcaggacaggaagctgcagatccttgatgaagattttgttgccaagccggtaaggctgactaacctaacctatgggactatgaaccataagtctttgcctttgcttctacctctctctgttttttctagacgattttttcccctaccatattgcaatcttgttatccccggaaatatccccattatcgaacaattgatcatcttgttttttcagacattgttgtttgtaactttgtagtgtcatgatccatgagtgtcttaattaaaaataataccttttcctgtaaaagtttggccgtattatcatgcagaaacagctgtttcaacaattaagcactcgcaaggcaccccttgattgcacctcttttacatggtagtacctggtttgtaataaaaagaaaaggaaaaggcaagttttttaaaatgaaaaaaaagaaagaacataaggttgaagccagctgttttatatgaatgcaatgcagagtagagttggctatctga

SEQ ID NO: 72435 - DNA, 3230 bp, Oryza sativa
gctttgtttccgcttgttttatggagtttattagagtaaacgccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattatcgctttatttaaattcccgcgttatcactgttttatttagccatgcctatttacctttgttaagacattattattgctattgttattattacctcgttcaccctagaataaacaaaaccccaactagtggacactctactcatggtaccactagcatgattttaggtggtttttcaactctagacttggggatattcatatcacctggacactttggaatagttggtttattgtggaattggattcacaccgccccctctattcaaaatccccaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgggctgcggcccggtagtcgagatgtcatggcacagggctggtgtcctgctgctagggtctcaatcctgcctacctgtcccggaggttccggccgtaggtggggttgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtaaaacctattcgaatagccgcgccctcggttatgggcaagccgagcaatgtacccaagttagtgttttaattcctaaaatttgctcaacaactaaaatgtggaatggttggcctgggttggcttgggatgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaacgctgtttactgcaaaacttaacccctacattatttccccttgtacttccctgcattaatcatgcatctgccggtgtggcttgctgagtactgtgggtgtactcattcttgcgctatctttctccccccttcagtaagagaagctttggagaagaagtcttaggtggagtcttggcttataccccagttgagcgcctgtgaagatggagccgtaagcccgctagtccgctgctgtttatttttgattgtcaggccttaagtgcttttgtaataatgtaaatattatcgatataataaagatgtgtcttttatatcatgtttgtatggtgtaccccggcttttcctgggacggggattaatacactagcgttcgggaaaatgcaattttctcggtcgcgacataggcccaccctgctgtcctggagtgaagcgcggtcgctggtgacttccttggttggactggaactgagctgtctttctcttcctgtccattttgttgcactgatcctcctggcggattgccttgtctaccagcttctcgaagtcagcataatccccggagatcaactggttggtcagctcgtcatccaggcctgctaggaacttctcctgtttctctgcgtcagtgcggacatcctccggttcatatcgtgctaggcgattgaactcatgcaggtactcggtcactgtcctgttgccctggtgaagtgcccggaattccctcttcttctgtgccacaaccccgtctggcacctgcgccttcctgaagctgcgacagaactccgcccaagtgacttctgtgcctggcaggtgggtagccatgtgattgtcccaccaagctgatgcgggacctcgtgtagcgaaggcgactttctcgtgatcattgcactgtagaagattgagcttcttttcaatggcatggaaccagtcctttgcctccatggggttggtggtgctagagaaggtgggtggcctgacgcgtagaaactccagcagcttggactgagggggagggggaccaaactgctgctgctgctgctcaggctgctgcagcatcctctggtgcatctactggtgctgctgctgcatctgctgcatcatggccaccatcatctgagtctgatgggccatcacttgtgcaagggtcgggttcttggggagcggtggcggaccattgccggaggcgctgttggggtacccactgtcggtgcgttcttcgccgttgctgccctctcctgctgcacagctgccattcctggtgttgaccatctgaaggaagagcagacggaggggatggaaaagaagaaaaacagatgctcaggaactaagctttattatataggaatttaaactgcaattgttcttatctgaattaaaacacttaaaacaacaaacaaatccttattaagacagccatatcataggcacatgatatcaaccgtcgactgacccacaagcgaacagacctaaacactcaaactaacagacaattactaagcaagacgataagctaagggaaaatgagcctaatgctcggaacagctcctacggtcggtggagtcgaaggcgtcctcctgctcgtcgccaggtccctctgagcgtctcctggggtctggcagatacgtctcgccactgcctggctctaagccactggagctactgctgctgtggtcgcgactgccactgggagtagcaggcaaccaacctccgttgccactggctggacccctggcggctgacgctggagcgaaggagagagcggatgcgggagctgacactggaacaggagctggagctgcaggaactgcgggaggtgctggaggagctgcgggaggaggtgggttcctgggtgcaagctgaatgcgcacgggtgcagtcgttgacttgcgaggcgtggtgcggatccggactcctccaggagcggggagacccttcaactaagcattctccttcttcaggcgcgctatctcatccttcagagctatgatcctca

SEQ ID NO: 72436 - DNA, 9612 bp, Oryza sativa
tatacatgtatatatatatatatatatatatatatgttactcgcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaatgtaattaagattattagacctggaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgtgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggtgtgtagggttctaatgtacgacatttacacttagcatacatgaattagattggtaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaggcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggttgcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaaaaacttatcaataaaggtaagatttagccattccgctagttgctgcttatatatgttgattactaataaataatctctcacaacatgaaggtggggtcgggcatgcccatcccaacggacccttcaggtctttaccactgcaggccgattccagcaggatactccaaggtccgagttgaattggtcgaaggcgcgtacaagaccctcgagctgtattaacctggaggagacagtgagccgcatctacgagacacatcccatgccatttttttatggcgcaggcggtacatcatcctctcttggcaacaagcggcgtctcgtgcaccatctcctccggctccgccatctcctcctcaggatcgtgcactgtctcctcctcgtgctccgccagcactgtctccacctcaggctccagcatcgactcctcaggatcttgcaccgactcctcctcgtgctcctacacctactcccccgcaagctcctcttccggcaccttcaaagtcaagggcccccccagctcctccgcttgcccacacaagggcatcaaagaaggcgaaagttgactccgccaagaacaagaacccggggtgcgattgcacgcaagaggagcttaacgcttacgctgcatcagaagtcaagagacaattcaagcatcgaagtccagaaaagaagattcctatagaccccagtgtcagaactgcttcaggggtatgtctgcatctgtcaagaaggccatcaagctatcggtctatgaacgaacgttgaagaaagcatcttctggaaagtccaaaccagtccctcagcttggagagcacccaaaccaggagatcgagccggttggtgacgggtaaagaaatgacgatagaacaatttattgctgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctgtattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattacagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatatgtatgcatatatatgtattgaaacatatatatgcatggtttatatatatatatatatatatatatatatatatataaaccatgcagcaacaggggcatgcaaaaaaaaaaaggtcagctctatctttagtcccggttatttcacccgggactaaagatagcgatctttagtcccggattggtactcccggtttggaaaccgggactaaaggggggttacgaaccgggactacaaagggtttctccaccagtgataggtgtattaatggtcttgacacttcagcgtgtgaagatagggccgtggggtggaactggaggccatgcttgggatgagggaggccatggtgccagtgctggcggttacaccggtgtacgccgaatgagtatagggtcttcctggtgtgtcagctcaatgttgtttgaatacgacgacaatggcaaacgtgtgaaaggtaccctgcaaggagagggaggcaatggaatacccgaggtatgtagcaagcaatacttgatagatttgttcttaggaagtgattttccaagtgaaaacaatttctccactccttataggatctactctatcttattagaaacttatatttattactgccatgtctacccaaaatctaaatactttttgttgacaattaaaaatcgattatagcatcctggattcaaaattctatatatactctactctttggactactctttggaggagcggcttgatgtacgcatggcacttgtagcgaggttgccttgatcagaagggggtgaatggttatcgcttaattttaatttcaatgtatacaacaaaaacaaacaagcggcagaaataaaacaaataatcattctagtactgttaatctgttataatgctatgacagccctaaattaaccaccctaataaaaaaaagaagaccaaacacaatacttaaattcacaacaccgtcgacaatcacgcgatgctacaatgcgtgaacagtgaaatcagcaaaccactacaactgaaaatcattagaacatcacctattcaaatccgcttgatgtataactttcaacataagttatatacatatttaattttaatcaataaatacgaaaaacaacagatgaatgggatctaaaaaaattttagtctgaaccaggagttcagtaaaatctagatagattaaaaactaaccatagaactgcatcataggtataaactagagttcgctgcgtaatctaaaaaaagaactgagctcaaatctaatgattatatcaaaatctagaagcagtataagatgactacaatgaattccaaaatcacattgctaaaatggaatatggctaaatttgtttagcgttagtgatcaaatcatgctccaatgagattaaaaaacaccccagctctcgtaacctcgtttctctcaaacccttaaaataataatcttatgctcttttgtttctcgtcttatctctttttcctctccctctaccttctacatccacccaacccacaaccgccagatccggcatgccccaaggctcgacaccgctcggtggtctcccagacgatcaaggtctcccgcagaagatgaagagtacggcgggctagatccatctgactacatcgtggtcctgcctttctgagccgcaacccacagccaccggatccaagaagctcaaggctggccaaaaccggaacgggctcactaaaggccagcctccaccagattagatgcccatcgctgcgcatcctccactcccacctgatccgccttcacccctccgctgccagtgccaccctcgtgtcaacatcgagcatgctggaggttgttgtcgtcgctgccgtcatcgaaccgcaaacctagccaccgtcgccaccaacatccgacatcgtcctattcgtcgcccgctccgggtggcttttacttaaccagtacctataaattataggtacaagtttttctaaaaaaaaccgacacctatagtatttgtgttgattttcctctacaaccagcatatatagttacccaaaggtgacgtttttgtattctttttcatcctgtggatttagggaaaggtttatatgtgccggttttaaatgaactcacacctatgaggcttttgcagtaatgatgcgctaagggttcagtactgtagctgtagagaaagaaactattgacttaattaccttcggtggaaaggtgggtaaattttacaattaatataccatttaaagaaatgcccacgcaaatgaatggttagaatttactcacaccagtgccccttgtcacttgtaccgtgtatcgtaaaacaactcctggtaacgacgatgggcacagatcatgaccaatttattaaagcccaaggcctctgcttcttgcttctgacaatctcataaaggttttcatgagcggtgagccggtgactagttcatttaatcatgatctaatagaacttatcaactagttgtattatagaatcagtagggactcttctttaatcgtggagttgtattaatttttccactgttttaattatgtaaaaacacagacaaatactcagtcgtcgattgaacggtttaatttgggagaaaattatttgacagaatttttatgctcaaatcatgcagattttatagccttaggataaagatctaaccgctggaaatatttgacataaaaaacaaactgaaaaaataaaagagcaaatttcatatatgattttattggaggcccaattttttttcctgagcccaaacacatgcccatacgaaggcccaaatttcttgagcccaaaccagaaagtacaacaaactgattctaaagcccaaattcaatatctaataaatcacatgcccaaataaacctagaggagcaatcactggcccaaaaatatagcgagaaaaaaaacaggaagcacaatttaaagctcaaataagctaaacaaaaacatgtcaaatatccaagaacaaactttcagatctactaaaatgcccatatccataaaactagcaaacttccatattgaattacccatagacatatactcaattaggtatatgctaatgcatagaagataaatttcactatagttacactgcaattacactaaaagttacagagtaattctattatagttacattgtaattacagtataactatagtgaaattacaatacacttacatgtcatatcaacttaacttacaaatgtaatattaggtctatagaattgtaattttatattttaaaggaaataataaatacatatttatttacacagtatttttatcaaaattacagtgcacttacatatcgtatcaactgaatttacgaatgtaattttagttatatagcactgtaattttctgcactaatcttagcgcataatcctacggctaagaaaacgttaaatacaatagaaaaaaaaaccactctatagacacagcgtgaaaaatcgaaaattttgaacagagatcgagtcacgtcgcgcaaaatcagaaatttcgcacggagatcgagtcacgttgactaccacgataccacgaggcatgtcgaaacacgggccctcatcctcatctcgcactggtctaggacgaatcgtagtgcaatatccgaaagaacaagtcaaatatcaaaaatctgttctcttgtgtcctcccctctcgatttctgtctcagggatagaaaaatctctacgtttctctctctcaaacagagataatgcaggcgcgaatttcaaaattcaatagttaatgtgggtcccacgaaggtcagtcaaaggactaaaaactgcatgtctatcaaagcccgaacataatcagcactaatctcaaagatgaatggatggcccaaaaaacgaatgatccatccatcctttttctgtcaacagccatatagcctttccgttaaaacaaacagcttgcagagagatgctttgtactaattaatcactgactgacaaataacctgatgcatggacgcacacaggaggagctcgacttccatggggaggtgttgacgcacatgtgcggctaccatgacaaccacctcatccggtggttgcagttcaggagcaaccggaacaggacgttcggaccatacggcaatcttggagaagacagagctggatggacgcggttcgaggtctccatggagcactcggggtccatcgtcggcttctgcggccggagtggcaacttcacggacgccatcggcgtttacgtcgccgtctggaatcccgagaggttctatgatagcatgcgcaggcagggcgtccgcgtttaccgggcgtcgcctctgcgcatggacctgcgtcaaatagaagaagagaaaaagaaggaagaagtggaacgtgggcgcctacagaaggagatcaaggaggggcgagaaagtcttcggaagttacgattgaagcttggagtggatgtgccgcagcaggatcaggaaatcgtgcagcaactggaacgcgggcgtcagggaaaacgccagacaatagaggagctgcaagtggagcatgagcaactggaacgggaacgagggcgcttgcttctactgcagcaagtggatgagcaactggaacgggaattgcgcagacacacctattgaaagagtcagaggagttacgctcccgggtaaaataaccgggactaaaaatccatcaggagcagttccggttatttttttttctcaaatcgatctgctccctaaatatccccgatcatattcccaaatcatccccaaatcaaagtagcatcacagatctggaaagaaatacatcacatattggaaagaaatgcatcacagatcacaatacatcacatcacaaaatctcaaacaaaaaatacatcacaaatcctaaaagaaatacatcacaactcccacatcagatctaatatcacataaatcacagatcaaatcca

SEQ ID NO: 72437 - DNA, 2670 bp, Oryza sativa
cccaaactgagctttacagcaaaatatattcttctataacttcatataatttgcataacaaatattctaaaaaaattacagcaaaacactatggtacaaggtataaactattagtgctttcactccatcatcagtacatactacatagtcatcaatcatcacataacagcaacacatatcagtccatcaatattcagtacttagagcgtacacagtaacaaagagtgatagaggtggagccgtggaggttgaggaacacctgctgctgctgggctaatggctgctgaaaggcgaggcatcgtgcatcggtggtggtgaggctgtccgcggtgtggccagtggccggcgtcatcggtgtcgtccgcgtcggcggcgtcggcatcgtcgcctcgtcggtggtggtggtggctgcgaaaatggtgggggcgaggaccgagcgagagagaggaaaggcggcgagacggcgggggcgaggtcgcgaggagcccactagccgaggacggcagccaggcggccggcggtggcgtgctcgaccccctggaggctggatgcgccgcctctctcgatctgtctctctcctctctagcctctgtagggttagccagttagggacctagggacttgggttgggcgggaacttgaggaggaattatggactatttggatgggcttttttttacttcggaaattccgacaaactttccggaatttttccgaccgattccgagttccgacggaaactgctattatcatattcgattccgtttccgagaaatttcgaccggctgattccgttttcgaaaacaggtccggaatccggaaaaaatctgaaccgttttcacccctacgcccagcccacctaccacagctgagtcacccaagaaagggagaaagacaaacaagacgccgaaactggacttcgcaatcaagaacgttccactctttagtgccaaccccgacaagaacggcaagatcggggcatcactaggcgagaaataggaactcgtgctcatcaccttcctccgggacaatgttgacgtgttcgcttggcagccgtctgacatgccaggggtactcagggaggtgattgagcacaaactcatggtgcgacccgacgccaagccagtaaagcaaaaactgtggagatttgcaccaacaagccatacgagaagagctcgacaagcttctcaaagctggtttcatcagagaggtactccatccaaagtggctagccaacccagtcatggtgcggaaggccaccgggaaatggagaatgtgtgtcgatttcaccgacctcaacaaggtgtgtcccaaggatcacttccctcttcttcgaatagaccaaccggtggactcaacagccggttgtgagttgttgagcttcctcgacgcttactccggctaccaccaaatcagcatggcgaaagaggacgaggagaagacaacattcatcacgcctttcggggtattatgctacgttaagatgccgttcggactaataaccgcaggaaacactttccagcgcacggttcagggcgcacttagcgaccaactcggaaacaatgtcgaggcctacgtcgatgacattgttgtcaagaccaagacaagcgactcattgattgccgatcgacgggaaacgtttgacaacctctgacgatatcgccttatgctcaatccaaaaaagtgcacgttcggggtaccatcgggcaagctgctcggtttcctcgtctctggcagaggaatagaagaaaatcccgagaagatcaaggcaatcgagaacataaagttgcctacaagactcaaggaagtacagaagctaaccggatgcatggctgcactaagcaggttcgtcgctaggatgggagagcgaggacaacctttcttcgctctactgaagaagcaagacaaatttgtatggacacaggaagccgaagaggcatttattgcactcaagcgctacctatcaaatccccctgtacttgttgccccctaacctaatgaagaattatttctctatatcgccgccacgccatattccgttagcactgtcattgttgtcgagagagagaaggtgcaacaactagtctactacgtcagcgaagctctccacgacgcaaagacaagatatccacatatccaaaaactactctacgcggtaatcatgacatcaagaaagctacgccactacttccaagcccacagggtcacagttgtatcctccttccccctcggtgaagtcgtgagaaacaaagacgttgttggccgcattgcaaaatgggtagtcgagctaagccaatttgatgtccactttgtgccacgaacagccatcaagtcccaggtactcgtcgacttcgtagccgattggaccatgcctgataacaggtcagacaaccaaatcgacaacgaaacgtggacaatggcattcgacggcgcactcaacagccaaggagcaggggcaggattcatcttgacatcaccttcgggagatcaattcaagcatgcaattcacctcaacttcggggcgaacaataacacagccgagtacgaaggactactcgccaagataagagctgtagctgcactcggagttaggcgactggtcgtgaaaggggatttcgaactagtcgcgaaccaggtgcataaagattacaagtgctctagccccgagtt

SEQ ID NO: 72438 - DNA, 25978 bp, Oryza sativa
atcacgaaaggaggagttagaggagggagtttcagattacgggagttacagcatgccacaacctgaagttcttcctaagcagaaattaaaattaataaatcatctcaagaaaatttttaagtcaagagagaaaccgtaaaatggcatgtgaaatttttcttgagttctacatgtcaaaatatactaacaaaaattttagtggaattttcagagccttggagataattttaatcaattaaaattaagcacaagcattaaataatcccctggaaatcctttctctctttttcccctttttctctcttttttccccttgttgggccgtcagcccatttcccctccgcccgcgcgccttgctgggctggcccgaggccaagcccgcagcccacgtgccccctcctttctctcccggggtcaccaacaggtagggcccacttgtcaggtccttccacaacctccggacgccgtcgacgcccatgctgcaaccgcctctcccaccttcttcgcccctcccgagccacgtcgccaacgaacgagcatgccccgctttccccgcgccccactacccccttacccactcgcccgcgcccacgagatgcccgggattcgaaatctgaatcccgcctctctctcctctcacacctgccccacttcgacggccatttcgtgctcctcccggccacgtccgagctccccgcccctatataaacactccccacctccctctcctcatttttcctcctttcgccgctcactcccgtgcatcctatcgctcccgcaccgtcatacctcccaccgtcgccttttaaccgcctctggcggctgctagcagccgcgctgggcctcgctgtcgacgccgccgcgttcgccgtgccgcgagccgccgtgtccgccgtccgttcggccgaatccgcctccgtaagccccttttcaccatgcgccgatgagcaatgccatggccgacgccttcggcccacgtccatgcccttcttgaactctccctctctctctaatccatctcatttgtttcgccaggaggttccggagcttgtccgccggtcgtcgccgtccccgatcgctcgccgtcgcctcaccgtgctcgtacgtcgtatagaatcgagctcgtccgacgctccgatttacttcaagatagtagccgaggtccctccagctggttcatcaatcatgttgctcctaaatttgcaaatgctcttttatttcctttaaatcattcttttatttacctattgtactcaactttactacttgtatactattattcctttgctatcttgggttgtaatatgattagatgttggattaggacttgcttagccttgcttagtcgaactagcacacaatgggggattctcgctaaatgcttagacattggtttagcataactttggacatgtaccaccatgatggtgttaatcaactaaaatacactaaatggtgggctgtgggtgcatggttttgctagtcgcacccatggaggttaaggaccgtttcgcgggaaaccctggaagaatttagtgtacttaccacaagccagcgttggcaacggctgagattgtagtgtagctttcctctagctgacgtacccaggctagggtgagcgtgatggagtttggatgggccatgcgacgtctatgcagcttccggattcaccgtggcacaagaagaagctgcccgttgcctgctagggtgcggtgcgattggttagaggggattatgcgaatggtcctgtcacggcctctttccgatatgccgtggtggcatgtcggcgcacgaaaacgtgtcgtggggctatcttgtgtgtaccattgtacacctctgatcagagtagaactattcgaatagccgtgcccacggttatgggcggttgaccagattcactgtgattaatcccacttaataaattggcttaatgaactggttagttcaggtggtggtttgggtttgtctcaacgtggtgtagcgttgagcagtgatgatttaatattgattaattaactacaactgttttactgctttcaactattattcttaaatgctagctttatgcaaatgaacccctttagctatccttggttatatcctgtatcataccctctattccggtatgacttgctgagtacagtgggtagtactcagtcttgctctatctcccaaccctagagttcgagtacgcttttgatggtggctactcagaggagtaggcttggtccgtgccgtcgaggatgcttgtggaatagcgccgctcactatccaagacaagaattagttttattttaccttttcttttccactgcatttatgtaagacttttataatgtttgtaagacgtggatctgtatgtcaatattgtcgtttgtgtaccctggccggtcctgggaatgggttttaatgcacattctgcttggagttctattcgggaatttctgggcatgacaagctggtcttagagccgaccttgatcgtaggacaagccaaatggaaacctaagagccctccgaatcctttttattgcatttgttctgtgcaattggatttgtttcaggaaaattgggattcgttccttcggtttatgggaaaaatcttgatcgctcgttcaattgaaatttattaaagaggtcagtcaagggttttagtaaaattatttgggacttatttgacagtcagtcgagatttaatgggaggaatgcattaggtcctagctgaggtgtattggttgcaaagtttatttatgttgtgattattattatgtatctaatttccgcattactttattgctcagttatgtcagttatatttattcgttcatgcaaaataatatatgtacaaaattttgctcttatttgtttgttttacttgagtcctttatcgtttcgcttatatttggatttgagcatgcattgattctctctcctttgtcttctatagatggccagccgccccaacacgcaccatggtcaggacatggaaggtttcgttgctgagctcgtctgcatggcatttgtggttggtttcccagcagagctggagtgcaccaggatttgtcctctcagtagcaagttcccacaccaggtccgttgtgaggtccatggtattccctcctacctacccaacatggtggtgacagcttgtgcaggcatagttgatcatgcttgcgaggaggctgccctcaagatgatggttgttggtatttcttaacgatattactagaaatataattcccagcaatggcgcagaaatactcctggtatattatggttacagagttcatccgcaagcacacggatataccattgtagcattttacctgagaatattccaagggtatcgtatttattttatcccgtggaaagatcatgtagagagaactcaactaataatttatatattacttgtgataatcatattctaagcaaaggttaagataatccaagggtagagtgacacaagcattactactcattctcgtaatatattatgtgagctaagtagaaagaaaagagaaagataatatattcctatacttttaatatacgtatcagtgttctaaaaatcggccctaggcgccgcctaggcgcccattaggcgctaggcgccgggtagccgccgcgattaggcattcaatggtgcattaggcggttaaattacttaggttgtgttttattgctattttagtgttatatagtctaatttctatgcaatatgcctactaatttcttgaatttaactatttgacccgacctaggcgcccgctaggcgccgcctaggcggggcctaggcgccaattaggcgctaggcgccccctatccgcccaactagcgcctagcgccttcttgaaccatgatacgtatacatacattctagttaactgatatactagctaataccctctatccgatgccctcttggtacttcgagaagccacccctgactgccgagttccttacgacagcccgtgatgaccatacaaccagggctaaatacggaggaataccctccccaggaaattaacttaggattatatcaccatcagtggcccacctctcatccgcaatatgtaatcccaaataatatcccctaatctagacaccacgtctaaactaccaaatactactctaatatcattttcatgacataaagtaattgcataagcaaacattatacccgtaccaaagcatctcccagataagctagcggtatattcagtataacatgaacataatgtaaaattggtactcatatactcggaaagtatttcaataccataaatgtatatagaagagtattctaataaaagtacaaagcttacaaaagagaagagaaaagcaactagagccatacccgaactcttccgaaggcttccggactcctgatttctactctattactattccactagctagatactactaaactaaacttgagagaaatgagagagctattgcttgaggtgtgtgttgaagtgaagagagtgagctccttatatataggtagttatgatggttgtggaaggggaattttccgatgtaccccgcaaccgccatctggagtagatctggcgcgtccctaccaaacccctcatccaacggtcgagaaatgggttcggccgaacctggggccggcccaaccagcccacaatttggctgtggcctcctggacttctcttctccacagacatgtgaattttggcccaattcatcatgtcaattatgagttcttggcccttttcatacacaagtctggttctcgatatcgtccgattgatttatcgtctgagttgatgtcgattctcctccactttattgtcattctctgcaaatggttagtatacctaatactagtggaagtttattattctaacagatatatgcattgcaagcatcactagttctcctctattttggtaatattgacggtcgaaactgattgataacgaccgtcaacaaaaccccccaagctagaacctttgctcgtcccgagtgaaggacgaaaggaaacaaagacttggttgttgattaggagttgctattttgctgcatatctcaaagatacaggtgcaaggtatatgtactctctctcagattaaataatctttggcacggtggcttaccctctatccgatgccctcctagtacttcgagaagccacccctgattgccgagttccttacgacagcctgtcatgaccatccaaccagggctaaatacggaggaatacccgccccatgaaattaacttaggattatatataggcgcggaggaatacccgtactgagctgtcaccatcagcggcccacctctcatccgcaatatataaccccaaataatgatatcccataatctagacaccacgtctaacttaccagatactactctaatatcatcgtcatgacatagagtaattgcatatgcaaacactatacccgcaccaaagcatctcccagataagctagccgtacagttagtataacatgaacataatgtaaagttggtactcatatactcggaaagtatttcaataccataaatgtatatagaagagtatttaataaaagtacaaagcttacaaaagaggaaagaaaagctactagagccgtacccgaactcttccgaaggcttccagactcctgcttcctattctaattctattccaccagctagatactactaaactaaacttgagaggaatgagagagctcttgcttgaagtgtgtgggtgaagtgagaaggtgaagtccttttctagctgaactatgacggttgtgacgattggaatggtcggtaataccctccaaccgtcataggggcttcatctacaccgtacaaccaaaacctagatccaacggaggcgaggcaggttcggccgaaccacaaggttcgtccgaacatggggctggcccaatccagcccaactttggctggcggcctcctctgctgcttcacttcgtagacttgtgaattttggcctgattcatcgtgtcaagtctgcgttcttggcccattcatacacaagtctggttctcgacatcgtccgattgatttatcgtctgacttgatgtcgattctccttcactttattgtcattctctgcaaaaggttagtagacctaatactagtggaatattattattctaacatatttatgcattgcaagcatcactagttctctcatgttttagtaatattgatggtcgaaactgatcgttaatgaccgtcaacaaaacccccaagcttgaacctttgctcgtcccgagtgaaggacgaaaggaaacaatgacttggttgttgatcaggagttgctactatgctgcatatctcaaagatacaggtgcaaggtatatgtactctctcttagattaaataatttttggcacggtggcttacccttacccctgattcccacgagacactgcttctccttgccttgagcggttgaaagacagaacagcaattaaagcaccaatcacccgatctttattcaactcttgttccggaagttttcaaatgattttgaaaaacaaaaccaagttcctcaagtgattcactcagtctctctaagtgtatcaaaatgaattcctcaccaaatgttgccttgttgattcctactctaaggttttgatatgtggcgctcggtagggatcaatcatggtatacttgcattcacatttattactaagtcaaaaacttagactaaagcagataactaaacatactcaagatcaagatcgtgcataaagtgtgtgatatatggtgtaaatggtgcatgaagaaaataaagaaaatgcttctcctttttgatttactttcttaatgcttctcctttttgatttactttctttctcccaaaaatccttcttttattggaagtgggcatggctacaaaaatttcttttaacatcatgctcatgcttgatggagtataactttatttatttttttttcatttcataaccatgcctttccctcccctttctttttttttcaaaaggagctttttttctgagaagaaagcacatggaagcatggaaaatttatttttgtggtgttaacgaccgaatttggtaatatcaccatcagaaaagaggattagatcgaagcggagtcaaaggcaaagatcaattcgggaacagagtaagaatcggctgaagtccgagtcggctacggctaagatcggcagagttcgagtcggacgaggttagccgattgagttgaatccgtcaatacaactcggtgtacgtcatcgggttgagttgatatgcttcaagatgattgccacacgtgggtagagtcttgagaaggcaattgtatctattaattaggatattttatgtaatttccttagagatatgtttgggcaaatgtctgccgcaaagacttatgatatcttagagtttgttagagataagagtcgtgtccgatatggagatagtttgtaattctcgggtataaattgaccccgaaccccttgtaattatttaacacacacgttcgatacaatctcggcgcatcgccaccctttttctttagttttatttcgacgagttcttgctttcgggttgagctgcatcggtttcgatcttcaacaagaggtaaaacttgttatgacggcttgcgttctcgggattagtgcttccatttttatgacactctaatcttgtttatgtaattcgtcgagttatcatatatcttacataatctctggcaatatcgctatctaacctacaatcggctaacatctttcagtagaggacaaccgattaggttagacatcgacgttgatttagattatataagatatctaccactctatgaaacttctagcggcttgattgtctagatattgttcttcttttcatacttaatgctgcatcaattgagtttgatctattaagtcgtgcttagaatatcaactctagcctgccttctggttgccgattagggtagcatcggggttttagccaatcttacctgatttaactacatttgctttatgtgttttattgacatgttaaatctgccctttatgtcaagatcttattgcatctaagtatattaagcttctgtttgatatattctgcttgttttaatatcttaacatagagttgtatcggagtatttgctgatacatgctatatctatctgattggctacgctatgaacatatatagtcttgttgttaatacatatttcgatctaagtgatttatactgtctcggcacggtgaccgatctatcccaatcacttgatttaattatatatcgacaccaggattatatattgttaatatctatggccaatcgagtagatttaattctttattatctatttacaaccgccgatcgatttaaatatgacatcggctcaaagataaatgttacgtcatcggcacctagccgatcggctatcatttatggatttaaccacggtttctttgtctttatttcttgttgattgcaggatcaaatgaactggcatgctagcatacccaaaggcaagtgtaacatacctgaattctaggattaaggaatttccatcaaaactagttgaaagggaagttcttcaattttgtaaaccaaaaatttctattttaaacctaggtggagttgatccaactcttgcaagaataaaatttgagaacaaattaaaaactttttcatctttaacctaggacttggatgcaacccaagtgaaagcatgcatacttgcataaatcatattttgacttgagtccttcatatgcatttggattttcgatttgcatttcataataggtctcatgaatataattgcaatctagacaaacaactaaaccattagggcctagtgctaactaatggaaaataatacacagaaaccatacaccttaaaaaaaatcaacatggataatgtcaagcctcacaaaactaatttggacatccatctgaagacatgtcatgaacatgaaagtgaacaaataaattatatcatatagggtatattctatcttaatcatctctataagcattctcttaatttaatactaaagtaaacttatgcataaatagggaaggagcttatgacatgtgtaaggtaaactgtaattctaacatatcaacatcacctcatgttaatgagagtccaaatataacttttataaacatttacatgcatttaggaaagggaaacacatataagacataagtcctgcgaattatctaaaataattcatgcaagataaaatcatgggaaaatttatgtaggctctaatcaacacatacaactcactgtaattttggtataatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtaatttatcatgaataaaaataatttttccagaatttatcttctctgtttaggtctcctaaaaattcgaactagtttccaaagaacccatattcctctaatttctgtgagtaatctatccataatttttgagtgcaaccaaagaaaatggaatttaggtatcttcatctaccttcagaaaaatccacactaaattattctacccacaaattaaataattgaaatactaaagtgggagagagaaataatccttaaaatcattcaaaccttttgttcacccacgtttctgcccaaccctctcaccctagcctagtttgccacgacctggacccatttggcagccactctggctcgtcctcaccctgtgcaaatcttccagccggaccagagacagccgagagagagagattggcgccggctgtgtacgacgcgtggcctcgacgtggcagcgccgaaccgaggcttcaactccacccagctgcgtcaccattcttcacccaccatcccagtgccgatccaaccgagggaggaagctccagctctccctctccacctctctttcgttgccggccgccaagaagagggacatcgccaaccgtcgtcgagctctcttcatctctaactcatactcggtccattctcatctcaccatgacgaacaactttggttttgatcccattccatttcatcttctacagcagcgggaacgccgccatgtcatggtcgctctagagcgcgctctgtgcaccgccgcagtgacatcatcgccgttcccgcttatctggaccaagccgggccaagctgtcgcgccagcgtcttcgcctcgacctcctctccatttcccctcaagaatctcgaaggatggtgctacgagtgtggagatcgtccaccgtcttctccacctctggtcaccatcgccgttgccgaatccaccccctccggtgagtaccaacccaattccatgcatcagtagcatctctggggcctctctaacctcatggacacacatgcatgatagttcttggagctgattgagccatcgccgttcattcggaggttcttgccgccgccgagccgttacacgagccgccgtcataaacctagctaccccagccatgtctaccatcttggtgagcacccttcagcctatagaacatacatgcatgcacccaattaaccaatacatgattgtagaagtacatgcatcaccacccgaaaacatcctcctttcggactcgccgccggcgttactccgatgtccactgaccgagaaaagtagaggaatggaatcgaaataacatgatcttcattttgtattttggttgcacccccaaacgagccatcgtttgtcgccggtgagctcgagatcgagctcagccatggctgttctgcctctgtgcgtgagaatttaaacaactataaggtttaatgtgcaacttttcaactcactgacatatgaggctaggtctgcgggttgattcttagaaacctcagggatctttttgtatattgatctttcactggcagtggaccccttggaaacaaaaatctgaaattataaaaggaaagtacctaaaacttgtaaaatccatataaaattaaatatagctcattttaagatgatacaaatttctgtgaactcaccaaattgtgaactttagtgttatggaataaaaacttgcactcacagtacaaatttagcctctaaaatttatccaagttaaatcacacataaagcatgcacaaacttataaaatgcatacaaaattcatttcaactcattttggaacaaactcagtttctacggatccaccaacttatgttctcctataaagaaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctagtagagtgaattatagcaccctcttacagatcatggctctgaaccttaatttggtagaataggtactaaacacatagtagtggttaaacaatacatatgaaaaagtatatatatgcatggtagctccaaataaatccaaataaaacttgttgaaccagtgaaggcatagatccatccccttccaccaaaacttagtatccttaactcatataataatctccagattgatatcttaagtttctaacatagaacatcccctagcttataaaatgtgaagtaaagtaatttgaacactaaaattttataaactaagattagattagttaactaaaatactcattttatacaacactagcaagttagagcaagttctggacctaaatctccaaagccatgtacacatagggactatatacctagaacacgttaaaacttgtaaaatatataaataattcatattaactctaaaaattatgaaaccaaatgtgttagtcttagaaaacaaatatcttcaccccagcaaacataaacttaataagaatcaccttacaacagcatttcacaatagtaactaagtaaatcctacactataccgacgaaacttctaaaattcataactcccaaataaaatgagataaaatagaaattctttcacctaaattcattttataccagtacctattctctgtgcacaaatcatgcattttagaacattttggatttttcgcatatttcggtgtttaattgcataacgtgtactttgtatagatgattgcttaatcggtgaagaagtgatttaggtgctgacattttcctgattcaaggcaagtcccacctccctctctttgatcactttgaacctatcttttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatggctataccactttatatatgagttttggtgacactaggttactataaagcttagccatgcttagaatggtcttccttgtcattatgggctcatttcaaacatgaaaattgatttttaattaatctggacagaactttaatacttgtgattttgataaataaaatggtggaaaacatggattttaggtttgggcctcaagtggtgcacatatggtgattagttgtgtaccgatagggggagagtgcgcccaaaccgacctaaggacttcactcaatgtcagttcatttcgtatacagtacaaccacatgtgctagtatgggatagcccaagcttagtaaattatttatggtttagccttatattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagttcaaggcgtgggccccccacttaacggttctaggtcatatttccagtatgactaggatggaggaacacgtatcgtgctggtgtaaggctaaatcatgaattttggaaaagctttgttgcgggtaataaatcgggtacttatgtatcgcgtgccatgcttttgcatgattattatttcgcatcatgtgggtaagtgtacaaactctgcagagttaaaactaatcgattagccgtgctcgcggtcatgagcagcgtgtggatatgtattgagtatagacttgtgtttattcttctaaatgatgaaatttaccttcaaattgtgatgagatttgagaatgatctccttgctgccatggatggcaatgaggtgaatatttatacatgattaatgcctaccttgatgcccaatatgtcaaatactagcttgctgaaattttatttgaaagtaagcctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctattgaattaaccttttgcttgcaggttttagatttagtctttgagtaatgcgggtattcgactgcttcttctaggacttgagcttaatggggtaaacccctagtcggtgtgcttgtggattgggtagacaagcttccgctgttctatatatttatttggccagttggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggcacatctcaagctgaagttgactggcaggctaaaggcccggcaatgtctccaatattcctctctcgaggcgtcggatatttcattatacttgtttgatgacttgaattatacatttcatctctcaattataatggaaggtccggagagcctacgacagcaagttttggacttgcactggagttaagcagatctcctaggcctcgtgttttatatcaacacgcttttggcacgcccagtgggaccgattagaagtcagaagtcttttctcatggacgacaagccgccgacatcaccgtccttggctagcccaggttctgttaaagtgaagatccagcagttagaccaatacgaggttaatgaaggcaacatcgtgaacattactccagacaagctgacacccgatcaaaagaaagattttgaagcgatgatgcagcaagcacggaaccagttcttaaactcatttatgcagacccgcaaggggacaatggtgcaaaagtacaaggtaagagaagtggctgatgtccccgggaccggttcttccaaggatggaggagtgaaacaagctccagatggctcggctcaaccgagcaacaaaggtgctgagatgattctcatggaaatcaaggtgacaactctcagggagttcaaggagttcaaggtgatggtgcccagggagttcaaggtaaaggccctaatcaagacggcaatgcaacacagttgcagttcaacaacttccaagatcaggttgactatgctgtacagcatgctttgatcaatcaatctggaatattaaccaatactttagcaaacatggtgaagtcaatggttgatggttcaatggccaagtatcaagctacaggaccagtctacttaccaggaggggtgttcccgaattatcagccactaatcaccgataatcaaccagttgtccagtcggccattaatgcaccatcggctaagccgatggcaccattaccagctcctgcctgctgcaccaccttcggttccaggccaattggttaatcctcgattgttggtgagagaacaatcatagcacagtggacggaatgtgaatcggctaacccaagacaaggttgcatctatgttcttacctcctcaacataccattgatccaacccagcaacagccgattcagcaaacaccgccaaggcagcaggttgtgcagccgattcaacaaacacccccagtccaacaggttgtgcaaccaattcagcagacgccacagagacggcaggttttgcagccgattcaatagatgccattaaggcaacaagttgttcagccggttcagcagcaaggcttagtgaatgcatcggctgggtttgcgatacctggtggtcagcctgtgcaacatagtgcaaatcaagttgtcctggagcacttggttcatcacgtacaaccatatagcacagtgattccttaagttattcctgaacatttggtgcgcaatattcagccggattttcaaaattacaagggggcaatttgaattataagtatcagccgccgtcaccgcaagttcaatagcaacaggcgggatcagctcaaccccagtttgttcctcaatacaaccaatttgagcccatgtcacagcagtctcaaggaacgcctcagcaacaaccatgggccgatttgattgcggatgtcatgaaggagcaatttgggcttaggccgaaagatgctggaaatttataccgacagccgtatcctgaatagtttgagagagttcctctccctaaccggtttaaagttccagattttttaaagttcttagggcaagatagcacatcaacttttgagcatgttagccgatttttagctcagtgtggtgaagcatcggctgtggatgccttgagggttaggtagttctggttgtctttgtctggatcggcttttacttggttttcttctttactgtatggatcgattaacagttgggccgatctggagaagcattttcacagctacttctatagtggggtacatgagatgaagttgtccgatttgacagcaatcaagcaaagacatgatgagcctgtgcacgattatatttagatgttcagagagatgaggaataagtgctacagcttaagtttgactgatgctctgttagccgatttggcttttcagggtatgattgctccaatcagggagaaattctcatctgaggactttgaaagcttgtcgcatcttacacaaaaggtaactttgcatgagcagaggtttgctgaagctaggaggaattctagaaaggttaatcatatctgtccttatatgtgtggatcggatgatgaggatgatgattttgaaatagccacagccgaatgggtaaggagcaaaaaggttgtaccatgccaatgggtgaagaattctagaaaagaggagaggtatgactttgacatcaccaaggttgacaagatttttgactttttactacgagagaagcagattcaacttcctgctagtcacacaattccgtcagttgaagaattgggcaagaaaaggtattgcaagtggcataattctgggtttcatactactaatgattgcaaggtcttcaggcaacagatccaagcggctatcgaaggaggcaaaattaaattttgtgattctaagaggccgatgaaggttgatggcactccttttcctgtcaatatagtgcatacagctagccgaacagccgatggaggtcgtacaagaggttttcaagtaaattcgactaagttcatcaataagtaccaaaggaagtatgacaaacagcaggagaagcattatgaggaagatgatgacggttttgatcctcattggggtcgtgagttctttagattttgttggaatgagggtatgaggctgccatctattgaagactgtcctggatgcggcaatactgcaaaaagttcaagccgatcgtataatagaggcaatcggccagggcagacaagggttcctgttcatcaaagattgggtcctgtaaatcaagattacggtcaagaggacaatgaaaacaggaaaactcaatggtgtccttctggtatctttactaagaatcagaagagaagggtcaaaagattgagaaaccgggaacgttttcaggaggttgaacaggaaatcaatcatcggctaaagagaacaaagccaaagcaggagtggcgcgttaagaaacaagctcctatagccgatgaggctgcggccgatgaagcaaagagattggccaaagggaaaaagcgttgtgactgcatcggttaacatggttttcacgttgcctgctaagtttgggggtcaagcaagctgatgtcgatgaggttgaggaggaatcggctaagttgtttttgtcgccagaacaagcagtcttcgagaaaccggaagggacagagaatcggcatcttaaaccactctatataaatggttacgtcaataagaagccgatgtccaagatgatggtcgattgtggggctgcagtgaatttgatgccttaagctacatttaggaaattgggcagaaatactgaagatcgcatcaagacgaacctggtgctcaaggacttcagtggcaatccattagagactaaaggaattctgaatgtggagttgacagtcggcaacaaaaccatccctacatcgttctttgtcatcgatttgaagggttcttacagcttgttgcttggaagggattggattcatgccaattgttgtattccttcaaccatgcatcaatgcttaattcaatggcaaggtgacaagattgaaattgtgccagccgacaggtcagtaaatattgccagtgccgatttggctctttgggagatggattgtcttgattgtttgtccgggaaagtttgggatgaagatattctaaaagtgtccgattctaatatatagccagttgaatatggagaacccaagcaattattttgagggcgtcgtggagggttcaaacgtctacaccaaggacacagtagatgatctcgatgacaagcaagaacagggttttatgtcggctgatgatttggaagaaattgatataggtccatgtgatcgaccaaggccgacatttattagtaagaatttatctgcagagtttagaaccaagttgatagagttattgaaagaattcagagattgcttcgcttgggagtattatgagatgccaggacttagccgatcgattgttgaacatcggctacctatcaaaccaggggttaggccacaccaacagcctccaaggagatgcaaagccgatatgcttgaacctgtcaaggctgagattaaacgattgtctgatgctggttttattcgtgcttgccgagatgctgagtgggtttctactatagttcctgtgataaaaaagaacggtaaggtcagggtgtgcattgatttccgaaacttgaataaagctaccccgaaagacgaatatccaatgccagtagccgatcagctggttgatgctgcctcgggacacaagattttgagttttatggatggtaatgcaggatacaatcaaatctttatggttgaagaagatatccacaagacggctttaggtatcctggtgcaatcgacttgtttgagtgggttgtaatgactttcggcttaaagagtgctggagctacgtaccaaagagctatgaattatatatatcatgatttgatcggctggttggttgaagtcaatattgatgatgtggttgttaagtctaaagaaataggagaccacagagccgatttgagaaaggtttttgagagaaccaggaaatatggcctaaagatgaacccgacaaagtgtgcttttggtgtatcggctggccagtttttgggatttcttgttcatgagagggggattgaggtaactcagaggagtgttaatgcgatcaagaagattcaacctccggagaacaagacataattgcaagaaacgatcggcaagataaattttgttagaaggtttatttctaatttgtctggcaggttagagccttttacgccattgttaagattgaaagccgatcaacagtttacttggggggcagagcagcaaaaagctttcgatagtattaaggaatatctcggctctcctccagttttgattcttccacagaaaggaataccttttagattatatgtgtcagccggtgagaagttaatcggctcagtcttgattcaggagcttgaaggaaaagaaagagttgtattctatttaagtcgtcggctcttggatgcagagactagatattcccctgtggagaagttgtgcttctgcttatatttttcatataaaaggttgaggcattatctattatccaatgagttcactgtcatatgcaaggccgatgtggtcaagtatatgttattggctccaattttgaaaggaagcgttggaaagtggatattttccttaactgagtttgatcttcggtataagtcaccgaaggcgatcaaagggcaagctgtagccgattttattgtagaacatcgtgatgattcaatcggctcggttgagatagtaccatggactttgttctttgatggatcagtgtgtactcatggttgtggcatcggtttggttataatttcccctcggggggcaggttttgagtttgcttatactattaaaccttatgcgactaataatcaagctgagtatgaggcagttctcaaaggattgcagttactcaaagaagttgaagccgatgctattgaaattatgggggattctttactagtaatcagtcaattggcaggggaatatgagtgcaagaatgatacattgatgatttataatgagaagtgcgagaactaatgaaggaatttcgactggttactttgaagtatgtatctcgggaacaaaacagtgaagctaatgatttggcccaaggggcatcagggtataagccgatgatcaaagatgttgaggttgaggttgcctcgataacagccgatgattggagatatgatgtacatcaatatttgcagaatccatttcaatcggcttctctgaaattgagatatgaagcgttgaagtatactttgttggatgatgaactctattatcggacgattgacagggtcttgcttaggtgtttgagtgccgatcaggctaagattgcaatcagcgaagttcatgaagggatttgtggtactcatcaatcggctcataagataaagtggttgcttcggcgtgcagtgtatttttggccgacaattctggaagattgtttcaggtattacaaaggatgttaagattgtaagaaatttggggcaattcagcgagcaccggcgtcggctatgaatcctatcattaaaccatggccgtttagaggttggggaatcgatatgatcggtatgattaatccaccatcgagtaagggacataagtttatcatggtggcaaccgattatttcaccaagtgggtagaggcgattcctttgaagaaagttgattctggggattctatatagtttgttcatgagcatataatctatcgatttggtatccctcaaatcattacgaccaattaaggttcaattttcgtgtccaatgagtttgttcagtttgccgatagcatgggaatcaaattgttgaattcttcaccgtattatgcacaagctaatgggtaggccgaggcatctaacaagagcttgatcaaattgattaagagaaagatttctgattatcctcggcaatggcatactgtgttagctgaagcattgtcatggatcgattcacatccctccttataagcctgtttatggccatgaggccgttttgccatgggaagttagaatcggctcaaggagaacggagttgcaaaatactttaacagccgatgagtattataaccttatggccgatgaaagggaagatctggttcaatcacggttacgagcccttgcaaaggttactagggataaggagcgagttgctcggcattacaacaagaaagtattatgtcacgcccagaaattcccgaatagaattccaagcagaatgtgcattaaaatccctgtccaggaccggccggggtacacaaacgataatgttgacattcagatccacgtcttacaaacatcataaaagtcttacataaatgcagcggaaaaaacgaaagacaacaggagctaagccttgactagaactgcagcgggaacaccactccacaggcatcctcgacggcacggacgaagcctactcctcggagaaacctccatctgacacaaactcgtactctggggttgggaaaaatagagcaagactgagtactacccactgtactcagcaagtcataccggaataggggtatgatgcagggaattatcaaagaagagctagagtggttcatttgcataaagcgagcatttataaatagaagttgaaagatttaaacagttgtaataattaattaatattaactatccactgtccaacgctatcccacgttgcaacaggcccaaccatccacctaaactatccaaattcaaaagattacactagggtgagactaatcacggtgaatctggttgaccgcccataaccgcgggctcggctattcgaatagttttactctgatcagaggtgtacaactgtacccacaagacacagccccacgacacatttccgtgcgccgacatgccaccacgacataccggaaagaggccgtgacaggacccttcgcataaccccctctagccaagcacaccacaccttaggtttcacccccgtccccagcgggcaacgggcagtcccctctcgtgcctaggtgaatccggaagcgacagaggccatcgcagggcccgccccgctccatcacgcccacccttgcctggatgcgtcgactagaggaaagctacactacaagcccggccgttgcccacgctggcttgtggtaagtacgataagttcttccagggcatcccgcgaaccggtccttaattgtcatgggtgcgaccagcaaaaccatgcacccacagcccaccatgtgatttattttaattaaccaacaccaaagcggtggcactaatccaacaataccattagaatcaacagcctaagccttaataggattttccccattgtgccctagttgaactaagcatggctaagcaatccctagtccaatctctagtcatgttataaccccaagctgacaaagggacatggtacaacaatagcatgctatgacaataggtaatcaccccatagtaacattataaaacaatgcaatatttgaagaaaaacaatagagcatttgcaatataggatcaacaagttcaagtgacaagcatgacttgccttgctctgatgctggaggaacctcggcgactatttcgaagtacaccggagcgtcggaagaaccggaatctagcgacatacaaggcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattgctataacaaaaagtccttaaatcatttattgcgcaataaaccccagggctgccgtcatcaagggggagggggtgcggcgccggcaagaggggcccacacggcagcggcgcacgggggggtcggtctaccgtggaccgggaccacgcgggtggtccaccgccggtccacgggatcgacgggccggatcggcccggggccgttcggacggtgcggcggcggactggctcggctcggctcggcacaaagccggccggacggccatggcaaggggggcggcacgcgcacgttcaccggcgacggcaagcggtggcgcgggcggcgacagcggacggcgccccggcggcgacagtgaccgaaggcgacggcgagcgcgggtgccggcggcgcacgggaatcggggaaggaaaggaaaggggagggagtcctcaccggaggggattgcgacgaccggcgacgaggagcgacggagggaggtcgacacgcggcggacggggaccgggacgacctaaagaacgaaaaggaaaagattagagagggagagaggggccatagaaggtgggaacgccggccgaaggcggcggacatggcgactctcaccgtcgcacagtgggaatggcactccggcggcgaacctcgacgaaggagggtggacggggtggatctcggccacgcgaacccgacggcggtgacggcgcggtgcggcggcgagcctagcggcggctagcggcagccggtgtcacatcctaaaaatccaaaaatatataaattgttgtttaattagaattattagaatttattttaaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaaagtttttaaaagtctcttttggctttgggccgaaagtcggcccaaaacccttccctctctctcttcgctgacaggtgggtcccgcctgtcggagtcgtcgtcttcgtcgcgccgccgccgcccgaaaccctagagccgcgccgccgccgttcccttccaaattcgatcgattctttccgtttccggccgaattgatagaggggaaacaatcttcgggatctcctctaccttttctcctttggaaacatcggctaaatcggtttggaaatcgttggattcgaggtcgaataggatcggcttttctctctctgagcccgatctttccttctcgtcgccggtcgccgtgggccttcgtcgccgcctcctagcccctttaaaaggatccccgagctctcctctacccgtcgccaccctcgccttcgcctctcgtcgccggtagagctctagcgccatgtgccctagcaccgctgtagccgccgtcgctccagccgtgcgccgccggcgtttcggtcgtcgtcgtcgctcgggaaggccaccgtcgggatcgccaagtcgtcgccgtcctcgtccgccccttcgccgccgccgaagatcgccggagcaccgtcgccaccgtcgacccgatcttctccgccgccttttcctcgacgtcgtcgccatccgttggtcttccgccgacgttttggtcatcggtgagttcgccgcgtcgcgctctacccgttggtgtcctccgttcgtgccaaagcgtcgccgttcgccggcgagcgtgcgccgtccgagccgtccaagccgccgccggagatgacgtcgccgctgacgtcatcgggacttttcgctgtgggccggtcgtggaccgatggatctcggccgtccattttggatcaagtcgatctcggccgtccgttcgcgtgaaccgccgccgtgcgcccggtccaccgaaaccctagccgctgacacaataaatcctcttttccttttcaaaaataattcattattgcgtcataattcaattaaaatttttctaaaattgagatctacatgttaaaaatatccacatgtactgttcatgcttgtttatgtgctgttttggtgattttgcttctttctgattagattccgtcgtttccggagagtccgttttcgcagcagaagagtttgaagagttccaaggccagcaaggcaagtcacccagatcccaaacaaccctttgagcatgttgatcctatttaaagctattgtttctattcaactattgcatttattttcgaatgtcattgggtggaattaacctattctttgttatagcccttttgttcttgattactttattccttgataccttgggttattataatttgactagttgagctttatttatattggttcaactagatattagatataattgcttaaccttgcttagaaacattagcacactattgggataacttatgattcactattacttaatgatggcttaatgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttacttttgtatagtatggttcattgcggggcaccagactgagaagtggcggagataagcccacgggggtcgctggggagtccatgccttgttttataaggatgtgattatgatccaggaatggtgcgctgcggtggattgtgttatgcaaggggtattgtcacagctcctttccgaggtaccgtggtggtattgaggcacatggtgacatgatgtggagttgtgtcttgtgggtacagtggtacacctcagattagagtaaaactattcgaatagccgtgcccgcggttatgggcgggtctaacaatgtctttcgtgattagtttcacacctctcatcataataacagatgctataattgataataatttgattagctcctggtttggaatggtatattcctggtttggagatagaactgtgcagccgggatggttgttcagaatggttgggcctgtacaacagggtatgttgtatagcgttggtttaatattgtttaattattacttaaccgttttattaaattctcaaatgttcgctaaatgctgcttttgcaaatgaaaccctattagcgcatgctttggtatcctgtgcacttgcatatttgctgcgagacttgctgag

SEQ ID NO: 72439 - DNA, 2965 bp, Oryza sativa
ctgcagcatccaagtagggtgttgcaagctacagcctacaagaggctacttttttagtatcagccattgatgtacagcaccctggtagatgcatggagttatacattcatgattctaccgccacacagaaaatattatattgctatattgtaaaaggtctaatgaagtatctttaaaaaaacctctcagaaggattaatccaatcttttcttttttttttagagcatggaggacttctaaccatgtcttagcatgattttgataccctgtggcccatggggagttggatcctctaaccatgtcttagcatctgtttaaaagagtttttttagtggctacaacttcttctaaaatttacatctccgctatgcaatttaaattctcatctaatttgttagactctatatttataaaatctagaaaataaattaacagttagaaactatgaaacccaacctttttagattttcattactcccttcatgtcaaaatataagaacctagtcatatcggttgagatgcattctgtactatgaatctgaacatattcagcactatattattatattttaggatagaagaagtagatgacttagtaatcactagctgcatattataatctcgagctccacaaacaatgtcttaatcaattgatagtctcggataacttcaggcgtcgagttgtaccatcaaactgaggattttggaggcgtctgaacatgtaccaacatgcctaattgcctatcaaagtagtcctaatgatgcaacatcaatgtctggattgggtccaatcatgtctggccatgtcggttgtagaccaaatttgtaggaccctggactccagtggacatgttataagtacatcacataggtacgtagcaccattaagtgtgaccgtgtcaaaagggaggagctagacgaatggattgccacttattaacctgaagaaagtgtcttgtgaaagcacggtcggtgatgtcatcagtcatctgactgaaaatggttatggtactgttcagctagccacttgtgagtctccctccatcaatattgttttacagcagagatattccagcatttgttcttggactagacgtcttgattagggatgaaaacggtcggaaacgatcggaaaacagcctcaaccatttccgtaaccatatttttctcggaaaaggtaaagtcggaaacgaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatacataaattcaagcttatactatataaattataaattaacttcattttagccatgtacaaaagttagagatttattgaagagtcattcaatctataagctgtgggtcaagtatagacatgtcctataatatcgacatatttagaatacggtaattaccatattataagaaacggtaatttccgcaagaatacggtaaatacggaaatgataggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctagtcttgacgaacgaaaagttcatcgagctaggcagagtccgagctggaaatatgaactctgaatatagttacactgaatttgatacaatgtaatcacgtgaacaaccaaaatggatcatctaatttactgctctctaactttaaagtagctgatatgtaaatcacataacttatggtccacatgtcagcgacctatgtcagagaagtttcttcctatggacaacatagtttgaagccatttttatttgaagccttactaaaattttgataggataaaatatattagacagtttaatactaccaatattttatattagattgtctcaactacatagatttgataaaaagttgtatccaatcaaaacaactatcacgatcggagaactcatttttactaccggttaacaacctcttttattatcgattgtaacacgatctttagtaccgattgaaagaaccggtaataaagatgcgtactaaatcaaaaataacatgtgggatataggattcaaactcaagatctctcatctcaaccctcacacacgttaccatcccgcctactacacacatctaacttgaataaatatattttccttttaagctaaccctgaggcatctttagtaccggttggtaatattaaccggtacttaaaaatagctttagctagtccgagttggtggtaccaaccggtattaaaaatactaacccgcactaaagatcttttagctttagtctcggttagtgttatcaaccggtactatcttataggggcttgaatttttagaaccggtagtaatgcatctttagtacctatttttaatctaaccgagatatttatgtttaggggagtaagaccctctttgtttaggcttaggcttattggcctagacttttaagtcagtttattggcttatatgatttataagccagtggatttaatgtcctaagtttagtggtggagtcatacatctatctcatataagccaaaaaagcttctccaacctagcttttggcttaatagtgttagagtggcttatggcttcaaaaaagccaaataaaaaagttgcttgtttgttttggcttagactttttgacttataagttggcttataagcctaaacaaagagggcctaagataaaagatcgtttctagtaatgtactgctcaagttagcaaaaaaattggcaaggggcaacaaacaaaaatgcctcttccggttctttctctccctctctcttactcttttttcttgccaagcatc

SEQ ID NO: 72440 - DNA, 10171 bp, Oryza sativa
tatataacttgtgattgactcctcaatcacctttgccatgggcatgcacttccataatctataacattgagggacccagagatatctctccataggaggggcaaatcccatcttgattattcatatcccacaacatgtttcatagcatacccgaaaactacttttatagctacccatttacggagtagcgtttagcagtccctaagtaagctactacacatgttgagaagcatgataatctcaggtctaaggattcaacaccaacactaaatgagatcactgatgacacaacacatatggctcttgcagtgtctcatgttgggtctatccaacaacatgttcaccaacatgtgtccatattattaatttggtatctctataccatgatccatgagacatgatcatcaattaatatatgtgctgatcatataaacatatttgttccacatatgatatttgatcagggatcctttagaaatagtaacaaacaacataatgattctcatgaaagaatcacatattcattaaccaataaggagttatctatttcaaggaacaatgttggataaatatgtaaacaaagtatgtgatacaatcatctctataattgcctctagggcatatcactaacagtctctcacttgcactagagtcaatcatgaacgtatcatatacccattgccctagtgtgtgcctcatgcttaggctgagggagtggctttgtcaacggatctgcaacattcaaatccgtatgtattttgcatatcttcacatctcctctacccactatctcgcgaatgaggtgataccgccgtaaaatgtgtttggacttttgatgcgatctaggctccttggcttgcgcaatggcaccactattatcgcaatagaggtccattgggctagaagcactagtcaccacacctagtcgagaaatgaatttctttatccaaacagcctcctttgctgcttcagaagaggcaatgtattcggcttctgttgtataattagacactgtatcttgcttggaactcttccaactcacagcgcctccattcaggcagaacacaaatccagactgtgatctaaaatcatctttgtcagtttggaagcttgcgtcggtgtaaccatttacaacgagctcttcctgtcctccattgactaggaacatatccttagttcttctcaagtacttcaggatattctttacagctatccagtgactctcacatggatctgattggtatcggcttgttgcactaagtgaatatgaaacatctggacgtgtacatagcatagcatacatgatgaatctgattgccaaggcatatggaatcacactcatcttgtttcgctcatcagtcgtttgagcacactgattcttgccaagattaatgccatgtgacatcggtaagaaacctttcttagaatcttgcatgttgaacatcttcaacacctttcaatgtatgtactctggcttaatccaattagcctctttgatctatctctatagatccttatgcccagaatatatgttgcttcccctaagtccttcattgaaaaactatttttcaacgatgtcttaacggattcaagcataagaatatcgttcccaatcaataatatgtcatctacatataggattagaaacaccagtgcgctcccactaatcttcttgtatacacaagcctcttcttcgtttttgacaaagcccaacgccttgactactttgtcaagacgaatattccaactccgagatgcttgcttcaacccataaatggatttctgcaatttgcatatctttttagctgattgtggatcaacaaatcccttgggttgtgtcatgtacacatcctcatcgagatttccattgtggatagctattttgatatccatttgccatatctcataatcgaaataggcagcaatcgctaaaacaatccgaatagattttagcatggcgactggtgagaaagtttcatcataatcaacaccttgaatttgtctgaaacctttcgccaccaatcgtgccttgtagatgttaaaatttccatctacatctgtctttttcttaaagacccatttgcactcaatggcttttacaccattaggtggatcaaccaatagttccaaacttgattgacatgcatagattctatttcggatttcatggctccaagccatttctcagagtctggtcccaccattgcttcctcataggtagtaggttcatctttgtctaacaacaatatatcacgttgtcctgtagttaacaacgcatacctcgcaggtgtacgtcgtatcctatcggatcttcgtgaagccggtgcttccacaactggttcaacaacaacttgttcaacctgttgaacaacatcttgctcagcttgtggttgtgtggacgttgaagcgttttccggtgtttcttgaatttcttcaagttgcaccatgctcccactatcctgtcttgaaataaactctttttccaagaaaacaccgtgtcgggcgacaaacactttgccctcttcccgattataaaaataatatcctttcgtttccttaggatatcccacaaagaagcatttatctgatttaggtgtgagtttgtctgattgcaaacgttttacatagaccacacagccccaaatctttaagaaagacaaactgggacgctttccagtccatatctcatatggtgtcttatccactgattttgatggaaccctgtttagtgtgaacgcaactgtctctagagcgtaaccccaaaagcttagcggcagatcagtttggctcatcattgatcgtaccatgtccaacaatgtacgattccttcgttcagacaccccattccactgaggcgttcctggcggagtgagttgtggaacaattgcacattcctttagatgatccccaaattctaggctcaagtactttccaccacgatcaaatcgtagatacttgattgtcttgcccaaatgattttgtacctcattctgaaattccttgaacttttcaaagtactcaaacttatgcctcattaagtagacataaccatatctactaaagtcagcggtgaaggtaataaagtacccaaaaccacctttggcagttgagctcattggtccacatacatcagtatgtactagtcccaatagttcacttgccctttcactttgacccgtgaaaggtgcctttgtcattttgccaagtaaacaagattcgcatgtctcaaatgatttaaaatcaaaagagtgtagaagtccatctctatgaagcttctgcatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaatcattgtccacttcgcctcttgctaagctcctacttcttttcagcccctgcaacgatttgcatatgtgagcaactgacccggtatcaaatacctaagaatcagtagaggaagtagcaagattaatttctataacattaatacctgaggtggaactctttccatcctgctgcttctgcttgaactgctctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgacaacttttcttgttgttgggcttgcgcttatgcacaactatcacatggttggagtttttcttaatgctttcctcagcagtctttagcatcccatgcaattctgccaaggtcctgttcaggttgttcatattgaaattcattatgaacggctcaaagctgggaggtagcgactggagaatcaaatcagtaaccaactctcggctaaggggaaaaccaagcttatccagactctcggcgtaaccaatcattttgatcacatgtgggctcattggattaccttctgctagcctgcacgcaaccaaggactttgaggtattaaacctctcagctcttgcttggtcctcaaacatgttacgtagtctcgtgattatcgtatgagcatccaatgcatcatattttctttgaagctcaggggacatagtagcaagcatgagatagcttgtatcaagataatcattgcatcgcttttcatgctccctacgttgagcagcaggagcattgttgggcaagttagcttgtaaaggctctgtaagcacaaactctttgtgctcttgcctgagaacagttctcaggttgcgataccaatccatgaagtttattccagtcaacttctctttctcaagaatagaccgcaagttaaaattggatgatgcaggagctgccatgatctacaatagaaatatatgtatgcaaaatcagcatcatgtttacatttaacctttcattaaacaatttaacaaaagatacttccactatgtattgtgaaacaaaattccctctagtaacatagtgagtcaagatcctcattttattagtgtctagtgagctttggcatcatagctagacaactatcaaaataggtaagcaacaccttgctaatcacatcatatgtgactcttgtgctgttggggtgacatctccatgtccaacccaacctatgccccaaggtccaaaactgttttaataaccttgtcaagtaaaccaataatctccgcacatagatgtccgacatctatcctattttatcatgataaaaagtgacactttgctatgacaaacccatcacttatgatcacaaccgtattaggtgcaattactggaagagcataaatcacacttaatttttctgagggaatctatcctaccatgtcatatcaaatatacaacagcagtaaagtaagatagatataaaaaccccaagcgaaatctaaggggcaacgcacacggcggtacatagatctgagggaatctatcctaccatgtcacggggtacatagatctcatctacgattcgccatgtgaaaaccttaacggcgtaatcgaattatgccgaaaccgagtcaatctcactggctcattttttctcattggcgtacggttccagtggacatcggactatccgatgaacacaatcgcgctcagccttggtgagtactagacattccagtgaagtcaccaacccatgcgactatcggttcatctcatcaacccatgcggctatcggttcatctcatgttccgatcacctaagaactcatatacaacataatagatctcatctactacacccgcatatcaactatatgcaatgatctagatcataaactatacaaggcggctctgataccactgttgggataagcgtaagctacgatagcataaatcaaacatttctatcgcataaaccaggaaccaagcaagtattagatcatatatcgttaccactcgacgcgctgcgcagcggaagaagacactgagaagtcgaagaaactctcgcgaagtagcacgcgtcgttgtagaggaagtagtcgatcgcaccggctcgaccttctcctcctcgtgcgttctccttgccgtactcctacgctgatcagcaccgcaaaccagcggcgcctctaccggtatccacacatacagggacgaaacgccacgcgcagatgtgctagcacccgcgcgcggctagggttttgctcggggagggaagtgacggctagggtttctcacgtgatgcaatgcctccaccggtcacacccctcacgaatatataggatccatcactcgggcctccaaggcccgtaagactcctatttggatccctatacgaagtatgctcatattggatctccatccaatccccttagtccggcccattaagcgtgcgaccctgtaggttcatgtatactcggctgcaacccgaaaactccttttcggtccatgcgtcaacagcggctcctagtagaacgaattgacccaccgtgcatacataaagatcatatcggctgaacctctagtgtatacttgtatgaacccctttgcctcacgatatcgattaagctcaaggctagatatatgccatcctctaatagctcaatcattcactcgaacctgttgatagattatgtaacttgtgattgactcctccacctttgccatggccatgcacttccataatctacaacatcgaggggcccagacatatctctccataggagggtcaaatcccatcttgattattcatatcccactacatgtttcatagcatatccgaaaactacttttatagctacccatttacggagtagcgtttagcagtccctaagtaagctactacacatgttgagaaccatgataatctcaggtctaaggattcaacaccaacactaaatgagatcactgatgacacaacacatagggctcttgtagtgtctcatgttgggtctatccaacaacatgttcaccaacatgtgtccacattattaatttggtatctctataccatgatccatgaggcatgatcatcaattaatacatgtgctgatcatataaacatatttgttccacatatgatatttgatcaaggatcctttagaaatagtaacaaacaacataaagagtctcatgaaagaatcacatattcattaaccaataaggagttatctatttcaaggaacaatgtcaaataaatatgtaaacatagtatgtgatacaatcatctctatgattgcctctagggcatatcactaacagtgcatgcctcgctgacgggtctggagtcgttcctcgctccaacccatattggagaccatcttctctattaaatcaacggttcctcgaaccgttttagagaagaatgctcctccagctgcctcgaccatgtgatggcgggacattggggtgagtctattataaaagttctgcaggattaatcagtcttccatcccatgatgaggacatgcggccacatactcctgcagacgttcccatgcttcccgaatggactcgtcccttgtctgctggaaactggaatccgtccatgaagggcattggttttgcccgttgggaagaatttcgagaggaatgccgtagaacatttgtcctaggtgttgacagcagcatgattggcgtagaaccactgcttcactctcccgaggagggagaacggaaacagccttagcctgacggcgtcgggaccgacgcccttcatggtgcacgtgctacagatctccaggaactgctgtagatgagcgttggcatcctcgttaggcttgccacagaacgggctagcctgtgccaacgtaacgaggctggacttcaagtcgaaatccacgtctcccatgttgatctgtggccaaatggccacattctcagcagagggagcagcgaactcgcgaagggtcttgtcagccatagtcttgaaggatgatggcgttggtacaactggtttctctgtcggtagagttttctgcggagcaatgactcgcgacctgatgctccggatgaaagcttctagattttcttgaagtttcccggcaagttggaaccagtcatgcacgaccctgttttcacaacaaaagtgaaaacaaccaaggttatacagaggtaaatataaagtattagttcagttaatctctgttatgaatcttccccttcaacggcgctagaaatgcttgttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatttatatattacttgtgataatcatattctaagcaggggttagaataatccaagggtagagtgacacacaagcattagctacttattctcataatatattatctaagctaagtggaaagaaaagagaaagataatctattcctatacttctaatatatatagtatacatacattcttgttatctgatatactagctagtaccctctatccgatgctctcctggtactctgagaagccacccctgactgtcgagttccttacgacagcccattatgaccatacaaccggggctaaataaggaggaataccctccccagtgaattaacataggattatatacacacgcggaggaatacccgtactgagctattgccatcagcggcccacctctcatccgcagcatataaccccaaataatgatatcctgtaatctagacaccacgtctaaactaccagatactactctaatatcatcgtcatgacatagagtaattgcatacacaaacattatacctgcaccaaagcatctcccagataagctagcagtatattcagtataacatgaacataatataaagtaggcattcatatactcggaaagtatttcaataccataaatgtataaagaagagtattctaataaaagtacaaagcttacaaaagaggaaaggaaagctactagagtcatacccgaactcttccgaaggcttccggactcctgatttctactctattcttattccactagctagatactactaaactaaacttgagagaatatgagagagctattgcttgaggtgtgtgagtgaagtgagaagagcaactccttttatagcctcccaatgacgattgtgatggttggaatggtcagaaataccctccaaccgtcattgggggataatccacaccgtccaggcgaagccctggatcagatggcgctgatgagggttcggcctaaccccctggttcggccaaatctagggccggcccaatccagcccaatttcggctagcggcctcctccgttgttcttctatgcaaacttgtgaattttggcccagtttgtcgtgtcaattctaagttcttggcccattcatacataagtctgattctcaacatcgcccgattgatttatcatctatgttgatgtcgattctcctccactttatttttattctctgcaaaaggttagtgaacctaatactagtggaatattattattctaacatgtatatgcattgcaagcatcactagttctcctctattttggctatattgatggtcgaaacttatcgataacgaccgtcaacaggcttgaaagagaatacgtcccacatggtagagctgaaagaacccttgtggctgcgattggaatggatatcccttgaagaatttatcacgataacactattccatatgattatgcgaaagtgcagttgcaagtggtgaacaaagggttagagtcatacgatctggacatccaaactcctgatggcatatccgtacttggggatgcggttgacattatagtattgtagcacataaagatatactctttgggactggcaacaatgctctgtcgaaaccactgagacctcctcaaaaacaactatcgaatgataaggtggaagaacatgagcaacctaagagcactgaagtggcatctacatcagcaatattgtcaattatgccagcaatagaaccgaaatcgaagtcgcaacaggtttggaatgggtcgaaatagaaccagatgtgtatgaggatccatctcctgcaaaagacaacgtggacgcaccctcggtcgatgactatgtcatcgacaagtccgaagtgcctaaactggtcaaaagccacaactccaagtccaaggataatcagaaggtgaagtggatggtaaccgccttctgaggtggtaaaaaacgtgccaaggaaagagatgttgatgagaagaagaccggtgaacttgccggcccaaaatactttggaacagatgattgtctggcagtgtttgaaaatggcaaagccttttggctggattatgcacttgaagaaggtccgtgggagatgagaagattacataaatggtacacggacgccaacaagaaaggcctaatgtcattagctgtttgaacatcacctgatgctttcatggccgaggaaggtttcttgtggctcaatttcgctgatcttcacgccgtctgtcggtgacatgggatcaggagtatcatgact

SEQ ID NO: 72441 - DNA, 11691 bp, Oryza sativa
cttggcctctgaaaccgctgccatgtatcaggctgcagccatcaagtttgaaatgaggggtggccaatggaatcgtgcgtatgttcagatggatggagagccatggaaacaaccactcctacaggagcagtcaaccattatcgagataaacaaagttccttacccttctctgatgataaatggggagcaatgagatcttccccgatttcaatcaggtaatattcctgaaagttcatttttctgctctgtacagcatctcgtttgctgatagctccctactcaccggtcgtcagttttgcatttcataccagggtcgtattctagatcgttagattatgtatagttcgggagcagctgcagggattagccatggccggagcacaatcgggcaaaatgtactgttgtatcatataaattatgttgtgtcgtaggttatttcagtggaaatcaaatataacttgatttgtaatgtatttttaccgtcaaaacaaacaaaaaaaatcaagtggaaaaacacaatgtactgtaaattactcagatttcccctcctgttatgccaatttggaaatcttttgctgctgggcttgaactgaggatatgttcagtttgtcgctattttcaatgccaaaattctggtagggttgtgaattgagtgtcgcccagtgagtggaatgtagtagaacctatttagctggtttaagtactagacttaacatgagtgcatgtatgtactacttcatatcgacaataactcaatattaagatatataagcttagtctctaagatgtgtttagggaaaataagtatgactaacggaaatttatcaatttttttagctggtttaagtactaaacttaacatgagtgcatgtatgccctgcttcttatcgacaataagtcaatattaagatatataagcttagtctctaagatgtgtttagggaaaataagtatgacgaacggaaatttatcaattttttaagtagttaagaggtagtataccgatgaacatgctttcatgtatgtatttgattcccaaaatacatctacattaatcacatattattgttgccatattacactttacaaagccactgccaatgcttcatcggtcaagttgctgaatttctcatctactggtagtagtacagtagtactaggatctatctacaggcgaggagacggttgcacactacttgtacttgacctgtcaatgttcatatcctaccggacacgtctactgggagaacttgccatgtcacatgtacatctaccgcggttgagatgttcccgccaccaccgctgcccgatcggacgagttatcgaactccgccgccgccggagacacggcgccgttcctctcctccgagctcgtggagatgctgaacgggctcatgccgccgacgacttcctccgggatccgtccggcgtcggcgtcggcggcgccggcgacgttgcacgggctctcgtcgccccacctcggcgtccggctcgcggcgtactcgctgccattcctcacggactcgtcgctccacctcctcttgaacgtcggggacttgaggtccttctggtcgtagtgccgcgcccacgcgcgcagccgccgcagcgaccggctcccggagccggagccggagccggaggcggcggcggccgcctccgccgcacggagctcgtcgcgctcgcggtagaagaagacggcgaggtagatgaggagcatggcgctggtgaccacgccggtgatgaggaacagcccaccgaagctccggaagctgaggttcgacgagccgacggcgctgccctggctctggcacgcgccgggctcgccgaaccacttcttctcgatctgcgccatcttctccccctccgccagcgtcaggatcgcccgcgacacgtccgccaccatcggcgaccctctcgggaacacgaacccgaagccgtcggtcttgtagattggtccgaccatggtgtagccgttgcagtactgcgagaggaagagcttgaggtaggggatctcgtcgaagatggcggcgacgccgccgttcgccgagcctttggacagcgcgtcggcgtactggtccaccgtgctgtagctcctcatcctcccctcgaagcccatcttctcgagcaccggcacgatgaaggtcccctcctggaacccgatgtagtcgcctcgcctcaggagctccctcacgtcggtcaccgtcggctgcagcttctggacggtcagcatcgacgtcaggctcgccgtgtagctcgacgtcagtatcagcaccacgaacacccatatgatcaccacgaacctcgacaggttgctctccagcttctcctctaaaaaaacacacaattgaaatcgccactcaaaaatcatgttgctgaattggtagtagaaagtaccccctccatccctaaatatttaacaccgttcacttttttaaacatgttttacttttttaaacatgtttgaccattcgtcttatttaaaaaattaagtaattattaattattttcatatcatttgattcattgttaaatatagtactactactcaagtttttgaataagacaaacgattaaacatgcttaaaaaagttaacggtattaaatatttagagatggagggagtagaaatgagctagagaagaaaaggaggatgcaagcacgtactgtgggagaagacgagggtggagaaggagaagtagaagatgaggccgaactgctgccatggcgtgccgcggaactcctcgttgatgcggtgctcgatcacccagacgacgaagccggtgaagcagaagaaggcgaggctggcgagccagaggctggtggtgagcggctgcaggaagatccacatgctcgtgctcgtctccttctgcaccgccaccaccatcgaccaccccgactccgtgaacggcatcgtgaagtccacctcctccatcctgctcgccgtgatcgtcacatcccccaccaccgcatctgccttctgcaaaccaaacattgcaattcaaccactctgatcgggtaaagtgatttcatacttcgtatatgtcatctaaatagttataatttttttttaaaaaaattggcaatatagattagtattaaatatatcactccacaaacatacagttaaaattcagcttctacaagttgcaacaaaaataacaaatacatatgtgaatgagctacaactattttcaatttaatttgttttttttcaactaacaaaaatcgaatttgatattgcatgtttgtggagtgatatatttcatattcatccatgttatcattttttttaaaaaaaattgctaactatttagataatatgtaaacaacgagtgggtgaaaatccacgtccctctgatcgaacaaatcaaacgaacagattgtctcaagaactcttgaactttggcatgtactgacctgtgacgacacctggtcgacgagcttctcgtaagattccgggctatcggggtaagggtcgtacacgtagctcaccggatagggcataatcttcatgacctcgtcgaacacgtcgatgcagtagccggtgatgtttcgccgcccggtcgccgtgacgttgccgacgtcgacgaactgcgtgaagccccgcttcgtcggcacgctgacacggagcggcagcccgctcggcgacacggtccagcctctcggcgtgtcgcgcggctcgccgggccagaggatttgcctcagcgtcttggcgctgccggcgttcaggtcttgcgtgatcccgaactccggcgtccagaacccgaccgtcctggcgcccttgccgatgatgttcacgacctcgtacgccggcggctggagctgcccgtcgacgagcctgaacttgccggcgagcccgtcgaacgtcgtgctcaggacggcgttgaggagcgccgtgccggtggccgacacgccgagccggtccaggtccgtcagtggcgcgctcgtctgcggtgtctggaacgccgggccggcgacaccggccgactccgccgccgcggcgatcgcccacgccgtgtcgtacgcccagaacctcaggacggtcggctcacggacatcgtcgacggtggggtgatcccggcgtagcctcgccttgaaccgcgccgagaagttcttgacggcgtcggtctcctgcacgtacggccggaggctgaccacgccctgcatcgcgtcgacctcctccggggagaacctgtccatgaacgtggcgacgccgtcggtggccacccagatgtagccgtcggacatcatgccgagcatcttcgcgcggcggaacagcctcccggcgacgttgtggagcatgtgcacgacgaacacgcgcgtcggcatcgccctgaggcggtacagcagcgcgtcgaggcggtcgtcggtggcgtcgacgggcaccgccgtgcggtccatgatcttggcgccggcgccctgcagcgcgtcggcgagcgccgggaggatgccgctcccgtacggcgagtcctcgtacacgacggccgcggcgcgccagcggaaggcgtcgaggacggcggcgacgggcgcggcctggaaggagtcgttgacggcggcgcgcacgaagaacggcgtctgcgcgggggacagcgacggcgaggtggcggagtaggacagcacggggacgcgggagtggctgccgatgtgggcgacgaactcggtcgctgccgagctcggtggcccgatcatggcctgcacctgcacattcttgatcaggtccaccgctgcaacgacagcaacaacaacgagcagccgctcagaaattggagccaagaatttcgcagttgagactatcaattatgaaagttgttgatctgacagttatttcagcttctaatctgacagttcttgagactatcaattgtgaaaagagttttgataccgtttattgcatcattaatcaacttgatgcatatcacttattattgattactggtgcgaagtcaagtcatttctagcattctaatcagttattttttcgaaattagatcatttcattgatatggctttctttttttaaaaaaaaaatcttaaaagatgaacaactctacataacagaagaatcaaaacaaaagcaactattcagtggggttcgatgcttgatttgaacaaattggtatgaacagatattgggcatcaaaacctaaagaaagaacaccaggttcttctttcggtgagacgttccttgacccagatttagaccagatcaggcaaaaatggtactccctccgttctataatataagggattttgagtttttgtttgtattgtttgaccactcgtcttattcaaaaaaattgtgcaaatataaaaaacgaaaagttatgtttatagtactttagataataaagtaagtcaaaataaataaataataattctaaattttttttgaataagacaagtggtcaaatagtgcaagcaaaaactcaaaatctcttatattatgggacggagggagtagcttaggtgcaaagcagagtctggggtgactggactgcaactacgattctattttgttccttcagtcctcctgataatacacagtctacactaatattaccctaccagataattatacactaacacaattggcagtcttgatcatacgatgactcataatattaccctaccagataattctactccagttagaacttaggagtacagtagaagcaatggtacagtgtacactacacagttttcatgaatgctactgctgggtgctgacatgtgatactaatagacaaaagaacgacttgtcacaaactgaaaaggaccttgtatatctatacaaattatggcattttttcagggccattaaaaactgcacttgaccatctctacagtaagtctatggtctatgctggagccaatggcctcactccacacgctttggaaaattcagaactccacgtcgtccaaatccgatcgcgcaaaacgcgcaaatggcacaggtttctcttatccctacactacacatactcacacagacgtctgcatcttcagctaaaatcttctcaatatcgttgtcagctgatcgaagttacttggttagaattatctgcttacattcggaaattagattcagttttacaacttaaggacgtatgcgagagttttaggtcagcaacgaaagggattgacattttaaaacgtcctcttcgcatccttaaattttattaatataatcgtcatgtccttcatggccactgacattttgtgacgagacaatttatttcgaggaagactttatatagaacttgtgaccagctaaacaattcaagcatcaagatttcgtgtacttgacacttgactcaaatcaagcctggtttgaacaccataaaccggaccaaatcgttggtacgtgccatcgtgattttaatgggtagagatgactactagtccaactcgaagtgattaaacaaattagaaggcgacatgcatcatgcatggagctgtagcatattgtagacaagtagcaatggaggtctctaaacaagcatatctcatatagacacgtatctactctgacaaaactgatagtatatactccctccgtttcaaaatatttgacaccgttgactttttagtatgtatttgaccattcgtcttattcaaaaaatttaagtaattatttattattttcatatcatttgattcattgttaactatacactttcatgtacacatatagttttacaaatttcacaaaattttttgaataagacgaacggtcaaacatgtgctaaaaagtcaacggtgtcaaacattttgaaacggagggagtacaattgtacgtgagagttgggggtctatgactagtggattcgaggttagaaatgtcagaacaatataagactgattagctgagatcctaatacagaaatgggattaccaaaaacaattaattaatgtctaatctgtcctcctgttccggcgttgatttgaagacaaggtggcatattctcttgacaacatcagttgggtcagcatcaaggaagacaacaagaccctttgcatgcgagcatatcattgcaaaagcttaataagggttttaattcaacgttttcaagagaaactattatgatagaagggagtatcagcgacagccaaacaaaagaacgtacatatctacataatttcaggagcacagttgacaatacaacatgacaatggcagctatgaagctttttttttttttttgcatcatctgcatcaagatgcttatgcatcatgcgatgtagacatatacgtacgaacaacatctactggctcggattacaaaggactcaaacccacacgcgactatataaaacgaacaaaaaaactccttaaatttgcagatattttcgacgttttgtgcaaattcacccacatatgagcagagcagagcatagctaatcaggccatcagcaattgattctaggaaatcgctgcgaactatccattcaagccgtcaaacaaactaggcgtcgtaataaattagtactagtagtagtctaagcatcattagttagttgattagttcgagcaaggaatgggagaggcggcgagcttaccggcggaagcggcggggaggacgtccccggccgagtccctgaaatggagctccaccctcgtcgccgacccggggttcgcggcgtagtagtcctccaccgccatctggatgccgacccgccgcctcaccccgaccgccgacgtcaagttcaggatcaccccgacccggacgctcgccgccgccgccgccgccgccggcagcgcattccgctgggccgtgaccaccgggctccccgcgagcgccgcaaccaggagcgggaggaggaagaagaagcaggaccgcctcgccatctacacccgcatcacaatatcaggctctcagcaaccaccacttgcactcgcactagcagttgcagatttttctggctctcgccgtgcgctgccgccgcagtccaacgcggcagtagctttatatacggataaaaattttacgggatagtttttttttcaactagtccatccgattaagttctaaatttgacacgaatgctaattattttttcagtaataaacgatatacccgtcgacagcaagacatccatgataactttgtcaatctcaaaatatgtcggtctagtctcaatgagatacctatgatgaattcgttaatataaatatatgcgcatataattattctttcagtggggtagaaaacgtactcgtcgacagcgaggcgttcgtggtgacttcatcaatcttaagatatgtcaccctagcctcgacgaaatgctcgtggtaacttcgtcaatttcaagatatgctgataggggggggggctgtgtttatataggtgagtgtgtgttataagtgctgtgtttgtgtttctaaaaataatacgggacttttccgtcgcttgcattgttgacttgaccttgctgcgctgctcggtgagtgcgtggcaccggaagaaccggtcggaagggtcggtggaaaggaggactcgaggtcgcgggacatatggtctgtacggggaaaactcagcgaccgagctaccgattaccgaagccaatggtgatgttaatcatttctttttcctctttgtctatacttcttaatctttatttggtctgggcttatgtgttggtcagttgactctgattgagaagaagaaaatgactcgagttgcagttaatgcctacaccagatgatatgtgctgtaaactgtaagtaatatgctgcgattttacaatgacgagctgatgggctacaaaacaattggagctagtttaacagttgccatcagtgggtacgcgctttggaacaggtgtatgtttgacaatgtgggcatggattttgagctctcaaacgtgcagaattccagttctctcttccttggctctgttattcttagcttagtctcattgaattattcgcttcatgcgtgcattggttatttgtcaatgtttttttttctcaaaatatttaacttaccctaatataataaataaataatccgtagtaataatccgttccataatctagatcaaacgtgcccttggcttgtgagttccgattacagaagtattggaacaatgctgcctgtaccttgctatgaagaccttgagtccttgattaccttgctctgaagaggatgtcttattgcaaaaagtcaagaaaagcagacagaatcttccgctctaaaatggaacgagcatctgaatattctacacagtctgctgagaagaaaactttttttatggtagttggaaatttcgatctaacagaacattttaatgtgtatacctacccggtcgcttggaaatctaggacatagttctaaaaaaaagaaatctaggacataataatggagcattagatctgtaagcttcctcttaatgtaagcggctaatgcaggtcacaactcagaatgccatctttttagatatgaaatattacattttaatatccggcctctgtatcaattcatgaggcatctccctctaaaatttaattttaaagtgattttacagttttgagaaggtatcaaaagaaaatatatttcctagtgtaaagtttgatatctcttaataacttttaaggatggtaaaatttatgtaaatagtactgtgaaccgagcagtgaacatatttatttttggaaattatgatagtgataaaaaatgatgaaagaacaccaagcaacgtggtaccgaaatgaaaagtggaaccgtggaaaggaacagctgatatttccttcagttgtcaaccacaagttaaacacagtaatgtcaaactttgttccaatgatttttcaattagatctaactcccttgcttctaaagaaagtaattagtttgcctattagggacgcttaccactcacataaacagatactctactagcaattgtaatctcaacgtcttagacgttcatgctactgggaaattaatatatatagttgagttgcaatgtcaatgccattgccacttatgctgggaaatatactattcatagatctacctgtaataaaaagaaacagacttttatgcgcaaagtcagctttggtaggatagtatattttcacggttgttagttgcccattcgtgtaagatcttgaccttgtgagtcacattcaaagcaatcttcatcatttctgactatggcataatcttacaaaaccgtgaatgatcaaacaatgttggtcagtcatcacttgtgtgtacgcgatagaaatgcggtgaatattgaaagaattttctggagagcataccaaaataagacaaagttgaggcatacttcagtctgcctgctgcaatttcccagcatttccttcagagaaagagactactgatctttgaattcatctggcaaaaacagatccgtcattctagtctggtttaagtattctccatgtggtcagtcacatcagtctccaagtaagacaggcgaacaaactgtcgcagttgttgtgcctgcagtagtttccaccgtattcccttcctgtgaattctgatatcgtcatcttgaaatgatctaggccgtgtttagttcaatttcaattttttttaagtatacggacacatatttgaagtattaaacgtaaactaataacaaaaacaaattacagattccgcctgtaaactacgaaacgaatctattaagcctaattaatccgtcattagcaaatgtttactgtagcatcacgttgtcaaatcatggcgtaattaggctcaaaagattcgtctcataatttacatgcaaactgtgcaattgtttttttcgtccacatttaatgcttcatgcatgtgtctaaacatttgatgtgatgtaatttttgaaagtttgaagggaactaaacacagctactcttaggggtggataacgagccagctcggctcgtttgagctcgttgtcttaacgagccaacttggctcggctcgttaatgttaatgagctaaaaggctagctcggcttggctcgcgagctggctcattaggctcgttaacgagttatatctcattaatatcatattaataattacaaatttaacattttattatgtattaacataataataaacactaactaatataatactcactaaatatgaatagttttgatgtaattaaaagactaagcactagtcaagaaatactaagttcatgaagatatgatgatattttatactaacgagccaaacaagaagctcgcgagctaaaatgctagctcaacttgactcattaagagtacaagtttgaatcgatccgagccacgagttttgagctttttgtccacccctagctactttggccttgtttagttcccaaaaacgtcacaacgaatctttgaacatatacatgaagcattaaatatagatacattaaaaaattaattgcacagtttacatggaaatcgcgagacgaatctttttaagcctaattagtccatgattaaccataagtgctacagtaacccacatgtgctagtgacggattaattaggcttaataaattcatctcgcggtttccaggtgagttatgaaattagttttttcattcgtgtccaaaaaccccttccgacatccggtcaaacgtccgatgtgacacctaaaaattttcttttcgcgaactaaacacaccaaactctgaacctagtacaatacctgaaagctaccctggcaggttggcgccaaact

SEQ ID NO: 72442 - DNA, 1295 bp, Oryza sativa
gctgatgaaagatttagattaggtccgaattagatccccggacatcactcttcagagcgtctagctagcttcagaatatatttggccttgcagcaggaatcccagcattgctcttttcaccgggaggcctaaaattttgcaggattcgcctcagaattcggcggtcacatcaagaatttctagccgcgatcgctgtggcctcgccggtgagttacaggtcgccaacacggcgatgccccaagagcattggtgcgaaagactgccgtgcagaaaaggaattttataaagcctcatggccccttttcctttcgccgttgctttcgtgcacagctttcgcccccgatgcgttcgcgacggaacggtgcaagaatatttcgaagccttttgtcaatgacaaaatcgtagaatctcttttggttctatctatctatatatataggtcactcggttgcacgagctgattaacggggcgttttggttaggagataattagacatgcggggggtttcggtggtgctcgtgctgatagcttgttggctgtgtggctgtccggtggccggcgaggcaaccttcgccggcgacatccgtgtcgacctgacgcatgtcgacgccgggaaggagctgccgaagcgcgagctgatccggcgagccatgcagcggagcaaggcgagggcggcggcgctgtccgtggtgaggaacggcggcgggttctacggcagcatcgcgcaagcgagggagcgggagcgggagcctggcatggcggtgcgcgcgtcgggcgacctcgagtacgtgctcgacctcgccgtcggcacgccgccgcagcccatcacggcgctgctggacaccaactgcgaccttatctggacgcagtgcgacacgtgcacggcctgccttcggcagcccgacccgctcttctccccccggatgtcgtcgtcgtacgagcccatgcggtgcgccggccagctctgcggcgacatcctgcaccacagctgggtgaggcccgacacctgcacctaccggtacagctacggggacggcacgacgacgctggggtactatgccaccgagcggttcaccttcgcgtcgtcgtccggcgagacacagtccgtgccgctcgggttcggctgcggcacgatgaacgtcggcagcctgaacaacgcctccgggatcgtcggcttcggccgcgacccgctgtcgctcgtgtcgcagctctccatccggcgattcttctactgcctcacgccgtacgccagcagcaggaagagcaccctccagttcgggtccctcgccgacgt

SEQ ID NO: 72443 - DNA, 3792 bp, Oryza sativa
  unsure (1)..(3792): unsure at all n locations
ccctaaccacatttattgcggtttggctgagcgcgtcatgccgcatgtaacgcagtgcagtgcactcgtttatccggtctgtgaccagtcacagactggtcagatcgcgggtttggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtctcatcagatggtgactcggacggcaactatacaaatctccgtccatttatgaaaaggtggggtaagtccccacaaaaaagagagaaatggtgcatgtggtatccccttaagatataaaaggaggaccttgcccactgggaggggggactggacttttccagatggggaacccagaacaagggagaggctggctcatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctcaccctgagtccccggccgaactggcaaaggggggcctgtgcggtctcccagtgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctatgcgggagaaggcgctcgagagggccgaaggatccgcgacttcgacacccacaggaggtggagaagggcggcgagatggggagcgtcncctcctcgtctacggcgatggcagcacgccccagggcgcgctccaagctgcgggcgcgctcctacgtcacccgcccgtcgcccatgacccggagtctccagcccaacgttggctggacgatgtggccaaattgatcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccggaaagatctgcgtggggaaccggatgcccgcatcagtatcgagcgccggcgtaatggccgacgtgctccccacgcaacggagggcgcctcctcgtccggagtgtcacctcaccacggacgcggggatcagccctccgtgcccccggttgttggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacacggtcatggcgaatttctttcccatggccctgaaaggacaggcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgacggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggagaagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgcaaccgtcgatgggggagcgtgtgctcacgtttctcgccggagcttcaaggccatgaagcgagagcttctggccgcggcccctactcatgaggcgacgtgtcgggcgcgggtggtcgaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacattgacctaccggtcaccttcggtggatccgccaacttccgcacggagcgggtgaacttcgatgtggcggacctcagtctgccctacaacgcggtcctggggaagcccgcgttggttaagttcatgcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctccgcccccgccaccccgaggcagcggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggggttgattgagcaccgtctcgccgtgcggccgggcgcaaggccggtccggcagaaagtgcggcggcaggccccggaacgtcaagccttcatccgcgaggaggtggcacgacttctggaggccggattcatccgtgaggtcatccatccagagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatgg

SEQ ID NO: 72444 - DNA, 11476 bp, Oryza sativa
agaggaactatctacctctgtaatgaaaatttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatgcatttcataatatttttttttgtggttctcattcaaaatttattccagtgttattagtactgtacatctattactgtactaatggctcatttaccagcaaaagttttacaatattgttttatttaatcttgctgcaataaaataaatttagcatgttgattttataactttcttttatttctttagaacctgttgttcaaaagtacaaaatttgtgaccttatttccaactatttcaacttatcttgcaagcttggtttactttatttacttacctttttaccttgattttctaactttatttaaattaatccaaaaacttgtgctattaattggataaatgccttaactctctcctttcacttgtctttagatgccgcgctacaagcctgagtacttgtttggtgttgagggatttgtccaggagttgcgtacgatgtcttttgtcataggatttgggactgcccctttttatgcccagattcctcatgatcgtcacgaagagaagtgccgagtcaaagtcaccttgaacagtaatagtgaagatattccctcagtgatgttcgaagctggaggaagaaactacatccatgcatgtcaggaggtggcaaggatcgccataggagagctccgcgatcgctacagtgatcagttggccgacactgagtatcgctaccatcctcgtcaaccacagggaagtgaccgtggcagctaccttgagactgaaggaattgagaatgatgctaccacaaggcatttggttgagatgctgtgggctatggatgaaacccgtgcagagagtgtgttagcagctcaagatcgtgaagatcagaatcgtggtaagatttgcaagctagaaggcaaagtggatcgtttggagaaggaactagccgcattgaagggagaagcaccaccgctgaaggccagggttcgtcttaccgcaaggaagagagctctatttgtccctcgctatcaattggcgccaaaggtccgtgtggtggagaaagaagttaccccagccctagcggatcctccggtcatcatcataagtgatgatgaagaagaagaatccaagcgcaaccattccaagattgagtgggtagctactcaagatgatgaagacgagccgaacgagccttcaatcgacctccgatgctcggaagaactagagtgccatgtctaaccgttgtcttagatcgttgtgttagtttgcttgttttaagtttggttgtgtgtctcgcgtgtgatttacatcaatggtgggaagtaagtgcatgcgtttgtttgcttttgagtgttaggaagttggtgagtttagtggtgtgagagtcttcagtttgtaataatgaaacttagttaagatcaataaaagataaagtaattctctgtcctaagtagttttcccccggtttctcttcttgtgccctgtccataccagatggtgaatactcgcagcaacgggaatggccccaacaaccccaataacaacaacaacgaagggaacccaacacttgcccaagttcttgctcagcagactcagttaatgaacatgatgatgcagcaacttcagaaccagcagaaccagggaaataaccatgcacctccccagaacaagttagcagaatttcttcgtgtgaggccgcctactttctctagcaccactaatcctgttgaagctggtgattggctgcatgccatagaaaagaagttggatttgcttcagtgcaccgatcaggagatggtctcatttgcatcacatcagttgcatggccctgcctctgaatggtgggatcacttccgcctgaacaggaatattgctgaacctatcacttggcttgaattcaccgctgctttccggaagacgcatattccctcgggagtagtgtctctcaagaagaaggaattcaggtcgctcacccagggatctcgctctgtcactgagtatctgcacgagttcaatcgtctggcccgttatgctccggaagatgtgcgcaatgatgaagagcgccaggagaagttcttggaaggacttaatgatgagctttcttacccactcatgactagagattatcctgatttccagaagttagtagataaggctattcgccaggaggacaagtacaaccgcatggagcaaaagaaacgtcggattgctcaattcaagacacaacaggggaataatcagaggccgcgtcttactttaggaccccagtctatgccacagggaggttcttcgtctgttgttcgtccgcagcgttagttcttcaacaacaatgctggcaacaacatccgcaatcaagctccacgccctgttgcagctccaacacagtaacagcctgccaagagggagcaaggcagcaagcccgtggtgtgtttcaactgtggagacccaggacattacgctgacaagtgtccgaagccccgacgcgtgaaggttgtccctgcccagagcaactctatcgcaccagcgccaaaggctcgtgtcaatcatgtcgctgctgcagaagctcaagatgctccagatgtgattttgggtacgtttcttgttaactcagttcctgcaacagtgctttttgattctggtgctacacattcattcttatctatgagttttgcgggaaatcatgggatggaaatagaagatcttagacgtcatttgatggttagtaccccaagtaatcaagcactctctttgaaacgtagcccctctgtcagaatagaaattcaaggagtatcatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttcggagtctttaaggtcaagactgaaccaaataactttggaagagattcctgtagtccgggagtatcccgatgtgttcccagacgatttacctggtatgccgcctaaaagggatatagagttcagaatagatttggtatcaggaacaactccgatccataagagaccttatagaatggcagccaatgagttggcagaagtcaagaggcaagtagacgatttgcttcagaaaggatacatcagaccgagttcatctccgtggggagctccggttatttttgtggaaaagaaagatcatacccagaggatgtgtgtggactatcaaaaataagtatccgctacccagaattgatgatttttttgatcagcttaaaggtgccactgttttctccaagatagatcttcgatcagggtatcatcagttgagaatcaaacaggaagatatacctaagacagcttttaccactaggtatgggttgtttgaatgtactgttatgtcttttggacttaccaatgcccccgctttcttcatgaatttgatgaataaggtatttatggaatacctagacaagttcgtggtggtctttattgatgacattcttatctactcccgaaccaaagaagagcatgaagaacatcttcgccttgcactagagaagctacgagaacatcaactgtttgctaagtttagcaagtgtgaattttggttgtcggaagtgaagttccttggtcacgtcatctcagcaggaggagttgccgtcgatcctagtaatgtggaattcgtaaccaattggaagcaaccaaagacagtttcggagattcgcagtttcttaggcctcgcaggttattatcggaggtttatagagaatttttccaagattgctaagcccatgacacgactgctttagaaagatgtgaagtacaagtggtcggaagaatgtgagcagagttttcaagagttgaagaatcgcttgatatcagctcctattttgattttacctgatccaaagaagggttttcaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtggttcatgcgttgaagatttggcgtcattatctttttggtacttgtacagaggtctataccgatcacaagagtttaaagtatatctttactcagccggatctgaacatgagacaacggagatggttggaattaattaaggattatgacatgggaattcattatcacccgggaaaagctaatgttgtagcagacgctcttagcaggaaaggctattgcaatgttacggaaggacgacagttgccattgcagttatgcaaggaatttgaaagattgaatttgggaattgtcagtagaggtttcgttgcagccttagaagcgaagcccactctaattgatcaagttagagaagcccaaattaatgatcctgatattcaagaaatcaagaagaatatgagaagaggaaaagctatcagtttcttggaggatgagcaaagaactgtatggttgggtaagagaatctgtatccccgacaacaaagatttaaaagatgcaattctaaaagaagctcatgatactttatactctattcaccctggtagtaccaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaatcggtatggattttatcactggtttacccagaacgtcatcggaccatgactctatttgggtgatagtcgacagacttaccaaagtggcacatttcattccagtaaaaacaacctattccggaagtcggttggcggaattgtatatggcaaggattgtgtgtttgcatggcgtccctaagaaaatagtgtctgatcgaggcagtcaatttacctcaaatttttggaagaagcttcaggaagagatgggttctaagctgaactttagtactgcttatcatccgcagacagatggacaaactgaaagggtgaatcaaattttggaagatatgttgagagcttgtgctttagacttcggtggaagttgggataagaatctaccttatgcagaattttcatacaacaacagttatcaagctagtcttcagatggctccttacgaagcactgtatggtcgtaaatcattcaagaaagattgcgagtagctcagtctcgtcataagagttatgccgacaatcgtcgtagagatttgagttttgaagaaggagattatgtgtaccttcgtgtcacgcctcttcgaggggttcatcgtttccataccaaaggaaaattggcaccgcgttttgtgggaccttataagattgtcagtagaagaggagaggttgcttatcagttggagttacctcaatctttggcaggagtccataatgtgttctatgtgtcgcaactaaaaaagtgcttaagggtacctaccgaagaagctaatcttgaacagatagaagtccaagaggatctgacttatgttgagaaaccaatccgtatcttggaaatagatgagagaagaaccagaaatcgagttatccgtttttgcaaagtccaatggaataatcactcggaagaagaatcaacttgggaacgagaagatgaattgaagtcagctcatccgcatctgttcgcctgttcttccgaatctcgaggacgagattttgtttaaggggggtaggtttgtcacaccctaaaaatcctaaatatataaattgttgtttaattggaattattagaatttattttaaaagcctagaagagaagatctaattttaattaataagttccaatataaaatggggccagataaaatttcattaaatactttgcttaattctataattcctagatttttctgggatttatttgagctaaggaagtatttttaataaatggaattgcatttcatgaataatttaaatggaaaaagtttttaaaagtctcttttggctttgggccgaaagtcggcccaaaacccttctctctctcctcggcctaagtcggcccagtccgccgcagccgcgcgcgcgccctcgctcgctgacaggtggggcccgcctgtcaggtcgtcgtctacctccggccgccgccgcccgaaaccctagcgccgccgtctccttccaaattcggccgcgtctttccttctccggtgaaatctttagaggggaaatgatccttgggatctcctctaccttttctcttttggaatcatcatctaaatcgctttggaaattcgcggattcgatctcgaatcggattcgtctctctcctccgaaccctaaaccttccatcgcgtcgccggtcgtcgtgggcctccgccgccgcctcctagcccctttaaaaggatccccggtgtctcctctacccgccgccacccttgctttcgcctctcgccgtcggaagagccctagcgccgtgagacttcgcgccgccgtcgtcgccgtcgctccagccgtgcgccgccgccgttccagtcgtcgccgtcgcgtcgccgtcctcgtccgccccttcgccgtcgctgtagaccgccggagcgccgtcgccgccgtcgacccgatcttctccgccgcttcgacctcgacgccgtcgccgtccgttgtttttccgccgccgttttggtcaccggtgagtttgccgcgtcgcgctctacgtcctggtgccctccgttctcgtcgacgcgccgtcgttcgccggcgagcttgcgcgcccgagctgcccgagccgccgccggtgatgacgtcaccgctgacgtcatcgggaccgtccgccgtgagccagccgtggaccggttgatctcggccgttcgttttggatggatcgatctcagccgtccgttcccgtgaaccgttgccgtgcgcccggtccaccgcaaaccctagccgctgacgcaataattcctttttccttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgtttttgctcttttctgtttagattccgacgtttccggagagtccgttttcgcaggagaagagtttgaagagttccaaggccagcaaggcaagtcacacagatcccaaacaactctttgagcatgttgatcctatttaaagctattgtttctattcaactattgcatctattttcgaatgtcattgggtggaattaacctattctttgttatagcccttttgttcttgattactttattccttgataccttgggttattataacttgactagttgagctttatatatattggttcaactagatattagatataattgcttagccctgcttagaaacatgagcacactattgggataacttatgattcactattatttaatgatggcttaatgatagctcacgatggtcaatcgtgattggttaattaattaatgtgccaactaaaacctaataatggtgggttgtgagcacatggttttgagagtcgtgctcatgacaattaaggaccggttcacgagtttcggttgtgaaacattaaccgtgccaaccacaagccagcgtgggcaacggctttatcttttgtatagcatggttcattgcggagcaccagactgagaagtggcggagataagcccacgggggtcgctggggagtccatgccttgtttataagggggtgattatgatccaggaaaggtgcgctgcaatggattgtgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgttcgggtctaacaatgtctttcgtgattagtctcacacttctcatcttaataaaaggtgctttaattggtaataatttgattatctcctggtttggaatggtatattcctggtttggagatagaactgtgcagccgggatggttgtccagaatggttgggcctatacaacagggtatgttgtatagcgttgatttaatattgtttaattattacttaactgtctcattaaattctcaaatgtttgctaaatgctgcttttgcaaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataactgtactctattatcaatttgttattgtgtgcctcggctgattcctggacaagggttcacacacatgtaagcgtttggaattttggatagaaattccgggcgtgacaagttggtatcagagccccttgaccctaggttatgccaaatggttatccatagaagccctctaaaaatattggaaaagtagaactgttctcctccccttctcttttaattaaaccaaactaatggcacatgcatttcataatattttttttagtggttctcattcaaaatttattccagtgttattagtactgtacatctattactgtactaatggctcagttaccagcaaaagttttacaatattgttttatttaatcttgctgcagttaaatgaatttagcatgttgattttataactttcttttatttcttttgaaacctgttgttcaaaagtacaaaatttgtgaccttatttccaactgtttcaacttattttgcaagtttggtttactttatttacttaccttttactttgaatttctaaactttattcaaattaatccaaaaacttgtgctattaattggataaatatcttaactccctcctttcacttgtctttagatgccgcgttacaagcctgagtacttgtttgtccaggagttgcgtacgatgtcctttgccataggatttgggactgcccctttttatgcccagattcctcatgatcgtcatgaagagaagtgccgagtcaaagtcaccttgaacagtaatagtgaagatatcccctcagtgatgttcgaagctggaggaagaaactatatccatgcatgtcaggaggtggcaaggattgccataggagagctccgcgatcgctacagtgatcagttggccgacactgagtatcgctaccatcctcgtcaaccacagggaagtgaccgtggcagctaccttgagactgaaggaattgagaatgatgctaccaccaggcatatggttgagatgctgtgggctatggatgaaacccgtgcagagactgtgttagcagctcaagatcgtgaagatcagaatcgtggtaagatttgcaagctagaaggcaaagtggatcgtttggagaaggaactagccgcattgaagggagaagcaccaccgctgaaggccagggttcgtcttaccgcaaggaagagagctctatttgtccctcgctatcaattggcgccaaaggtccgtgtggtggagaaagaagttaccccagccgtagcagatcctccggtcatcattataagtgatgatgaagaagaagaatccaagcgcacccattccaagatcgagtggggagctactcaaggtgatgaagatgagccgaacgagccttcaatcaactccgatgcccggaagaactagaatgccttgtcaaaccgttgtcttagatcgttgtgttagtttgcttcttttaagtttggttgtgtgtgtctcgcatgtgatttacatcagtggtgggatgtaagtgcgtgcgtttgtttgctttcgagtgttaggtagttggtgagtttagtggtgtgagagtcttcagtttgtaataatgaaactcacttaagatcaataaaagttaaattaattctgtgtcctaagtagttttcccccggtttctcttcttgtgctcctgtccatgccagatggtgctcactcgcagtaacgggaatggccccaacaacaacaataacaataacaacaatggagagaatcccacacttgcccaagtcctggcccaacaggcacagcttatgaacatgatgatgcagcaactccagaaccagcagaaccagggaaataaccaggcacctccccagaacaagttagtagaatttcttcgtgtgaggccgcctactttctctagcaccactaatcctgttgaagctggtgattggctgcatgccatagaaaagaagttggatttgcttcagtgcaccgatcaggagaaggtctcatttgcatcacatcagttgcatggccctacctctgaatggtgggatcacttccgtctgaataggactactgctgaacctatcacttggcttgagttcaccgctgctttccggaagacgcatataccatcgggagtggtgtctctcaagaaaaaggaattcaggtcgctcacccaaggatctcgctctgttacggagtatctgcacgagttcaatcgtctagctcgttatgctccagaagatgtacgcaatgatgaagagcgccaggagaagttcttggaaggacttaatgatgagctttcttgcccactcatgactggagattatcctgatttccagaagttagtggataaggctattcgccaggaggacaagtacaaccgcatggagcaaaagaaacgccagattgctcaattcaaggcacaacaggggaatagtcagaggccgcgtcttactttaggaccccagtccatgccacagggagggtcttcgtctgttggtcgtccgcagcgtcagttcttcaacaacaatgctggcaacaacatccgcaatcaagcctcacgtcctgttgcagcctcgacacagcaacaacctgccaagagggagca

SEQ ID NO: 72445 - DNA, 1136 bp, Oryza sativa
cacatcaaatgtttcaacacatatatggggcattaaatgtagaaaaaaaccaattgcacagtttgtatgtaaattgcgaaataaatcttttgagcctaattacaccatgatttgacaatgtgatgctacagtaaatatttgctaatgacggattaattaggcttaataaattcgtctcgcagtttacatgtgtaatctgtaatttgttttgttatcagactacgtttaatgcttcaaatgtgtatgcgtatacttcaaaaactttacacccaaagaactaacacgtaccttctgtattttttactgtttcgcaatttatcgttcgctgcagagaatttggtgttagagtatatagtacgaattgagtcaggaactcaggatccagtgatccatcaagggcaccgagctttgcatggtaatttccattaatgctattttctacgaggagaacattagatgttttttcgcaaaatctatttcgagaggcatctcgatttagacttaacgagcgacgcagacaattacgtgagaagtactattagcgtacatgcatgcaagtagtttttgctattaggttgtgcatattttttttcttcttatgaaattttctattaaattacttatccgatctataatccgattacatcgttgtgttcgtaacaattaaatctttacaacaagatctcatatgattatattttgatgaaaaatcacaaattacttttatgatatgtttaaattacttttagatttcactaagttacttcttagacatacaaaagttaattcagtaaagcctaaaagtaatttacatatattatagaagtaacttagaacaaaacgaatgtaactttgacatgtcatttgaagtaaatccgttatagagataaaaacatgactctatctagaaattaaattaatcagcacaaattatggaattaactaaaaacaataataaaagtaatcacctcagagcattatgaatgtataggaaatattttaatcaaatctaaaagtaacttatatatatgataattaaatatatgataatttgttcaatgaaaaaaggtattaatcaaagttactttctatcttttttttataagttacttctataatatatgtaaattactttt

SEQ ID NO: 72446 - DNA, 1185 bp, Oryza sativa
actttgtgctgataatactccctacatcaaaaccacatatcgaaactgctgttcttttatttcccggcgaaaaaactgcctttttttttgtagctgaccaaaagcttccatctgcatatcactcactatatctttctgatttgctcgaggcatcaaacttggcctaattgatccggcgccttgtagacagagtgggacccagctgccggcggcacgaggccatggtctgcagccaggttgctggaccggccacgcagcaacgggtgaagtgaacggcaagctgatctggaaccatccgtaccgtgttgtctcgatcaaagcagcgcttaatccgtgacgttttggtcgttgataagctagtgaagttttacacgatgccgttccgttaaaacagatatccgcatgtgtcgctcttccgtgacattttcggtccctgattaagcttcgtcgctttcgctgaacggttgattttgactggaacatcacgttgttttttttaggagcgccatccattaattcgttcatttgagcttattataaactaacaactgtcgcttgctaacccccaaaagaatcaatgaatcatggtgcaggagacaccttgtgtgggcatgtggccggccgactagggttcagtggttcactacttcactcccaacagccgcggcatgtaggaggattcctaatgaatatattttgtataactacagaattttttttcagaactaattaaagttaaagatttaacatcgaatttaccatgaaactatatgcccaacacaaattaccataaactatagatttagtaatataattgtcacaaaactattacttcctccgtttcccactatatgatgttttgataagttactactccatccgttttacaatgtaagtcatttctagcattttccacattcatagcgatgttgatgaatctagacatatatatttatctagattcattaacatcaatatgaatatgggaaatgctagaatgacttacattgtgaaacggaggaagtataaaacatagcaacatttgtaatacaaaacaaacatattattaaaatatatttaatgctaaatttaataaaattaattcattgttgtaaatgttgctatacttttaatgaactcaaaaaagtttgatttaaaaaaaataaacgtcttataatatgaaac

SEQ ID NO: 72447 - DNA, 1002 bp, Oryza sativa
ttagagttaattcttattccatcgcatttaaatttaattcatacaaatatggtcgcaataatattttatttatttctatccttacctaatatttattttaaattatatttattttgccaatttatttttagggtttattcctaattaactattctttatttgcgattaatgaacttcgaaatcaaatccaaataaaataggcgaataaaattggcatgatgcaattaatttaaaaagttttcgaaggtccgtatttttagagttttgtttttattggtcgaattttcagggtgttacagatgctcaccaagcggcacggcaccggacggaggcgagatagcggtggtgctccaacggcggccgatgggcgacgagtgatggccggggacctccgggaccctggggaaggggatagagagtttaggtggcacggggaaggcgtggtgccgaggaaaacagcggccggaggcggcaaggaatggtgaagctcaccttgaacggggaaaagcgggctcccgtgggattccggcagcgaggggcagcggccgaggtgcggcacaacacagcgacgctgggggtggccacggcatggctcgggatggctgggagcggcggtaaacggcggccgaggcggcgaaagcggcggcggtctcaggttggcagtgaggagggagttttggtgggggatttggggaaaggagatgggggacgatgtgcggcgcgcgacggcgcagcacggcggcggtgggagtgttggtggcgcccggctggagtcggcggcggcggcaaagagaggtggtgcgcgtgacggtggtgttccggaggcggagaggggaaatggagtaggggccgggctgtggcacggcgccgcgaagccgacggtggtggcggattggcgcggcgttgggtggagcagcggtggcgggcgggcggagctcaccggaaaccagccggtgcgcgggagtggcgtggggatggcggtagggaggcgcgggtagctct

SEQ ID NO: 72448 - DNA, 23435 bp, Oryza sativa
gcctagttccgcttcgggacccaggtccactgaagtacatcttaagaatgtaacgtgtgcctcagactcggtgagaggagcgtagagacctacaagatctacatcttaaaggaaataaactaaggtatgcctcagactcggccttatcctgggtctcgggctcaccttagtccgcacaagtcacacattgctctgagaagaggagtgtggagacgtataaaatctacatcttaagaatgtagcctaaggtatgcctcggaccctgtcttgtcctgggtcccgggctcaccttagtccttgtaagtcctacgtagacgagcgtagagacctacaagatatacatcttaagaagaataagctaaggtttgcctcagacatggccttgacctgggtcctgggcttaccttaatcttcataggtcacactttctacaaggggtggagggtggagacatatgattaagagataaactgaggtatgcctatgtccggcctcgtcctaggacccgggcacaccttactccttgtgagttttacattcctctacaacgaagagtgtcgaaacattatatatatatgtatgtatacatatatgtatgtatgtatacatatatatatatatatatatatatatatatatatatatatatatatatatatgtatgtatgtatgtatgtatatatatgtatgtatgtatgtatgtatgtaaatatcattgtgagctcctcaacggagagtagattcagtaacatatcagtttgcaagaatcccggtggtatctctctctctcactcctccagttttgctatttggtgcagctagtagtttagttgttgtttgtgaaaacccattaactacttttgccgatatccccttttgcttgccttgttagcttgctcacctttgtctgcatgtaggttacgtcccttgattaaggaggaatgtctctgtcgaaacattagatattatctaagatatcttcaagaagcttgtgtaagaatagctaaactatctccataaatgtgcaagggcgcgacctcaggaccagctggggtgttgggcgtgctccacgggctgttgtgaagtagtcctctccgccataaattaaacaggtttatgggggagccccagctagtctggagctgaaaggatgtggacaaggcaccatcactgagtcattagaaccagtggcatcttggacacgtgtcgcacatgccccatgccgcctgatttagccaaacgggtagaaacgaaaccgtggtgctgtttcaggcaggtcgggtctcaccaggcccaccactcgccacatggtgaacatgctggcacgacccagctgtctcggacagaagcccgggtgcttgggggcaatgcaagcttcaaatgtcagtgggttactcgaagactgtgtgagggaaccaacaggcattgacaagacagctgatagacaagacaaggaagtagatttgtagcattgtgagcccatccttgatctataaaaggaaggggacaagctacggatgaagagttggattttttggatcagaacttcttgtctgtagcccaaaaaggcatcccttgttctaagctgatataagaaaaacaacaaaaccaacacgggagtagggtgttacacctccgggtggcttgaacctgtataaactctggtgacttttgcttggcggggagatcaggccccacaaatcttttctctgtttggctttttctatcgtcttgcactgctaaccccctggctgaatcttcaaactcggggaggggtctccactcctcgctgtccgaggagtcgctccatggacacccctctaggtgacatcaaggtcattttaggtttaatatcttgatcacgatttttagcttgctcatgatgtaagtggagcctaaagaacgggtaaacccggactattactgtgatcgattaaaaagaggtacatcatttttttttcaaatagcatgcgcaaaggcaaattaaatagctttaagactatgattgtgtgtagcgcaaatattcattcataagcgggtaaggtagcataggttatggacatatactccctctgtattctaacagaagatgttgacttttgatatgacgtttaaccattagtcatattcaaacaaattatataaatgctatttattttgttgtgacttgttttattattaaagaaactttaaggtatgacttatacttgagcatatttacactaaaattttgaaggtcaaacgttatttcaaaagtcaatggtgtgatttattaagaaaaagaggtagtatataaaaacaaatttggtgggtcgtcatattcatacctctttcccttgatgaattgcttgagttcaccgatgagctcctgtacagtcaacatctccatatttggacaattcaggtacttctccaggccaaatcgatgaagaatgttccacaagattgccttcatattaggattttgaccgattggaacaaaagcattcaaaggaaaacccactttaatcttctcatatactgctgtggcaagggtggttttgcccagaccacccattccaacgacgtatactatctttgtcttcctattggacgtattaagattgttatcacgctcatgttgggacaacatcttaataagctcatcccttggctcatcaatgccaacaagattgtttgccattttctcaatatttaggatgtgaggatcaataggcgtcggacgtgcagggataactatgttatcaactgggtatctgtaatagatgagagtcaagagacaacatcaagagatgacgaatgtaagactacaagaaatagaattcttgagataaatcagctgtaactcgtactatagtcaaagttctcatcattctatgtatgtacctcatgacagatcaatataatgcaatataatacaacatattattaagatttcttccatattactcccttcgtcctaaaataactcaatttttgggtttctgtgttcatcgtttgaccatccgtcttatttgaaaaaattataaaaaaaataaaaagataaatcacgcacgcataaagtattatttatgttttatcatctaacaacaataaaaatgctaatcatagaaaaatttcatataagacggacaatcaaatgttggacacggaaacctagaaattgaattttctttgggacggagagagtaaatattttccatacctgccatgccttgcatcaatctccaggagcttcttttccatttcttggattgcgtccgcgatggtgacgcgatgcttggtcttcttgaacagtttcttcacctgcttgccgaggcgcctgagcacatgtgggtcggctggcttggggccatcgtcgtcgacatgaaccaagaaggcgtcgatgatatcctccatgtcgtaggacgcctccctgaggtcgctcgcccagagcttcaccagctcgttctgctggtcttgtggcacctcgctgaccatgcggaggacggcttgcgctcgccggagctccgccgagagagactcgatcttcccccttatgttcttctgcagattgtacttctccttcagcagctcgcccagcttggggatcaggctactcatcgccccagtgacgaactccatgcttgctagctagctgtggttgacttgacttgagttgagtggatggtattgctgggttggtagctgggtaggagcagaaacaatgcactcctgtatatatatgtgcaactactagcctactagctgacaggttaattaatggacttgtcacaattgggttagagcaagtttaatactccctccttcccaaattaatcatcatactccatatgttccacaaccactttttcaagaaacaattattattattttctaatttggatcatcctaataaatataatacatgtatgcatccaataaatttagagatcttgagagtgaaggatttaaaaaagtaataatttaatggagaagatgtcctagttaattgtatgcatacatgtatgccttatattatggaacataaaaaaaatagttgtgccttatattatggaacggagggagtataattttatgcaccaagaccaatgacaatttaaatcacatcaatcaagacaccatacacacattctcccatactcgattaaaacctcctgccaattacaccctagcatacacatattctcccatactgtattaattgtattccgatgaaatccgtgtccatgcagttatataatgaccaatttgaaaaattttaaattctattagagcaagtttactagtatagcccactactagctccaattcatctatagccgatctaatagccaattcatacaatagttgcttattatactattaatatatggtctcacatgtcatacatccattgcgtcttggagtccgtgttatagctggctacagatctatagcctgctgctcttctctctcatcttttatctcattaaaatatgtttatagctggctaataatttgctgttgtacctattcttacatgattaatttgggaagaagggagtagtatattcaactgttggctccaaatcttctaaagtcaattcatacaatagttatctataaaaatgtactatataattaatgtctgatctcacctgtcatacacacatgtattttggagtctgtgctgcagctggctataaatttataatccgttgctcttatctctcctcttttatcttcttaaaatatgtttatagctggtttataatcttatagctactcttatcggagctcacgccatccattctcgaaaaaacattaaaacgtgtaaatgtttgaattgacaaaatgtgaaataatatttactccatctcactccaaatgcaacgagttctagacctatgcaactagaatgaataaattaagttgcttaaatatcttcatttgtaattgtaaacccatcattataattgatgagccatttatctgagtatagtaccattttgcatacaaaatcctgcctcaggattgaagtgttatatccgatttgtttgtttccattggagcatgaacataacaagagggcgaaaacgcgtgtaattaagtttcaaaacgcgtggtaggcaatactgtgtttatcactcaagttactcaacttgtaagacgccgttggctccacctcgaacgcgtcacatgagaccctctgggtgtgttcgctacagccggatgggaagatgttcgctacagtcggatgggaaggtgcatagtacgtacgaaaaacgaaacggtccaataggacgtaattaattaagcatttgctatttttttaaaaaaataattaatttaattttttaattttttaagcaactttagtatataaatttttttttaaaaaaaatacaccgtttaacaatttgaaaagtgtgcttgtgaaaaacgagagagagggcttaggaaaaggggcatccgaagacagccacacgttgattaagggggtgtttggtaagtccctcgctcctaaccaccccctaattgaagccacgttgggaagctatttttcttctcagcagccagcacgctcaccttccggaaccggttggtgcggcgaactgtgaaaccgaccgtggtccaggtgcattaaagtggacaatggtaagctcttaaaaatcagcatgtgcatcgtcaagtctgttgaaattccacaatacatcttttacaatttaaacgagccgtatcctaaaattgctttgtaggagatctctggattttgaggactagagcggtcattttaaagtgtaccagagcttcttgcaggatttgttctatctccgtttgacgacaatattcgtgacttgtgcaaatttcaagctacctgtgcacgacaaatgtatcagtgttgtaacaatatagcgttcgattccaactgttaccttatgtggttgttaggattgttgtatttgttaaccatggtttagctatgtttgaatagaaaaaattttagttgttattcggctaagatagggttagtgaagatattgttagagtttgtatcgaatatatgtacaaagtcggttacaatttagaacttggacttacagtttagtggctgcactagaggacgtacggatgcgtggaggctgaggaggtcacgataggtggctgtgtgcacgtttgcgtgtcgaagctaaagaccacaaatgactctgttttgggctggagttacgcagcagatcgactcgggccagcggatagactcggatcacgaatcctacttggctacgcatggaagaagctgttgaatagtcccacattggttatgaaagagtaagagacctaacatataagtgggagagcccctcacctcaatggctagcttttggggtgggaaaaaccctttatgattctacaattggtaccagagcctaactagttcaatatctctgacccgaggaacatagtgtgtgaaggcctgatggaccgtaggtgcttacggggcacgtttacctgagggaccgtgtggggaaacggtgaaggggcggtgaaggattgagggacaccaatatgtgaagggggagattgttgaatagtcccatattagttgtggaagggcaagagacctaacatataagtgggggagccactcacctcaatggctatcttttagggtgggaaaggccatttacgatcctacacaagccaagccggtgatctactcgtacacggaaggggaacggagagtttttacgatttgggcagaggtgatttgctagtgtcgagctccggcggtgtaataggtattaggacttggagttgtaataggtattaggactagagtatgagtcagactctatcctaggatctctcttaaatagaggggtgtgcctgttataaccgcatagcgatatagcatagtgagagggagcggctgttggtggcgactggctgtgattcgttctaactctaatatgttgtatatgttggatcggagaagagcgcccgtaatcagtgtcccggagatgttggttacggctgaactctgtaacgccccgacatttgttagccataaatgcagctaactaacaccggggtgttatgcattacatgtgatatagtaccagtcccaggatacactagctgatacacacagaataaatgtgtaatcaaagtaactattttattacatcactgggtagtagtccttacataagttaccatcatggacaggcccatagatgaacaacacaacattacagaaaaaccataaaaggcgacgtcgcagaagcgaacagcgcggagaactaagcgactaagcaactacgcactaggcaaagaacctaggcaactaacttattccacgggcgaggcttggggctaggcacgaaacatctagaagtcttcatactcagcttgctcctggagatactcctcggcggttgggtcgacgtcttcgtcttcaaactctatagattattataaggggcaagggtgagtacttaacgtactcagcaagtcaggggaaagaatgacatgttgatttaaacaaggaagctagtgttttatttgcgaaagctgcctttttggcaaagtgatttatttcacaaaactcctagtgagtgagtcaaattttagttgtcgggaggaggctcacgcctcgacccattccacaagttgctttgcaacagcttgtcatgattaacgaacaacaattaatttgtctcctctattagcttcttctcacaacaacacatagtccacacagttatcttagcacaacaacgccatcatggtcctagcaacacatcggtgtcggacgacaccccaggtcacacagacccgttcctaaccacaaaggttagtcgtctgccacacaggcgaactctagaaacgttactcttctgaacaatcacttttccacaaacatttgcaaacaaaactacgctatgagaaacaccttacacttgcccatgactgtgggcacgactgttcgaacagttcattaatctctgcagaggttgcacgctttacccacacgacacgaaacttacaccgtttacccgtcggtaacggaagttcgtgataagacctttccaaagctaacccatgaaaatcgcatgccacctagttgggctaagatccatagccgaatatcgggcaaagacagccgtcatccactcaagaaataccgaggatgtctcctactgatatcacacgccacaatagaggcaaaaagacacccatgatgggcaaaaatgtgtaaaacttcgtctgctcatcctcggcattccacaaccattggcataccaactcccatgtgataacaatttacttagcaagaggcaacccataaatatccatgtggtctcactgtaatgtgtttggatggatttcccaaaggaatcggtccttaacgacaatacgtagccaaaccacaaaggcatgactccgcatcatcaccactttcacaacacattttatttcacaaactcctcggtacaacgtacttgatttttaaacatgtaatttggaataacccaagtttcccacacggcaacaacgtaagcatggctaagtgaaactacctcggtaatcgtataacaataccggcgcaaatatttgtggagctatcaaaggtatggaaacatcaacctatgaaatataagtgcgactactaggttggtccgtcggttgtataaacaatccgaggcctaaacatgttaatcgtgtatactaagtaatgcacttttcaaacaacatatctttacaaatataggggcaatttgatcaaagaggcttgccttgcacaggatgcgggtcttctccctcgaaagcggcgtccggagcttcctcgaactcgggctctaaacgcgaaaagcgaaactaattaacaaaaggcaataaaacaagctcaaaccagagaaacaatagtgccactgtgtagatctcatttttagaaaaatttaggaacttgaacgggtcaatcggagttacagttgattttctacagattttcaaagaataaaggattttctagaatatttggaaattgacttattaacggaaaggaatattccgttggaatattccgctaacttggacggcaagggtggggcccacctgtcagcgacttgatggagggagagaggcgcgggcccgggctgtcagtgttgagatggaggaaaaaggacgtggggccggcttgtcagtggctggagggggaagtcttcttcctcctctcgctgcttgctcggctcggcctgggacggcgacgctccgcgggaccgcggtggctcagcgtctggcggccgaggggagcggcggcggcacttgaaggcgaggcgcggtaactccaggcggcggcacagagagaagaacgagagggagtgagagaggagagagatggtgatggtgtggaggacaacgggagagttcgagctccttttataggcgggcgacgcggtgtcgagctggcggtctagacgcggagctttggggtagctggctagcgactagggcgggattccggggtggagaggatggcgacgcgacggagttgcgtcacgcaccggtggccactcgatggcgaaacgacggcgacgcgacacgaagtgacgcgtggagagcgggattggcggcgagacgtgggtgacgcgcagccgacggcggctacggccgggatttggggcggtagggctggagagggatgatgcgagcgacgctggcgacgcgacgcgagagagagggagggatgctgctcggcggtttcatggaaggaggcgagcgacaagatgaagcgagagagaggtgaggcttagcggctaagctccttcctctcgaagcaagcgaacggataagcaaaggcgatcggataaggggatgactcggcctagggttaggggtgacgaagggtgaggtggcggccgttatccgttggtgtcgatgcgacgggcgatgggatggtgacgggacaatggatgacgcgaggccgtgtctcccggagagaaaccggagcgtgggagtgggttttgcggcttggcgcgacccgggcttgacgcggcacagcctcggcttggtgcggggtggcgcgacgtggccctggcacgatgcggggcgcacgggagggtggcttggtgcaatgcggctcagacacgaggcgaaagtggtgcgacgctgggtgagacatttcgtcgtaacatcttgcgtgcgtgagctggctggcctgaggaggaacatgatgaatagtggctgggctgggttgggctggcctggtcggggaggtgaagagaggagggagtggaggggagttgggctggggagagagaagggaaggaggcccaaaatgaacagtgaactttcacctttttccagagatttgtagagttgaattttgaagatatttttggagggatttgaatttgaattttgacctagggtttcatggaatttgaaatgaattctaggagaggatttgagatctctattggcacaaaaacaaataagaaccaaattaactccaatttttaaatgacaaacttttaaataaatccaaacaaaattaagtgtgctacaaactccgttaccaaatatcgtgtctcggtgtcgacatcatgtttggatctcctatggcgtttcttccccgtttacactggtggagaaaccctttgtagtcccggttcgtaacccccctttagtcccggtttccaaaccgggagtaccaatccgggactaaagatcgctatctttagtcccgggtcaaatcaccgggagtaaagatcgatctttagtcccggttggtgttaccaaccaggactaaagatcgatctgaccttttttttttgcatggccctgttgctgcatggtttatatatatatatatataaaccatgcatatatatgtttcaatacatatatatgcatacatatatatatatatatatgtatatatatatatatattatattatattatatgtatatacatgcataatatatatgtatttatacatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgcagaggatgtgtactcacaggaaatttgaacttccgcctaagtctttctctccatttgccgcagaccaaatgacggaaccgataccaagccctacatggagtttaaagctatgattcgtagtagcaattaacataacaagattttcttaattaacaaaggaacttatgacggtacctgtctataagttcgaaaaccttgtcaaacatagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccaccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaaggctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgtgtgcaatcgtaccccgggtccttgttcttggcggcgtcaactttcgccttcttcgttgcccttgtgtgggcaggcggtggagctggggggcccttgactttgaaggtgctggaagaggagcttgcgggggagtaggtgtaggagcacgaggaggagtcggtgcaggatcctgaggaggagtcgatgctggagcctgaggtggagatggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctctagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtttgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccactgtgagcatagtaccagaacttctatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcatcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcatacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatatcatactaagtctaatttgcaataaaataatcttatattaaaactcaaataatattagaacactacacattcttatatgataagtctaattacaggtctaataatcttaattaattgcattacaaatataacaatcatttatattattacgtcacttgcctgctccaattccttctagggctagctcttccactcaggcttgacggacgactccgacaacatgtcttttctgcaagatacaaaaagatgtattacgataaatacgaagtaacatatatatatatatatatatatatatatatatatatatatatatatattgcatttcacgttcacgttcgttcgctcgttctcattcatgttcgttcgcttgttctcattcacgttcgttccctcgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctcgttcacgttctcgcggcaacgtacgttgacgtgttcgttctcgctctcgttcgttcgatcgttctcgttctcgttcgttaacggcggtgtggcggcatcggggcggcggttggcgcggcggcgtggcggcggcggcggcggcggcggcgtggcgacggcggcggcggcgtggcgttgcggggccgtggcggtggcggcgtggcgtggcggcggcggcattgcgcgcgtggcggcgaaggcggcggcggcgtggcgttggcatgcggcggcggcgttgcgcggcggtgaaggcggcggcgtggcgcgtcgtcgtcgtggcgcggcgtctcgtggcgggcggcgcaacggagagagatcgagatcggagagattgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaatgtctaagtgttggtgaagaagacgagggcgcaccgggaatatatatacccccggatctttactcccggttgttgagaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtgataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaagttcgtccgagtatccaaccttgttaaggtcaacagttgtcatcccaatgtcatcaatcattacgccttcaccagtcaacctaacccattggcaccggaacagaggaaccttgagaggaccatagtcaagttcccatatgtcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagggaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgctagcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactaacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctcctttgtgcttattattcgcttgatattcgtggagtatccagacggtacctttatgctctccaagcattcaaacatactttccttctctgccttgctaagagtgtagctggctggactcaagtaatagcttcctttctcctttggttccgggtgaaggttgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgttggtcctcgtcccacacggggacaccttccttcttccacaactgtttaagatcttcgaccagtggtcttaggtacacgtcaatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgatgctcttcagcgtgccatcgcaacattctagcattccccttgttcctgaacaaacgccttagccgtggtattatagggaaataccatatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccctattttttgccttccattgcaacaactccagagtggtatccaactttttatgcccctgctcgcaacctgggtacaacgaagttctgtggtcctccaacatcttgtccaatttatggacctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctctatgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaaaaaattttgaagcttgctcgggcagctggaggaggaaaaagacatatatatataggggtgggactttagtcccggttggtagcaccaaccgggactaaagatcatctttagccccggtttttattgcatccgggactattgtggaaatcggccgaccgacgaaagatggtttctccaccagtgttagctatcgatgtctatttcggggctggttttataacagatgttgctcacttgcttgtatgaagcatctggtactgttgacatgtttcttggattgaggctattagttacatggtgtacgaatccatgcacctcctgaatcccagcatgttcttgtttttgtctcttttttgtgtttgctcggtcgaattcatgagctaatctatacacaatttatcgaaacttggcaatataccgagtgaaagggtaaccagtacacattagtggtcgttcttgcattcatacaagctgaaggttttcacgatccattttacattcagaaagctgaagtgaaagcaatgctttctctgaatctttcagagaggcactttgtttagttgggcccgaacttgaatgcacagtacttgatgaatcccatatgtagctcggatgcaataatgcattatattgccatctcaatgtttatttagtatttttataaagtaggtatataacatcgtaaaatactaagataattaattaatggtagtatgtatagaacccgataatttttaattcggaccctccacagtactgtacatgtagacatgtgagcctgaaggtatgtgggcccatatacagtaatgtagaggacctcactcgataatttttgttcgggttcgtgtggatgccgcggcatctatccccgtgggaaccggtagaggcggtacaaccgtaggtcgtcgtcggggcgagtggtcgccgtcgtgccgccggcgatgcggagctcctccatagcccagccttcgacgtcgcacccgacggaccaatcgttgacgaaggcccatctcctactccggccgatcttggcgccgtccgccgtggcgatgatcgattccggttgattgatcatcactttccagtagcctccggtgatgtttctcggccgtgggatcttgcgtcccgggctgaacacgtacacgctgccgtcttccgccgcattgctcttcaaattatctaaagaaaaaaaatcatacaagcgattcatcagagatcgatcgatcatggatgcgtacgtcgtcgtcagtgaagaagaagaagagttggggtttcaaaaaaaaaagaagaagaagaagaagaagaagagttagaattagaatgaattaaggtgcatgagtgagagtatacagtagaggtgggaggggtggtcgccggcggtgaagacgttggcgtcgtggatggtgaacggcagcggcggcagtggctgcccctgccgcttctggtcgagggccgccacgagcagctgccgtatcgcggcgtaggccatggatttgggatgatgatgatgatgatgatgcaggcagaggcggagatgaatctgggtcgggcgcccgatcaggaggaggcaaaatcggacgctgatgtcagcatgacgtaaacgttcgatttacgtgcaaaattactttaaactgatttatctcttaaattacttatccaaatcatgatccgattgcaccattaaattcattgcaattaaatcttcaaaacaagaccacacatggatatattccgatgaaatttattttttagcttattattgaattatttttaaatgttgcacgatgttccaccagatatatcggaattgtttcgctaagtagatcgaaaatgtttcactcgtttaaatcgggtgttgtttcatcttatataaaaacaatgtttcagcaaatagtgaatgaatgtttcagttcagtgcaatattatatctatacatagtgaaacattgtgagtacattaagtgaaacatttttggtggaacaaaaaataaaccaaattcccttaatagagagtttcccaaatatgtgggtttttttttgcaaaagagtatttttaattcactgagatctataaatagtgaaacattataaatacattagatgaaacatcttttgtgaaaaaaagggaggaagaaataggtgggtccaaatagacacgtggggggagagggcg

SEQ ID NO: 72449 - DNA, 19642 bp, Oryza sativa
  unsure (1)..(19642): unsure at all n locations
tgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtgtcccatggcatcgacacgaacagcgctgttttggttcgtgctcttcatgtcctgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattttgaagggcttctaatctatccggatcgatgaccttctgcgaaattgcgttcatgaatgcacatagctntgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcctggcgtacgtccaagaattctcaatatggtaactcccaaaatatagagttctttttccacatcgccgcgtgacaatcttcgctctctatatgctggcttccaggcccctttccgaacactactttaagatctttaaccatagcaaacacttgttttccgctgcgatgtttagaattcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtacccctggttgactgtccgataggttgctaagtgcagaccaatggttaatggtggcgaacaggcagcgctcgtaggttaaactcctcctgttggtcctcgtcccacaggggaacaccttcttttttccacagctgtttaagatcttcgaccagtggtcttaggtacacgtcgatgtcgttaccaggttgcttggggccttgaataataatcggcatcattatgtgcttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtctttcctggcgtactgcaacatctgaccaagatcatccgcaacgtcgttaccatcagcagctatttccttctcgcccgtttgatttccttcaaatccaacatactgagcaaagtccggaatattgtcgtctttcacttcaccttcttccatttcaacaccttgctctacgtgggatgtacaacaattatagcttggcatgaaccccgactcaaacaagtggaaatgaatagttctggatgcagaatactccttatgattcttacacttattgcatggacaacaaataaaacccctttgcctgttagcttcggccactctcaaaaaatagtgcacgccgtcaataaactctttggaccggcggtcagcgtacatccattgccgatccatctacatgagtcaaaaaaaccgcacacaaataatatttcttacaataatgacagtcatacataattataagatatcttttattcatacaaaaatcataaaatatcacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcttaagccccggttggtattaccaaccgggacaccgggatctttagtcccggttggtattaccagccgggactanagttaagatctttagtcccggttggtgctccaaaccgagactaaagatcccggggggacctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgtatgaatgtccccaaatatgtgtgcatgcatatgtactgcttgatggttggtccatatatatatatatatatcctttcgtgggaaagatatccatacttcttgagcctttttttattcctttatttaacatgtggtaaaggaaacaacggcatctgctattttgaaatatcggaaattcctagctatcatatgctactttggagcattattggagatgctctgagagaggccaagtgggagaatatagctatcctcaccccattaccctatcaaaactgcgcagattgagtgtgtatacatatatctgctggtttttaaagagcatggtgacaaccattatttaacccttttccttatcatcacgattgaccccaatttttggctctaccaacggattgtagtttacttcaactaacatgtgatcagacaccactattttgacagtcttacatagttttggggaagtgctcgagccaagtgataaacatccaaaaaagccaagtgatctccaccattttttttcgataaaagatcatatattagcccggcttttgaaagaaagcccaaaccaaacagagtattccagggtatcaaatataaggaacgtgcatatactttttatgaacaggattctatcaaaggacaacatgacgagtgataggctagagaggattcctatggacgtatttagctgacttaagttaaaggcaaaactttatcgaatacatcaggaaccagccctcccttagtctgtcaggttgagtccggccttgagctttatgatgtacccgaatatagaggcatacaaaggacgggcagggttatcaccacctgtcgtctaccctactttctgtgtagcacacaacaaatgaagataacctctaacctaaacaccacacctacgttatcgattactactctagcctcggccaagaactatcttgtttatccagagtcttagtactaaagcattaagtataaatactaagcgacgaatccgcaccgatgagaatatatctcacttaaataaactaattaaataccataaggaaacttgaatacttactttttaaaagaagtatccaccgaggtaaagcgagagaagaaagccggcaactcatgcgcttctccggcactctgatggaagaattctcggagaaaactccgatatttgggacacaccttccggagctttccttcactctcttcctaatcccacatactaaagtagctaccatgatatgaaagtgagttgtactctactttgttgtgcaatttgagagtgcaaataccttttcgttttatagctcataattacaatgctttacatcggtgatagctgccgatgaaaccttcataaccaccattggggagtcatcaagagcatacacgtggaagcagatggtgagaggagccaaggtccgttcgagcgaccttatagttcggccgaccttttggcccacctctcggcctctccttcggcagtgaggttgcctggtggccccccctacatgttataccttggttaggctcaattgtaggtagttttgattgacatgtgaggcttccaatccatgtaatcatgtctgattgtccggaggttccttctatcgcttggtgggtgtgttttctaccgaaaatcacatgcatacatatatttaccaaagctagtggaaatggttagttataaacccctaccacaaagttttgaaattatattttatttcttttatgcaggagttgatggtaaaagtttgcacttaacgaccggcaacactatggctcggtgaataatcatacacattgagtgattcaagagaatcaattgaggagtaaagttatgtttttatgagcaaaacgaaaaaacccatgacactcatcaggagaagtggaggtaacttgaatcatggtcgttccattcgtcaatcacccaagatgacatggtagacaatttaagattcacaagtacaggtatgacttgaaataattattataccagtatcattacaaagggattcattgctcttgaaagtgcatctaggcccctaataattttggtgattaattacaatgcgattagagaggactaacatttttatttaagcaaatgtgaaggttgttatgtcctcgatgagttagcgtaatgcatatcccgccaaatacgttgaagtgatgtgttgcggcaaatgagcaaatagtattatgtatccttttctttttgcttgagtcaataggaaagccgcattaagagggatgatgcattgacatatgaggagtgatcaaagtgctcaaaatcaatttttaaaagtgtttctcctcagttttagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaacatccagaacgatgtttttggctctgagtattttcggacttgttcgaaagtgattttcggacttttccgaaagtgattctagaacgatgtttttggttctggatatttttggacttatccgaaaaattttcggaatgtccgaaaattctctcgttgactttgctgttggtgctgaactggaatttttggacatgtccgaaaatctttcagaatatccgaaaatcacaattattgtgtataacaggcagaatttgggctttggctataaatagccccctcccctcacttgtgagggctgctggtcacattggatatttttgtgcccttggcttgctcttgttgagattcacttttgagccttactttcttgtttcccctctcacccatgttcgattcggatttggtgtgtgtgtgagagttgtggattcgagtttgtgtgagtgcttgttgctgacttcgtgaagatttgtgagcacttgcatcatctccgggagttcaatgcttcatttgttacttttggaggttgaggactcctaggcggctaggtgtcgctcccgacccaccgatctacatgtggttggccgggaaaagtttgtgaaggtcggatctcacctccgaaagggaagagatacccttagtggaaggaggagtgcttagtgcaatctcttgaggaaagggttagctaagacccgactcttagtgagctcctcaacggagagtagaatcccctcaaggattcgaacttcgagaacaacttcgtgagcttcatctttggtgactttacttcctccctctccactagctttgcttatttgagccgctataggtctagttgatgtttgtgctagcatattcttgttgtaggcaaatagatctaggatttactttgctatttatgctgactccgaaaattttcggatatatccgaaaatttcggaaatatctgaaaattattgcttccgcttttaattgaattttttgaattagcctattcaccccccctataggccttattgacactttcaattggtatcagagcctaatctcctaattcggcttaaccgcttggagagatcatgtcgggccaagtgggggatgggaataatggtgataagggagctaagattccttatgactatccccctacatctacatcttatgtgagtacatttagcggcaaagcttcatacttcaatggtacggactatgtcgcttggaagcataagatgaagatgcatttgaagtctattaatccatctatttggagaatagtcgaaaaaggctatgttttgcagaatcccgaagatcccaccaaggaggacgacgagaacgagcacaagaacgctcaagccgctaatgcaatacttagcgccttgagtgaaagtgagttcaactgtgtggatggcattgagagtgccaaagtgatttgggacacgcttcagaacttgcatgaaggcacgaatagtgttcgtgagtccaaggtggagatcctcaaggggcaatttgagaggtttgtgatgttggatggtgagagcccaagcgacatgtatgatcggttgagcaagatcgtcaatgagatcaagggacttggctccaaggacatgaccgatgaggttgtggtcaagaagatggttcgagcaatcactccaaggaactctaccttggtgaccatcattcgtgagcgtccggactacaagactctcacacctcatgatttgcttgggcatatccttgcccatgacatgctcgtgcaagagtccaaggatgtcatccaatacatcaaccaaagctcaaccacaagcatcaagaaggaagacttggcattgaaggcgaagaaagaagaagaagagaaccgcaagagcaagagcaaggcagagatcgatgatgaagagatggctctcttcgtcaagaagttcagcaagttcatgaggcgaagcggcttcttcaaggaggttcttccaaccactactccaacaagtcaagtggaagacactccacaagagtgtgctacgtgtgcaaagagcccgggcactttattacggattgcccccacctcaaggatggttcccacatcaaggaagataagaagaagggtgagaagaaggatgagaagaaggagaagcacaagcatagcaagcgggaacattatggccaagctcaccttgggatgatattcggctccgactccaagttaagctcaagtgatgaagaaggagctgccacgttcaccgtcaagccttcatcaccaccgagactcttcgaccactcaagtgatgaggatgctcccatttgcctcatggcaaaggaatctaaggtaccttctcctcacaagtcatttaatgttgatcttgttagtgatgaggaggatgaggttctggatgacgaattgtttaagtccataactaaggaatccctaccacacttgagtgagttacttggaagaattgaggaccaatatgcaactcttgagaggcaagaggctttgctcattcgtgagaaagagcggtcttatgaactcaagaatgagctttctaaggagagagaaaaatgaggcttaggtacggttttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgagccatcttgttccaaaattgtcccaagtaatgaaccatgtgtgagatgcaaagatattgatattgaagcttgtgctactaactctatttctttgagtgctttgcaaaagcaaaatgagaagcttatgggactccttcacaatggcctacttaagtgccatataggtagtaaggccctaaaggagtacctaggctatcaaagggacaacttcaaccatcagggtcttgggtatgttcctccactaaaaggaaaggtggacaagagtgtgatgatcaataggccccaaggtcttagcaattttgttaaggccaaaagtatccttcctaatgattatacttcacattgttcttttgatgcatcttatgttcttaggaagaatgctagtggtcgtgttgttgctaagtatgtaggcccaaggggcaagaatatttctatcaagagagtactttgggtgcctaacgcacttgttactaacatgggaggacccaagcaagtatgggtacctaaaactagaaattgatctcttgtaggaatatgtctccggtggaagaagttgggtgattgatagtggatgcaccaatcacatgaccggagaagaatcaatgttttcaactcttgatctgtcacgccctaaaaatcctaagtatataaattgttgtttaattggaattattagaatttattttaaaagcctacaagttaaactctaataatctaggaaaattttcaacataaaaatggtctagataaaattttattaaatactttgcttgttcctctattttctagatttttctaggaattatttgagcaagggaagtatttttaataaatgaaacaacatttcacaaattattttttaattgaaaaagttgaaaaatcctcccctaagtcgttgggccgatttcggcccaactcttctcttccccgcgcggccgaaccggcccaagccggcccagccgacgccgcccgcccctcctcctcgggtcaccgacatgtggggccccggacccatcttcctcctccagccggccggttgccaggccgagccgtccgagccgccgtttgcgccgtcgattccccacatcctcctctatctttccccctaaaaatcggagcaaaccgttgagtattctctccgaatcgaactcgttttcgagtttatctccaaaaccgagtttcgtttttcccgagtcgatttcttgcgggaggagtccgatctcttcaatccaaggctataaataggaccccctagtcctcctctttcgtttgccctctctcccatcctctcccgtgctccgtagcgccgccgccgcgcgtgtcaagccgccccgccgccggtcgaagtccagccgcgccgccgcgccgtttgcgccgtcgccgccgcttgccgccgccgccattgggtgcgccgtggtgagagaaagctcggccacccttcctttttcgtcgccggtcaccggagctctgccgccccatacaagccaagccgccgccgttgcctcttcgtcgccggccgtcgttgttcgtcgtttggctcgagggtgagtaccgttgggttcgtctcgtcgtcctctacgtgtacttgtcctccaaattcgcagccgatcatccaatctccggcgagcttgccatccgagccggccgccattgatgacgtcatcgtgacatcaccatcttttcttttttcccgtttttctaatagattaaatcttcggaaaatcataactaaataaccgtaactccgattcgagtggttcaagttgctaaatttttctaaaatcaggatctacatgttaaaaatatccacatgtactgtttatgcttgtttttgaactgttttgttaatttttgtttaattgctttagtttccgacgttccggaggagagcgtttccgttgaggaagattccgaagcgtttgcggaagcccaaggcaagtcacacagatcccaaacaaacctttgagtatgttgaacccatttaaagctattattttatttcaactatgcattgttttcgaatgtcatcgggtggtgaacctttcccaattaattaatggccgaagatgatcttattttcctatgggttataaatttgattagcatgaaccttatatgttggattggttcagctaaatgctatatgtaagtctgcttagccatgcttagaaacattagctaactaaagggattaattataaactatgttacattattattttatttatggttacattaaatggtagctcacgatggttaatcgtgtgatgttaattaattgataattaaaacctggttaaggtgggttgtgagcatatggttttgatggttgtgctcatgacaattaaggaccgttcgcgagctactgtgtgaaacatttatcgtgccaaccacaagccagcgtgggcaacggctttatcttttgacagcatgattcattatagtgcgccagactgtgaagtggcgagaagtccacgggggtcgctggggagtccatgccttgttataagggggtgattatgatccaggaaaggtgcgctgtaaaggattatgttgtgcaaggggtattgtcacaactcctttccgaggtatcgtggtggtactaaggcgcatggtaacatgttgtgggattgtgacttgtgggtacagtggtacacctctgatcagagtttaatctattcgaatagccgtacccgcggttatgggtgagttgagcaatgtttttcgtgattagtcccatattattcattaatggtaattgtgataattaatttgactcctggtttggaatggtacgttcctggtatggaggttagatttgtacaaccggggttggttgttcatatgaggttgggcctatgcaacatgggtgtgttgtatggtgttatttaatattgattaattattcaactgtttttaccattcccttaaatatttattaaatgttgtttctgcaaatgagctatattatgccatcctttgttatcctgtgcacttgcatatttgctgtgtgacttgttgagtatgtcatatgctcatttttgcaataatcattcatcagaagaggagtatctcagtgaaggtgatgatctggaggattaggcttgttcctggttaagatgcctgtggagtggagtcgccatagctgttccgtagtttgttatagtttttttttccgctgcgtagaaggtttttctttgagaggaactatctacctctgtagtaattatttatttgcgaatatcaaatagatatttatttgtactctattatcaatttgttattgtgtgcctcggttgattcctggacgagggtttaacacacatgtaagcgtttggaattttggatagaaattccgggcatgacatgatccaaatggcacttcacaagataacatggtcttcggggacgatggaaagggaaaggttatgggattgggtaagattgcaatctctaatgatctttccattgccaacgttctcttgttaaatctctaaactacaatctcttgtctatttctgaattatgttctatgggttacaattgtccttttaccgatgttgatgtgaccgtctatagaaggaatgattcatcggtagtctttaagggtgttctcaagggaaagctttaccttgtggatttttcctcaagtaaagccaaacatgagacatgcttagtggctaagtccaacacggggtggctttcgcatcggaggctagcccatgttggtatgaggaatcttcacaagattctaaagtacgatcacatccttggactaacaaatgtttaattcgagaaagatagggtgtgtagcgcgtgtcaagccggcaaacaaattggagcacatcaccccgtcaagaatgtgatgaccactacaagaccattggagcttctccacatggacctcttcaggccaattgcttatctaagcattggaggtaacaaatatggtcttgttattgttgatgacttttcacgcttcacatgggtgttctttttgcatgacaagagtgagacacaagccatcttcaagaagtttgcaagaatagtacaaaacgagttcgacctcaagatcaagatcattcgaagcgacaacggcaaggagttcaagaacacgtgcatcgagagtttccttgatgaagaaggcatcaagcacgagttctcggctccatatttacctcaacaaaatggagtacccgagagaaagaataggactctcattgagatggcgaggaccatgttggatgagtacaagacatcggaccgtttttgggccgaagccgtcaacaccgcatgccacgccatcaaccgcctttatcttcactaccatcttaagaggactccctatgagctttataccggtaacaaaccaaatgtctcttactttcatgttttcggtagtaagtgttacattcttaataagaaggctagatcctctaacttcgctcctcaagtggatgagggattcttgtttgggtatgggtcaaatgaatgcgcataccgcgttttcaacaaaacctccggtattgttgagatcgcgcgtgatgtgacatttgacgaaactaatggctctcaagtagagcaaattgactcacatgtgttaggtgaagaggaggacccgagtgaagcaatcaaaaggttggctcttggggacgtacgtcctagggagccacaacaaggagcctcttcctcaacacaagtggagccacctacatcaacccaagccgacgatccctctacctaaagcttggatcaaggtgaagaaggcgagcaagtgctaccctcctcgcccaagaatccaccaaagtatccaaagagatcatcccaccgacaacatcttaagagacatcaacaagggagtgtccactcgttctcatattgcaaatttttgtgagcattactcgtttgtgtcttctcttgaacctctaagggtggaagaagctcttaatgatctagattaggtgatgccgatgcaagaggagttcaacaatttcacccggaatgaagtgtggactttggtgtagcgacctcggcaaaatatgattggcacaaagtggatcttccgcaacaagcaagatgaggccaggctcgtaataaggaacaaggcgaggttagtggcgcaagggttcacccaaatcgaaggattagattttggtgaaactattgcgccggtagctagacttgagtcgattcgcatattgcttgcttttgctactaacctcaattttaagctatatcaaatggatgtcaaaagcgccttcctcaacgagcctatccatgagttggtatacatggagcaaccactgggcttagaggatccgaagtatcccaaccacgtgtacaagctccacaaggcactctacgggcttaagcaaacccctagagcttggtatgtcttcgcaattttcttgtgaaaaacggctttgaaatcgggaaagccgattcaactctttttactaaaagacatgataatgatatttttgtttgccaaatatatgtcgatgacattatatttggttctactaacaagtcttttagtgaagagtttagtaggatgatgaccaaacgttttgagatgtccatgatgggtgaattgaagctcttcctcggccttcaaattaagcaactcaaggaaggaactttcatttgccaaacaaagtatttgaaggacatgctcaagaagtttgggatggagaatgccaagccaatccagactcccatgccatcaaatggccacctcgacctcaatgagcaaggtaaagatgtcgatcaaaaggtatatcgttccatcgttggctcacttctttacctttgtgcatctaggcccaatattatgcttagtgtgtgcatgtgtgcaagatttcaagccgctccgaaggactatcaccttgtggccatgaagagaattcttagatatttagtgcacactcctaaccttggtctttggtatcctaagggagcgaggtttgatctcattggctatgccgatgcggattatgccggatgcaaagtggataggaaaagcacatcgggtacttgccaattcttgggtaggtcccttgtttcttgttcttccaagaagcaaaactctgtcgccctatccaccgccgaagcggaatatgtttcggcggggagttgttgtgctcaacttctttggatgaagcaaaccctgagagactatgacctcaatgtatctacaatcccactcctatgtgacaatgagtgcgccactaagatagccaacaaccccgtccaacactcccgaaccaaacatatcgatattcgccaccatttcttgagagatcattccacaagagacgacatagacatccaatatgtaagaaccgacaaacaattggcggatatctttaccaagcctctagatgaagctaggttttatgagttgaggagtgaactaaatattttggattctcggaatgtggcttgatctattgcatgcatgtttgcttggtagaataggtttgcataccactttgtgacaaaatggtcattcaactcatggatggacactagtcacttttgtggagaacttgaatctatgtgtatggggatcttatttttcaatgaattttggtcctagcacaacttgaaatagattcacacattccctctctcgagggtgaattatcttgtatcatggtaattccctctcttttgatccctcggatcgtccatttgacttgtggctattgttttgtgtgattgattgtgtgctagtcacaagttcaaatggagcctctagtgctcgaccatccctcctttcctaaatactatcaaaaacctttgagaaatgtgtttttgtcaaaaatttcccggtgcttgtcccttgcaaaatccatttcaaatgtttgcaaaatagtttcatcaaaattcctagcgaaatccccttgcaaaactgtgttttccaggaattttcggactttccggaaaatttttggacttcccgaaaaattttcggatatatccgaaaaacattagaaccgtgcgcaacccttctggatccgttcggacttatccgaaaattttcggaaatgcccgaaaatttcggggtctttatatatcaccccgtggactcccttctctctcctttccactttttttccccacgggattgactccctcctctctccccaccggcgaccacctcctctccggcgacttcctgcggctcccctcctctctatcctcgtgggagcgcgcttgggggacttcttggggcttgcattgtcgatcttcaccgcgttcttcaagtgttcttcgcgttcttgaggtattcgccctaaaatcaaatcctttgattcctcaagttttatcttgcgattccctttggtggagatgttcccctagtgccctagaacctgcggattcaatctcacaagtttttgttggcggatttgtgcggcatctgagttatagggttcggcaggattcttttcggacttttccgaaaattttcggatatgtccgaaaatccctggccgacccctatcacttcagttttgcacgattcttaccttcacttacttgtttcttgcctttttggcttccattcactggtcccttgtatctcgcttgtttgaaggatgcctcccagcaagcaaacctcccacaagtccaagcgcccgagggatcgctctcccactccatcctctcatgatgattcggacagtgattggtctggtggagaggatgcggttcctcaggttgccctggtggctcggggtggcaacctccctcctcggcgatctactcaagctcttggtgctggtggtggtggtgaggactcctctcgtcaactgcaaacgccgccgcatcaacccaatgtccccattggtcctctccgcattcatacccccgagagggatccagcggtgattcgccaagtgtatgattggaggcggaagactgaggttgttgctccctggtgggatgaggatccgcgccctcttcaccactccgccacgaatccgcggttttggactctctttcaacaagacttttatgagtcagtgatcaagtccaaagctcatcccaccgttcccatgcaatggatcaactgggaggagttgcaggcgcataatgatccggtgctaaactctgtgattgcaaattgtgagcgcatggggattcgctctttcatgactttgcagcaggattggtgcaacgaagtcatcgctcaattctatgccaccgttttctttgatccacaccgtgccatgcattggatgacccaaggatcttggtattctgtctcctatcctcctttggctgagatttggggtttcgacttgcatgacttactcaaccttcctgatctgcataatctacccattcctaccaacactgatctcctccctctttacattccaaatgatcctaatgtggtgttgggtaaggtcgacggtctcaaaccgtactttgcctacttgaaccggatgtttcgccggtcctttgtgccaaaggatggtgatgctagcagcattaaccgcctctccaggactgtgcttctcaggttcgatccccctcctcatcgctttcatccttatcactttgtgtgggaagaaaaccgcatggcttccattcagtacaggaaggggttggtctatgctcctcacattatgcggatgatcgagtctgtcactcagcttcagtttcgccatgatgtgtctcattcctagcttcacttgtgccttgttaaggcgccccgctcctcagccgctcgggacatcccctcctcttccactcagccgcctcctgctcctgagcgcccttcctctgtggctcgtcgtgagccgtctcctttattccgcattttgcagagtctttttggtctttgctccgcggaggccaaaaagaactgccgattgcggaattcaacgaagaaaacggctcgcgacgtcaaattcctcaaggcaaggtattatgaggatcatcacatcgatatccctccttctcctccgggtttcgaggccgagcccgatgagctagaggaggaagagattgaggatccatttgctgggtcgcctcctgacttcgacttctttgtttatgcccatggctatggctatcctcctccaccacctccagaggatcctcctcaggccccccttcgcttgagtcgtcgtctcatcgtcctctctttttggtgtcttgatgccaaagggagagattatctatcatgtctttagggtcgagcacatttggcttttatttgtatgagactatgtgtgatttctaagttaagtttaatgctttgtaaactttattgtttaattatggatgcttgagatgtaatggatcttattatgtttaatgtggtgcaatgccttatcctctttatatggtgtgtgtgatgagatgtaattattcttatgcatgtgatgtgttggatgtgatgagcaaatgtgatatatttgttgtcttgtgagcttcaatgtggatgcaaagatttagggggagctctctacttgcttttatgcacactcttaggaggagctttcactaaacctttgcaccaaaaccttaaattatactcattctctcttgtgttctaatcgtattgtcatcaatcaccaaaaagggggagattgaaagtgcatctaggcccctaatgattttggtgattaattacaatgcgattagagaggactaacatttttatttaagcaaatgtgaagcttgttatgtccttaatgagttagcgtaatgcatatcccgccaaatacgttgaagtgatgtgttgcggcaaatgagcaaatggtattttgtacccttttctttttgcttgagtcaataggaaagccgcactattaagagggatgatgcattgacaaatgagcagtgatcaaagtgctcaaaatcaatttttaaaagtgtttctcctcagttatagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaccatccagaacgatgtttttggctctgagtattttcggacttgttcgaaagtgattttcggacttttccgaaagtgattctagagcgatgtttttggctctggatatttttggacttatccgaaaaa

SEQ ID NO: 72450 - DNA, 1216 bp, Oryza sativa
actgaagatctatatctgtggtctactacagctcaactgttgtaaacaatacctgtgatgcatcgttcttccaaagtttcatagatggcctttgcattaaatagtatatccatatctttttttagtgaatagtacttgcaattttgagtgtgtgctttccatctcataaggtttccatgtttcataatgtcctcttgagtttaatttgagttttcaactattggaggaactataaatagcactagctaaatatgttgcacacgtgattcatgtattcagctcctttactaccatatataagtttttggcacattggatctatgattttgccacagcagggttaaaatcaaattgctctgagagaattggaccttggatttggatatccatccagccaggtcaatagtatgtgactcttaggctccaaaaaataattggcggtgatagaacttagattatgtcaaaaaatgacgaacttgtacatttttaatttttcactgtaagtagttgaaggtgttttctattttttttcttcgcttcatcattcaaaaggtgtaatttcttcagtattaccatgttttttttagggttcgctattaccatgttgacatgagtactttgtaacatggcaagttgagagttgaatttcacaattgagagttgcttacatttgtaatagttttagtaattttggaatgaacgtgcagcttggaatgtataatgttttttggtttgaaatgccaaatatatatgtatattggtttattaaaaaaacttcaattccatttgcacactctagatatttgcgacgcttcagttatgtataattttagccttgcgcgaatctttttgatagattgctggagctaaagcacaagctttaccctttttttcgaataagctagaaatagcgtaaaaaggttagtgttagaggtttacatatgttttgacttgttattcttgtagaattgatagtcttctaccataatgcaaattcttgtagttgcgtgtcttttttcatgatttaacctgctacacgaacgtatcaatgaaaaactcacatcttctgatgccactggcgcggcgcgcaaagcgcgcgttcacctctagttttcttttagaatataagtatatttggtatcttttcctctggattgaatcgcctccctcaactgctgactcaaacgagtcaaccgccgaacattgtctgcagaaa

SEQ ID NO: 72451 - DNA, 1408 bp, Oryza sativa
tgaggttattgtttgattaggacctaattgattgaattgcgtataggctagtgaagtctgaatattcgaattgaaacctttagatgttattttgcggagtgaacagcgtagtgtcatggtcacgttatctgcaatgtactatttaagaaagaaatgttatggtgagttgattgtttctgagataacaagttgtttgtggatgaatggagacattaaacttcatgctgagcagatatgcatttaggcaaatgcccaccgacatctccaattccctatgatgtagttcagctaggatgattccaatctacccttcattttgtttattctagttttcttgcttttggattttaactgccatgtataaaccatattagatcgagttccatcttcctgaattgactaaaatgttgattaatctgaagagtttaaatcatccagaaaagccataacaatgctttcttttggtggacattgcttttgaatgtttccatgaagttatagacacttgttctactgaactcattgattacactaactttcctgagtttaaattgtcttaattttggactaatatatcatctttggactttgtttctatgatccactacatagtgaatgcatgactgacatccatgttaggatgctacattatattttgcatggttaattagaatcctgtgtgcaatgggagacagaaggggaatttaagttgcctcaaaatattccctgcatagtgtaccagattgtaaccgtactacaaaccatgtttctcaagaagacaagttcagtgcttgagctagataaaattgcttcaagaaatattaacaaagctaagaaagttttgaacaaagtgaatctcagtatctaggcatagactaggttcacccaagccctttgtgctaagaaaatgtaccacaaggctgaagactttctcatctatgttcaatatggagcttagggttttagtattgtggatcatttatttgtgcagaatcttgaacttatgaagtatactctaaactaaaataactctttagttgataagtgctaacgttgtactttgtgcctttgtggtagcatttaattttccctcagcaagtcaccacaaaagcaatttgtatctccaaatcaagcacattttatagacattttctgccacaatattttaagcctctttgcttcgtttagagacccaacagcccaatcaaatacacttgcaaatggaatttgcaacgaagagatattttctcctgatgctgtactgtgtctttacaatggttcttaatttgcagggtgaagctttggctttttgtggcgtatgttgtctctttcgtctgcctagctggatcagtgggtatgttggtgcaaaatgccttgacagacaaaggcccttctgtgtggactggtg

SEQ ID NO: 72452 - DNA, 7257 bp, Oryza sativa
tgcctccccccgcgccgggcgaccagccaacagcattatcgggcagaggcagacagattaatcgccgatatattggttctttgatttttggtacgagtgtttgtaatataatcatgtttgagatcgtgttcttgtacgcgttcgtgccggttcactcttgtacgtgttcgtgtcagagtgaaccgagaattctgttcggttaaactatcagcgtctcggttttggatcggcacccaaaatcagccttatacacttcgttgccaaaatcaaccttattaaattataccaaaatttgacatgttttgatgttttcgaattttagtggttttggttacatttggtttaaagccttatcaatttagttgagtttttatgggaggaaatttccgaaattaccaatctttagtagtctagtaacggtaggattatgctcaatttgttaccctaaccaaatttactaattccagatacttgataataaggttgaaagtgagaaataaagtggtcatgtcctagggattgtgaagtttcgtccgaaagagcatgcatagcccatattatttgtcctggaacgggaatatggcatccatgatgcccatacaagttgggctggaactcccgtgggctgtctaagtgacacgcggggagccactggctgtacttttgacttgtgccacctgcaacaactcggatgattcccttggtcgttctgagatccatccatctgtaatagtatgtgatatatgcggaagaaagaagagtgcagcgcacaccttgctgttacgttcatccatatcaacgtaagtaatatcacaaatattactttactcgctaatacaaatatttgacaagtgaaatgacatcaatagatttgtgtgaaaaatattttgatgtagttatactttctacttgttttttatgaatacttgatagaaaatgaatgataaaatatgcaggacagcagattgtgtcaatgactctaaatggcaactaaacagaatggttgcattttttttccaaaatgtttttctcgagagcagaagtgcaaattgaaaggggattttagctacactggtcacaaatagaacttatcagagctaaatgaaatatctctggtattgtgaaacctgaaaaattgagtgggagaaacttttgacttttgaaacatcacacgtttactaatacacggacaatatgcatgatgaaatggcacaacaacctaaacgaattcgattcactgacattgtactacaacaaagggaaaggacataattaacattagctaactttgcaccggcatattcagacacttacacacttgtgcaattaaacaatagtggagctacaactaaagttgctattcggtggccggtgggacaactatatcaccttgtggagccgatggagctacatgctggtcttgtttctccttgcgagactctgccccttgggaggtgtcagttggagcaacaccatgtcctccttcctccttgagattgtgaggatttttcgagccttgcgaatcggatggaccgatgacaccatcttccctttcatcctcaggttcctctgttggcaagtgaaacagttgcctcctctggagcatctctgggaacgtctccatgccggcatgtgccagcaggagccacacatgggagaggtactcaacacctgatccaaggctcttggcatgcaagtatcctcggcatctaccagcggagaagcatagcatctctacccacacatctattatgacatcccacatcttcttgtaaccccgagccaataacaaatctcgggcaagccggaaagcatcatgaatgaaacaattccttttatgctccaccttctcaattacttttagcgtaagtttttcttcatcatccacaggtagatttttctccttgtgtagaatggagtcaagttcgcggtacgcagttgtgaagagattacttctgctgccagccatcagcatctcaggattagcgaacaacagatgcattatgtagttggagattgctcttgacatcactctgaaagaagggccattgggtggaccaaaagattcatgatacttgtgaaagcagaagtccgtagccacatgccatataaggacaatctcatcgaatggtttctctaagctccagcctagaagccaggtgcattttgctcactcaagtgcccactgtcccatgttgtcattgaaactcctgtagctctcggcgtttctatgtattttgtccatccatctttcacataattgtgaaccaaatttgtaatatcggtggacatatcgcatagattcatgcaccagtattggtctagcaaacccttgcattgtaagcatcctgcgatgcttatcaaccatgcgtgccttttgtttcgggtgaagaatcctacgaggctttgttgtgccatagtgttaggcaagacatcgagatatttccatactacagccatggaaatgatctctagtaaaagggtgccatacgccattagaaatgtcacaatgacatcattatggctataggcttgtttatggctgctgtggaggagaccaacggctgggatcaccagtagtatagctagcatccatgttgataaccaacaatagcggtttgcgtcaggttgttcgctatcaatcttatttctggtgtatagaatatcaaagatgctggagagcccactatttattgttttacaaacttgtgtgagatcaagggtaaagaagtattttaggttatcaaggcgatcggaatatgggtaggcaaaatccacaaacaacatggtgggcacatcgaactctggggatgaaatttcttctctagtaccttgctgtgatgctggaggagaatgatcgctgcgctgaagtaaagcctttgcttcattgacgaaagattccagcatttcttctctgttaacgactatatccaattcagcatcataattagagctgactaattcattaaagcttgcggccttgagagacatgggcttctcaaagcatttgacaataccaacgatgaaaagcaaaattgcagctgccaatagccttctgtcagccgacgacgaccacgactggcaaaagacgtagatggctactgtgacctgatcacgaattcacgattatgtgaaattaacgaataaatagatgtcaaaaatataaatatataattcgaaattccgaaatatgtcaaaaatttcccttgtaattttgaaatcacattttataattacagtctggcctgatattgaaatttaatattcaaaatttagatgctcctgcgctttattatacataattcgaatttcaacagtaaacgtaaggaagcataattctattcccaacttgaacacaacaaattgacatataaagaatttcagaataaacatatctgacaacttagggtttgctcgcttaatctctatgaagaaaggactgtaggggattgaaagggattatttccacacctcaatatatatgtgtaaaattattccccttcaattcctctcgatctttttgttggtgggattaaccgagaacaatcaatattaacccttagtccttgttcagtccacaataatttggcgaaacttaaaatacaaatacaattaatatatccgagcaagaattgcacgttctagctactccttccatgctaaaatataagtaatttttagcatatatagtaacaaatcaaacatttttaactttgactattaataacaaaatagtaaaaaaaaatcaatcatgtaaaactgatgttactaaatttatcattaaacaaactatcataatatacaactctttttacttaaaacatttttacttttatagatattattggtcaaaaaatagtacctcgtagaccatgtcagagtctaaaaatacttatatgttgggacggaggaaagtagctagggttgagcacctgagataatgcggttaggatgtggcgcctccacagctcattgtcttctatgttgtaggcggtgatgaacatctggccgccgagatgcatcagcaggataggagcccacacgacctctagatcatggctaccattgttgtcgtgctgcagtttcttcttgcgattgaagagagtggcaagtgcgtataccgccaacgcatcactagcaaggtacgagagccagatgaaaaacctgtactagggtgggaaacggggtgacttgcgcctgccgccaaaaattgcaagaaagtactgtacgccgaggctgcccaacacaagcacgcgcagctgccactcctcccaccattgcacggcgcttgacaaacccatctactacctgttgaatcgatcgtgtgttagcttttgtataactatagctttacttcgcctaatgacgatgccttttagggctttatgcagctagctagcacatcgtcagtcacagtaaatttatggagtttcttttcaagactttcaactgcttcggtgcttacttggtcctagagaaatattgacgcacttatcaataacctcgatctccattaacagtgggattgatcaccgaaactttaattttaagtgtagtacgagtactatttatacgagtcacccattttacttgttattaaatatgttacgtggatctcgaggtcaactacgaattgactaattttataaaattgcaagccttaatgctactatatgacttggggcatttccattagatggttattaatgaagtttgtaccagttcctaataaataggtagattccatttgtagattctattagcttgttactcatcttcattatattttttttgaccaagcgagcaagagctaccatttcacgtattaagagaaggttcgataggatttgatgtgaatgatcggtctggcatcatacatgcatgagactgtcatctagctgggctgcgactccacttatggttgggccgaaaagaggcaagccgagcaaaaggtaggatgcagcgaattgggttagggtgaaaaggaaataagaaatgaacttaagacccaaaaacaaggaagatttttattcaactttttcaattatagtgtataacgatccaaaagtttcaatttatagttgtatcagtgaaaaaatatctttacccgttgcaacacaaatatatttttttctggtatataagagatggcacatgatgctgagttatccgatgtatatgtgaataacatcgtttaagtgttatagtggtttaacaaagtcaatagctaattcttgaaaaaatggtaagaatatgttttctttggtctgaaattgtactatttcagcacatggtacgtattgaaaaagttacagaacttttacaaactattgcagtacaatatattggcagtatataaatgggtaatttagaattttatagaaaattggaataagttttctagtaatttcgtggtcgagagttaatccggtccagttgggacttcttcacgtgttaggccaccgacatcactgctggatcatgtttgtacgcctgcgagagacgatgacacgcattgcgatggcatgattcctggtcaattatgatcatcattaaaaatttgcatacttggttacatgtgaccaattaccagttaaataatgcaagttataacatagcagatgtgcgtggaaggccttacacgttctgaatcttgctagctaggttaacacattcatacaaccctaacaatgatactagtttttttatctaaattaattactccctcagtttcatattacgagtcatttgactttttttctagtcaaatttctttaagtttgactaaatttataaaaaatagtaatactttcaacacaaaacaaacatattatcaaaatatattcaatgtttgatttaatgaaactaatttgataatttagatattgctaaattttatataaagttggtcagattaacaaaatttgactcttaaaagggtcaaacaacttataatttgaaaccaagggagtactttcttttttaacaaaaatgaccctcacagaataacaaagaaatatgcatttacccttgtaaattttacactaccatctatttaagcgaaaaatcaaatcaatctacaccattaaatcatttatatcagtatattatacagtaaaagttctcaaaagttaacattctcatgaagcctactaccatctttcttctatacctacacagggtatataactgtctcttgctttatgaataggagtaaatgttgaagaaaggatgtgcctggctaggggtggcaatttcccccgtgagggcggggacgggtgctggtttcaatccgcggggagtcggggtcggggccccgataatgggcgggggcgggggaggacagtcacccgctggtgacctgcggagcccaaaggatgtatattcgactattaatcctagtatgtcataagcccaaaaggccaattagcctatcatatataaatccaaaccctaatttccccaccccaccctatccccaatttctcacccacctagcgacatctccatcggcgggcgacggcgcaagcgaccaactactggttaaataatgcaagttataacatagcagatgtgcgtggaaggccctacacattctgaatcttgctagttaggctaacacattcatacaaccctaacaataataccaatttttatctaaattaattactcccttagtttcatattacgagtcatttgacttttttcctactcaaatttctttaagtttgactaaatttataaaaaaaatagtaatactttcaacgcaaaacaaacatattatcaaaatatattcaatgtttgatttaatgaaactaatttgataaattagatattgctaaattttctataaaattggtcagacttaacaaaatttgactcttaaaagagtctgtcggagggtgcacgcctcaagcgagggactgtgaggcccccccgttttagttcggccagaggcagcgggtgagaatcgaggattcggtggaacggtgtgatgtagagggggtcgggccccttggaaacgatgagaccaaaggggtttatacaggttcggaccgctgaaaagcgtaataccctactcctgtgcttggttgatcgactatggaatacatgcacttgaattggtgagacccaagcatgagttagccaaagaacccatctctccctctcaccaagcctggacctccttttatatttcaaggggctgccacatgagcctagattaaatgcatgtcttggtgcttgacttggaagcca

SEQ ID NO: 72453 - DNA, 5142 bp, Oryza sativa
attcaccatttaatgggtgaagacttctgggttcccatctacaccgggaaacaagaaacctgctttgaccagagcggatgaaccgtctccggccgggttagcctctcatcatcatgatgtgacagggcatggcaggcggcatgccgcctgacgtatgaccagtgcgcaggcgcactacctcggtcccatcaatcattcgaccggtcacagaccgatcaggcgcacagcacgtcgcattaaatgcggcgtggcacgcccgctcagggggccttaaatgcggttaggtgggtgttgggaccgttcacctaactccgcacacatggcgtcatgcaaagggggtcggggcagcccgacccgccgcgctaccgtgggcccgacccccttgggggagtgccatgtggtactgggggcagcctccttcctctagtctcgataccctcaggcccatatcaccgatagagtcaaacgacttataatatgaaacaaaggcagtactttctttttcaacaaaaatgacccacgcagaataacaaagaaaaatgcatttacccttgaaattttacactaccatctatttaagcgaaaataaaatcaatctacattagatcgtttatatcaatatattatacagtaaaagttctcaaaagttaacattctcgtgagagcaattttacggtccttgaggaggtaccatgaggtaccaaaaatttagtgtaaaatttggtaccttatagtatctaggtaccaaatttataatagaaaaaatggtacctcctcacactactacaaaaatacccattagtgccgattcttaaggcctaataggtgtcggttccggacccgacaccttttaaaattataggtgccggttatacaccaagaaccgacacctatatttattataggtaccggttgtacactagaaccgacacctatattgattataggtgccggttgtactcctataataggtgtcggttttttataagaaccagcaccaataattctaaaagccaaaaaaaaaatattgtgaaatacatcatcctgaaacacagaaatcacaaaaatgacacaatattatattcgtagattcacatatgcattcacacaaatatggacattcacatatatgcattcgcagattcacatatgcatccacacaaatcacaaaatattacattcacatatgcacatccacatcctcgacatccacatcatccacaaaaatacactatggaacaaaaatgacacaataatattcacatcgtccacgaaaatcacagaatattacattcacatcttgcacatccacatcattcacatttccaagaagactcattttaaaatcccacaacaattcatatcagtaggtatgttattgctaaaaattgaaaagagaaggataaacacgtggcaaaagtgaaggataaacacgtgacaatagcaaagtaaatgcagagttagaaactgtagcattcagtacctagtgttgtactaactagataataccccgcgcgttgctgcggggaataataaataaatttcaaagatgcaccaagagcatagtagcacatgaggaggaaagaaaaaaaaattaatcctaagtgattgacttcgtaaagccttcatattatggaatggagggagtaaaaattatgtgatgagctatctccactttggtagccgtggttaaaaatgcaacagaattgcaggtgaaatacatagttgctgaccggatagatctagtattggaacaataaaattaaagtctattacctcgttgctgaagaatgaaaaatatacaccatcaatagaattatgcagaactatatgtttaatgtccatatgaacctttctaaagaaaatctatacgaactgagactggaaggaaaatatataggtggtgtactggaactgatatcctcattgacttggtagccttgtattctgcataaagtatttcgtagtacagctctccctcactgatccatttagctcggttttagtacctcagtagttaatcttgcaatagaatgctaataagttcttgaataagttgctgaaatatcatatttttattgcggtaagaaatgtacatttagccacaagtaaaaattattatttatatgttgtcatatgatacgccaccaggaatgtgcagttgaggcatgtagcaaatctggtcgatccatgacaaccatacaattacaaaattgataaccatcactaaaaagactctcattttatatttaaacatctacatacatagtccaattatcacggttagctggggaatcataactaaactgttaaacgatcatagagaatagtagaacaaattcctgcttagctatcggagttgggaaaaggattacctctaaaatatataattaagttctcatccttcgttaactcctttctgtgttcgtagctttcagaaaacttccgaaataccaatattactaagctgattcagagtcacaaaaagagtctatatccagatcagttgcatcagcaccttatatataccgagatatagcttcaccagctaaagatcataattgaataccaattaaaaaaaacttcatcggcttagcatgcccatacattcttagatctgattgggtgacaaatcaaccaatggatgtatatgatattgttttccatacccttcaaccgcttaagagacaaatcaagagtaaaaatcaactaagtcagtaatcatgggcctaaaacctgggaaacaaaagaggatgggaaactacagcaacaaaaaaaatgtgttagacagtcaaactgggtaaataatgctactatatcctaaatatgaaccatagtacaaaattgaattaaatattgataggagcaatcgaaatggtgtgcatgtaaaagtgaggttctattttgatgaacaaaatccgattgagcaaacaaaaggaaaggggaaattggtgtgtgatcacctgtgttagatcattggagtgattggagagataatagtgtgagatgcatatgaatcaagccagcaaaaatccaggaacaggagcagactgccagctccaattgcttggtagatcgatggatacgcaagagggataaatttgatatagtggcagaactaaaagagggataggaggagaagaaaaggcaagccattaattgatggatgtacttgatggcagtcgtcggcagtttcagttcctcgcggcaccacgactaggggtgaaatcgggtcgggttcggtcggatctcactcttcccatatcctaacccacattttataatcggaatcggcttggatacggatagtatcgaatacggatacaagcacggataatatcaggcacaaatatgagacgaatacgtacctagacggatacgaccactatcggttatgaatatcttttcggatatcacgtcaaagcaacgatcatctatactatatagacaatagctatatattcaaccatccccgtatatccataatgtgactatattattagggtttaagatatacgagcaatacgtcaaggaacaatcgatttttaactggaaaaattgaaagtttggttgaaattaaaactatgcgatggaaaagttagaagtttgtgtatgtagtaaagttttatacgatagaaaaattggaagtttaaagaaaaagtttggaactaaactcggcctgacttgtgatgagctgctgacttcctgttcctgaagagatgaggatcggctggcagaaaaggcatgtagcggcggtggccacggctcaacggatgcagcaggtggcggtgcgacgggtgctgcaccgcagcaccggtggcgctcgtagtctcggcgtcattgcttagtgggattagtgaacactgaacagtaattagtatttttagttgttgggttgttaagcatggtttactggttgatggtggtcattgtactagtaggccttttggccactagtgctttattgggctaggcatgttatccgggtattatccggatatttaaccgggtaatacccgtatttttaccggataatctgtatccgtcggataccgtcctcccgaacccgatctcatatccgatagaaaatacccgtattcgaacccgctacccgtagaaacttccgggtacccgaaatttttacccgaaattgtcccgaaataatacggctgggcgggcgggcgggaaatacccgccccgttttcacccctactcagcagcacaacgtgccgtccacccacaccgcatcctctccctctcctgctgcccgcaccgtcctcctccgccccccgtcgcatcgcatcccagcgagcgtgcttacgcctgcgccccgtggcctcccgcgccgggcgatcccgcttgcagtgccgcaggtgccctcctgccccctggtcgccatcgcatgcctcctctgcttccagtggaactttctctcccgcgtcgcttcttctcccgtgcctgcttgcctcttcgagtctgctgaggggacagggatgcgatgcagtgcagatggttgatcgttcgattcaaatccaacggccatgagaaaatgaggtgacgtgacagcatcaggaagcagagaattcctagtagtggggatgatttgtataggtatataggattacataggctaaatgtagagtagaactaaatttttgttgttaattaataggttaaggttaaggtgtcctcaggcctcatggacacaccagaggaccaataacatggtgaccaataacacttcaggacacaaacatgatacaggacacttcagctcagattctattaacaagaaagtcaccaacaattcttccattatgaggacaacaattccagcaactaaccaacccaagacacacatacccaagatttcctctaaccactgtgtaactgtccctagatctctgcaaccttgattagagtgtgtctccatgataattatagtgtgattttatagttttctcaggtcgaactgcatgcacttgattaataggtgcttatggcttgtttttttgaaaagtctacatgaaaaatatcataactaatgtacagtacttagctgaaacatttacactatttagccaatttttttgtgattgaacttatttagtagtacaaaattagtcacaggtagaagagact

SEQ ID NO: 72454 - DNA, 8363 bp, Oryza sativa
tgatggcgacgaccacaattgtgaggagcgggcgggcggataaggctgggggcgtagtgaaatacggagtatatactagccacataggtgtcggtttgtgtggtagaaccgatacctacagagataaaaggtgccggctttttattagaaaaccggcacctattcccctcgccggcctatatgatgcaaacacataggtgtcggttcgtttaaataaccgccacctttcgtataggtgccggtttttgtccacggccgccacctatgcaatttttggaccgttggcgggagtatttttagtgccggtttttgataaaaaccggtaccaatgaccttcccaacaaaaaccgacacctattaattgttataagtgccggttttttgctacattgacaggaaatgacttataggtgtcggtttttggctaaccggcacctttgtgaccgacacttatgggtgtttttttagtagtgtcaaggaccataaatttactcttctcgtgaagcctagctaccatctttctctgtacctacacagggtatataactgtctcttgctttctgctttctgaataggagcaaatgttgaagagaggatgtgcctgccactgcactgcctataatcaacgcccggagctggcttaggtaagtagtatatttgaggccatacaattacaccgacagacaacgatcatttgactgaaagacagcctgaacattcatgtcatgtatgctaagtgaaaacctttgggttttttttttcaaaaaaagaaaaatctgtcagtagagaaacaggcgcagtagtctgggcggaagggcttgtgggcttcgtcgagaccacggaatggaggaggggacaagcgcaatggtacagcatgaacaggaactaaccatgaacaccaggtgattgatttattagtaatactagcttgtatagtgtgtacattaacactagtgtatactccctccgtcctaaaataaataaaataatttgtctcttaaatacccttcacctatccattcaccaatacaacttttgtattaatcaggggcaatttggtcctttaacttcctccttaactttacattgggaagctagggtaagagggagtaaggcacaggggttgtcaaggaacaaggtctcattgattgggtgcagtgtatgtgttctagctagctagttaactgcatagggtgatttgtttgttgtaattgtattcgagaattgtattgttgtaaaactgaaatctggctgagcatgtcctagtgaattcaatgttgttcaggaacttaatgaaactaaatatatattgtaattttatagaattaatcgatcgtagttgacctcgagatctacgtaacatgttttacaagtaaaactgattcttatactctacacttaaaagctccaggatcgatcaatcacacagttaataatggagatcgagattattgattagtgcgtgaatatttctctaggaccatgcaagtaaggaagcatcgaagcagtagttgacgcgaagttttgaaaattactcctccataagtcccattagatatatatgtgtgtgcctgactgactatgtaaaggcaacatcacgtagatgaaaaggggacagagctagagagacgggagctagcccactgtaattcgatcgtagacgatggatttgtcaagcggcgtgaaatggtgggaggagtggcagctgcgcattcttgtattgggcagcctcggcgtacagtactttcttgtaatttttggcggcatgcgcaagttctcccgtattccgcactgctataggtttttcatctggctctcgtacctcgctagcgacgccttggccatatatgcgcttgccactctcttcaaccgcagaaacaaactgcagcctgacaacaacgacaatagcagccgcgacctagaggtggtgtgggcacctattcttctgatgcatcttggaggccaagtgttcatcaccgcctacaatatcgaagacaatgagttgtggaggcgccacatcctaaccgcactatctcaggtatgtgtgctcaatgctacttatatatatatatatatatatatatatatatatatatatatatatatatatatatatattcccctatgtatatatacacacacacgcgcatcatctaattctttcttgattggattatgtataatgctgaaatcttgaattattatgtgctagccatacctctgtcttaaaatacgcatgtaagtattttcatatgtatatgtatgtaagtatttccatcgtacgtaataactattttcatgcgtatacgtatgtaaatatttccggtaaatggattctgttggacacagaaagcatatgctttttaaatagatctaatctgacggtgtaaaataatggttctatcaatttaaatgaaaatcgatggtgggattgtagtatgccacatggcggcctaggaacgctcgtagaaacgccacgtggcggtttcggagcgtttgtagaaagtttaatagacttttagtatataataactaggaaggtatcccgcgcattcgcgcgggcatgtgtcctatgctaagtttgagatatttgtaagagcgaaatgttacatctaccacaatttctccataaattgttttcatcggcattaattgcttttataattttctaacctattagttttatattgtatcatatttaaataatatctataagtaattttttataatcttctatatcatttgaaattaaggtagacttattttttaaaaacatgtcaacgaattgaaagtaaaaataagtaaaataaggcatttttgaaattgcatatctattatcatagttcattaaaggattaattaggtggaacatgaagatctactaaatgtttaggtttatatagtctaatatgattgatgtagtttgagaggcaatcatatatgaacatttcatgtacatttcatgtagggtgggtgagaggttccatgcagcctaacatgaatacgataacgacgaaatataattgcgcagtaatattttgaaaatatcatgtaccatgaatacattcttttttatgtaagatagatctaacgattataactaatagtttaccagtttaaaaggcataggagtattgcagaaatgtagcttaaaaattatggctgttttaatatccaatgttattgcgaagtaagcgcagctcaactggattgttttaatatccaatgttattgcgaagtaagcgcaactcaactggttaggtttctcgtggtagagcttgcccatctgggttcaagttctagatttgacatgggtgttggtatttacgtctaattattcttttagtggtaggtgacgtacccatcgacagcgaagcgccgtggtaacttcttcaatctcaaaatgtaccggctctgtattttaagatgctaaaggggtagggtgcgtgcacgctgtgtttctaaaagatttccaatattattgattgtttctgttttagttttatagctaagagagagggaagggacactaaaatctatttgattttttcttaaaaatgtatggattagtgaacagtagctagtccgtataatatatatgatccaaagtaataattttttaataatatagttaacttggttctttaattaaattttatagtaaataatctaatttatctcctacttagggtacactcgatctcattgattgagcttaagtagggcacacaaaacgatataggccattaacgtatgattaattaagtattaaatattacaaacatgaaaatagtttttttaaaaaaatgtatagaatatatttgcacaacacgcacaatttagtagtttggagaacatgctcaagataaatgagggagccaatctgataaacactttacaactcaaccttaaatttgttacttatgtacttaaaaaatatgtataaatcaaaagtgtagatcgagtcattaacggctaaaattcaaaccgtgtttagcgagaaaaacatgcaacttatttttagacaatacattttttatttgtgtttttgacaatatgtcctgaatattttaattactcattatttcatcttgaactatcaatatataggcccattgatgcaaataaatgctatctatactcaacaataatagtgtgaaatgatacgtgtatttgatattttatattatattatagatctagttttggctgtgcatgtttgttaagtgatatatattttttatactaccaccttcactaaatatatgacattggtcatcaatatataaaaaacaataaaaaaatacaaaggaagtataatagaaaatccagattaaagagcgttgttttctttcggtagtttcactaaatatttaacgttggctgtcataaaaaaatacaaaggaagtgaaaatccaagtttaaaaaaagcgatgtttttttttaaaatttttttccagtagtacgtacgtatacagtattttttttttgctgtatatcatttcttcttttctcggttgtggttgttaattcgtacgtaccaatgccttctcagccttttctagtcaatttttttatggaaagtattactcggtaaatttgaagggatagattactatttataacatatctaatccaattgtgtaaactaatggatccaccaactttttaagaatttggagggatagatttttttttcttttttctcagaaattttaagtttttttctattttattatagcgccttgtggtagcttgagagctttttagagcaccatgtggcggcatgagagcgtttgtaggaaatttaatggacttttagtatataatagaatagataatagatagatagattgatggtaagaaagcggagcaatggatagcgtgaggcgccgccgtggcatggggcgtggcttcttcacggcctcgtaggagtgtttggtacatatgcacagtttgaaaaaaaaacttagaggaggaaggaaagagaatataggtagttgtgttgtaaaatacagaatataggtaggtttccattaaatgattatgttatatatacaactaatctaaatccggtaattaaacatttaatatatatctatcatttattcgaaatatttagatgtgtcaatatatcattctaatactcttctcaactatccaactgatcaaacgtatactaatcatgctgaactgctggtagacaataggcgactcaattagcacggggtgctagacttaatctgtgttttggtggttgtattttgttcacaggagataattccgatccgacttgttggttcgtgacagtctcgccgccgtatattacccattaacaaatgaataacggactttttctttccttttttttcacatctgttgcgcataggaaggacattagccggttttaaggagagagagagagattttaacaaatctaatccatatgtttgcgcataaatcaatggctagatatttcttatattttctctaatttattagagtgccatatggcattatgagagcatttgtagaatgacatgtggcggcttgagaacgtttgtatgaagtttaatggatttttaagtatataatagatagattttttgtgtttaaatgtgccagtgcaattgtgcaagttacgtcatgctgatgtccgttctaatatttgttgtacaccatgtgtggaccgtcaagttcatactgtaatcgtgtcattttaacgtattatcgcttctttgcggtacactctacactacgctaccctatactagttatttagacctagttctttttctcaactctaaactcttcaactttctcattttctgttagcacgtttttcaaacgattaaatggtgtattttttaaaaaaattatatagaagttgtttaaaaatcaaataaataaatttttcaattttataataattaatatttaattaatcatattctaatgaggtttctcgtggtatttccagtatttttgcaagacttgaccaactacttcctttgtcttacaaatattattattaacgcaagatgctcatccatctaatgggaaaaattaagctttttaattattacttacctagatctcgaggttgagaacatgatatgagaaatctactcccaagttgtcggtcagttgtacactgcactgttttgtatattagagacaggtgccctaattatgctctccaagaattgaccaacaatttccttaactggtcttatttattacacagtaaagtttaattattttattgtcaactccggaccccttttttctaagactaaactccagactttttttttttactaattcaccgggggaagagcttccgcatccgaattttcattgcaacaaaggggaggaaaactgtccattacaataagtttagagtttgaaggtgggaagagtaaatttgtttccaaacagaaattacatgtcgatcttcaatcttcagattttctgccctgagggccacctcgctaacacacctttgaaggcaggaaacaatggaaggcgaacaacccctgaaaactacgtcatgacgatgatttcaaagcgcccagaaacaaagtagttagaagacctgaaaatgttttaccggcagattgtgcgggttttagttggtgtagcatttgcacttgctgaatgggtggatgaattgcaattgcccgccagaagcttattgcaaaagggcaagtaaaacacaagtgattcgccgtctcagccccatgattacagatgatgcatgccgccgattgaacaatttttttctttagcagattttgttttgtggacagtctattcctgacaagcagccatgcaaacagctttacctttagaggcgccctgcattcccatatccagaaaactccaaacttaaacaacacctaaatgtcagatcggtgcaaagttaactatacccctgttgaggtgcaaagtcagcacctactttttgaaacacagaataaagctcgggaaactgaataatataccgccaatccgtgtaacctgaacaactcctgctttgcctctctattcaagtaagtacgtcgatcaagttcatcaaccaatatgttacattaagttcatcacaatttaaccaacatgttacatgcatctggtgcctctgctgttgttgcgtactccgtttgtgttactacaggagtaaacatgttgcgcccaacccaacctataaagtggtatattgtccattttctcatctctacagcctgaacatttccacagacctttttttttcttttgtagccgcgtaacacatgctttctctgaatcttgggttttctttcagactagatatagctgagtaaacatgttacgccgagacgcgaattaacgttggaggcggcgtagaggtatgtgttcgcagccgcgcgcgttttgtcgagtcatcgccggagctggggccgaatcatccatggggaggcggcccgagtccgagatagacctcatcggagcacgtgaaagaagataaatccattcttactactataaagttatagtatgatccactaactacaattaagatactaaatctcaaacattaatgttccacattatcatcaatttttagccgttggatcattggattagattgcttcttaggtgttggatgaataaaacgcagtcaccacatgtggcccattgatcctaggccaatttaatagtgaaggaattacggtttcttctttgatcggtgaggtcttctcctatagtaacaatgctggtggtgtatggttttctccatcgatggcagtcgatgcccttgtgaaaaatctaatatgttgtattctgatattttttgatatattacatcgaccctctcatgaggtatatataggagtacataggagatagagacttgaaatacaatacatgtaagagtagatttatctctaggattctatctctagaactctattcttatctctaggattctatctctagaatatattttatctctataatttatttttgactcttatctctaactaatatattatacttctaacaaccctaacaggctagcacggcctacgtgtggtacggtgctggcctggccaaaaaacaacatgcagtactttattgccaacggacgttagccattcatctcgacgctgagtttcggacaccaccaccttcaaggacttcttttccccataatttatagtgctgatgtatgcttctttttaaactgaccgattaattaaacgtaataaattaaaaagagaagcatgtgcttccaatagctacatatttgatgagaacggcgtgtagattggatgaaatatagctaaagaccatacaagtcagatactcccttcgtttca

SEQ ID NO: 72455 - DNA, 3630 bp, Oryza sativa
cttagttcgaaattggactcctagagctcagcaatccgatcccttagatcgtgttcgttcttcttggcaagttctctggcctcgtgtagttgactcctggtggcttcgagagttccgagatgagggactaacttctctaaggttgccgttttggcttcgttcctgagatgaatcctctgcaagacagtttaattagcgcatgaattaaatggcaaacaagatggttgagatcaagtaccagagaacttacatttacaatgcgagtcgcttggttgagtgcctttttcggtaggcagacctcttcgtcttctttttgccggtttattacaattccttgaggctgcaagttatcatcccaccacttgaccagaatgggagggcacgaatcttcggctgcttgtatacgggggatttcttcttcatcaccaatcattggtcctaatgtattcgctgacaaaggttagacaattgatcagagtttatttgggtcaacatggtttcagacaaaagtgttttcccgtaatgatttctgaatgagaacgagtggattcggatgcccttaaaggagatccagatctctggttattgctggcgttttgtccacgagggttgtctgcttgggtttcgacttctggaatctcttggtttggccttgcgtccgactggtttccagtcgggggctcctgattaactccggcttcggcttcggccaactgggtttcagttggaggtggatcaccggattctacatgatcggttgccggctgattgtcactcgggtgatccccaacagttggcccggtttctttggaagaacttgtgtccatgttagtcgggtcagagtctttcccagacgggtctatatcagatggtttcctacaaatttgattatcagtattattgccgcaatgggtgtgcatcaatacaagagggatcgttatatgagttgcacctggaagacttcctgatctttggcgcagggcgactggatgttttcttccttggagtagcctgttttggtagtttcttggtcgtctctcggtcttcaggcctcctggtggtatcatcggcttcgtcgtcgcttagaaccagcttcctctttcgagaatctgactggccgactggatcagaagcacttggttgagtttcagaccgaattcttggtcctccgctcccttgcccagtttggtggcggggagatcggcgttgagcgattgggggatccgacttcatcaaagcaaattcctgggtgtaatatccttcattgttaactgattcaacaagaaagcaagattatattttgagaaaggtcgaagtgtatgaatgcgtaccggtggaggggggttgaatgcattgaacggtacaactggcagcaagtgtgagtagctgacaacgatggcatttgaaaagatcttatacatcctttccttcatgaccttgaagtcaagagaatctgggtcttcacggtttgggtcatgcttgccgtcaaattcgaaggctgtacgagatctttctttgattggagctaaccgacacttgataaagtgccgggtgatctattctccttgaaggccctgttctttcagctttatcatcctctccatcagttctactgcttgtgcggcttcatctcccattggcagtgagttccaagtatcccgataaactggaggaagacaggagtactcgggaaggacaggctcggggttttgaacataaaaccagtttgcgtgccagcctttgtttgaggtcttgaagggcatggagaaatacttttggcttagcgttcctctgagttggaaaccagcgcccccaacaacgcatggtttgctcttgttcggctggggcttgagaaagaaaatgcggcggaacaaagcaaaatgaggcctaatgccctgaaaagctttgcatacatgaataaagttggcgatgtgaactatgtagtctgggttcagatgatgcaggctgattccatagaaattcagaattccccgaaaaaatcttgaggttggaagggagaaaccgccatagaagaagtgagcaaataccacgatttcatgcgtatcgggagtcgggaatgcttcgccgaataccggtcgccacccaatgatctccttcgctggaagaacgccgtgcgccaccatctccttcagattatcttccgtcacatcggagggcgcccactgactctcgaagctttctctttcttccgccatgaatgtgaactggatggtttgatttggttcgagataaggctggaaagagatgggggaatcggtgcggtggacgcgcggagaagtttcgtgggatttttgagaatggattggggcggattggtgaaccctagctccgtcggcgcagtcttgtactgtagcgaggaatggggaaatggcgagagtctcggcggggaagacgaagcgtcgcttagacttcggtgttttgttagagtatcgggagtgctaatgggcctgggcctgtacagtacttcagcccaattttatttccagcgtggcccgttgtgatccttagggacttaggcactttttgctttggcaatttgtgctcacaatgttgtggcccaatgctgattaaatcatttttaatgcggcttgctaattctttagaattaacacgatgcaaacaaaaggtgtctgacagaaaggtgttataccgtttttgtaagctttattaggctgcaaaagctgtttgggttgatttgagatgactggtttattcatagtcattcttttagcatgttatatgcttattttagttatggtaagggtcacagcctaggctattagactcattaattaccatgattttttatcatgtttggtgaatcattttaagagtttcttactcggattcctatcaaatatgtctatttttggaccttttgagtgttcatcactcagcccttcttgtattttctgtccttgatatgttcaagttgagaagtagtcggctgggtatcttactaagtaccatgcgtgcttcgctgtaaaaccactcggttcttgactatatgtttagtttttcaactaatcacatagtcgggggctacacttaattaggtgcatctactcgatacaccatgttttattttcgcccttcacagtcttttagcactcggcaagccggagcaagttgaattgaagcactcggattattattttttgtttcgagaagactgttttggtcgactgcgaaggtctcgggggctactgtggagattatggttaccccatatctacatggcagttatattccagctggatatacagtaccaaatatagatagaatatctttatgaggactcgggttagattctaaacttgtatatcaagaaagtacctgggatcctagtcggttacgattgtattttatctgtaatcccatattccgttaggatatggatattacggattccttcccctatataaggagggtccgtgtgcctcttggggcacgattcttttttttcccaatcatcaatcaataacccactcggcggaatcatccccggacaggagtagggtattacttcttgaataagaaggcctgaacgtgtataaaattccttgtctccaaacccatccactttcctagctcgatagccaccccttt

SEQ ID NO: 72456 - DNA, 2974 bp, Oryza sativa
caattcatgcacaaatgcaaatgaaagagaatactaaacttagaggtagtgcttattactaaccatttccacaagtcttggtgaatatttgtacgtgggtgcattatggacgaaaatcacccgccatacgacaaaatacatatctagacaatcagacgtgagtacacggattggaggccctacatgtcaatcataatcgcctacaattgagcccatctgaggtacaacttgtaggggggccactaggcagcctcccagccaaaggattggctgggaggtgggccaatggggttggccgaacccaaggtcttttgaaccacctttgcctctccttgccatctgccgacgcgtggagcaagatcttgaagccccaaaggtggttatgcttgattaccggcagttaccgaccttccaaccgacttaaggaggctataaaagaaggagctcactacactctaaaattacacagcaagtggagtacaactcacttacacatttaggctgagttcgggagtgagcgttgggaaccctcactcccaacatgcaaaacagagcggtgattagtgcataatttattaagtattatgtaaaataaacttgaaaaatggattaatatgatttttaaaacaactttcctatatattttttttttcaaaatgcacaccgtttagtagtttgggaaacgtgcacgccgaaaacgagaaaggtgagttgggaaaagtaggggaagaacacagtcaaagggtgtgttcgggaggaggggttgggaatccctcctccccagcacggaaaatgaagcacgtattattgcatgattaattaagtattagctattttttaaaaaaaaagattaacatgattttttaaaacaacttttatatagaaaaattttgcaaaaacaacaccgtttagcagtttgaaaagcgtgcatacgtgccccaaatgtcggacttctctccgaaggagtgctagagatgtcgacattcttccaaggagttctagaggagtgccgaagatgtcagctctctgtctctctatctctttgatcttgtacctcgttggatgcttcttttacataagtatttgtgatctcatttggtattaacttttcttatttaagtaagatatattctcatcattccaggttcatcgctgtacttagagtaccttaatcttatataagtgtgacatcgagattggggtaataatcaatagcgtagacatggtgttaaggctagagtttacgtttgtttgttgtgtgctccacgggttgtagaagtagatggcaggtggtaacagccatatccgtcctttgtaattctccatgttcggtacgtcatcgagctgtaggccggagtctccttggaagatcacgagtaagctggtgttcgaaacaattgatagagttttaacttaacttaattaacccataggaatccgctctttcctaagcatcccaattagttgttgtccttggttgaatcttgttcttagattacacgcacatgttccctgtgatttgatacccttggaatactctaaagtgaagtgctacttcggtatccatgttcttgcggatttatttatgactgtagcaaataccaacagcgggccactattatgttgtcgctagtcatgcattgtgcacacattattaatagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttatttttcttctcctctctctttctcatgcatatacatttagtgcatttattttaatgtgtgtgaagagttagctcttggataccatcagctcgccattgttgaagcccttaccactgcctaggattggggacttggggtgtgaggcccagagagaggttaggagatgggaatcggttgaatggttgaaacagaccagaccgggtggtcttcacgggtggcagggaaatcttgtcttttcaaaacatttctcttcttgtataggctaaaaataataaaataattgacagagcatccttcagcagattaccatattttttttaggatgtactcagaccgttctatatttttgttatgtctacatgcaaaaaccacaaattttcaatgtgcggtaccaaattttgccaaacaaccaccctggaatgataattaacaagtatgaagtttgttacaatcgtctcaaacttatttgttataaagttattgtcaaagtatgaccattaataccatggaaaatgattaaaaaggacaattatcgttatattggagggaatataaatttgtttgtgcagttcattgatacaaatatgaaaaacaaaaattaaaatgcccagtggatagacctcatgaatgattttgctatatggtttatatatggaaagtggcgaataaatatcatggctagtgtagtgggcaccttatccaaacaatgcataaaaagatagcttgaacttgcagctaaattgttcctttattccacttctttttttttattctcccaacagtggactacgcatatctgggccacgttgattttttttttccgaaaatggccacgttgattcggtggtccaatttaatgcacttgcgagcaactaattccgttccataaaaataaaccgatataaaaataaatctattatgggatatgactgtcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactgactgtaatatgtaatcacatgataaaagtccattgaacatcctacaaacacttctagg

SEQ ID NO: 72457 - DNA, 2191 bp, Oryza sativa
caacaaagtctggcaagttgagacattcagtactacgaatctggacaagctcctagtctagatccgcagcactcgaatgtgtcacatctaactgaaatcttttatattttggtacggtggtagtagtattttgattaactctttcttataaacaaatcaatcatctatcaggtttcatccgcatccggtcttaaaaaaaacatgctttagccgaagctatttgtctaagatctacttccttcgactcgtattaagttaatatagtacgagatgtgacgttgcatattaccccaaatctagacaggatatgtcagatctcgtactagattaacttaatatggaatggaggaagtagcaagtgtggctataaagtttataaaaacccttaaaacttccatcaatttataatgccaatagaattaataatatttgaagcatttaggtagcaatatatatttaggtttccctttacaaactttcatttgatggtagtaggaaaatgaattttggtcacaccaaaattttggagacgtggcaagggttttttttttttttgtcacaccatggtgaatggggtggcactttgttgcacacgctgacaactcaccaacatatctactagctttttttttgttctaaatgtttaaattttaattttaccaaaatgcctcattttacaaaattgaatttgtccagagccagaggtacgcccatgtgagcagtcatttgtgtcctgctcagccaggctgtgaatggaccgagctggaggccctgccattatctttgacgtggttgaccctcattggttgcagcaattatggagtcatgatgcggtagtgattgagatggagaggaacaggaacgcagcaaaagctgatatctcgataaacgggagcatcacagctctccatgtactacgcattcaagactacagtacgggatggttggagtagttccgcatgggtctttctttttttttcccttcattttgtttaaaccgtctagagcaagtataatagtaagtacaatagtagagtattagccagctataaacatatttaaatgagataaaagatgagagagaagagtagcaggctacagatcggtagccagctgcagtacagactccaaaatgcaatatgtgtatgacatgtgagaccatatattaatagtatagtaagcaactatggtatgaattgtctattagattagctataaatgaattagagctagtagtgggctatactattaaacttgctcttatgtgatgatgcatgatgcacttgcagagttcaactaaagttgaacgagaaagaaaaatgctaatagcaacataaacataaaacagatggagaaaatagacaaaacaaaaattaagtttacattttatatggcgtatgaagcacaggaataaactgcctcaaaaacttagtacatgaatagacaaacaaagaagagtatggagaagatatccttacccctgcattccaaatgacagtataacatttatactacattcgttcctaattaagtactgcacttccataagtactgcacttccactattttaaaggcaaattaccggagcagaaaaataacttaaatgccatttattaaatgagcgatggttggaacggcggggatgattggtactaagatagaaagaaattaaaatgatgagtggttggattaaaaaaaattagaaatatagtactagtacacttgtgagtaaattgtaatagcggtatataaacttgtcagatgtgtgcaatctagtgcataaacttataaaatatttattttggtgcacgaacttatttggtgcatgcgatcaagaccaaaatcacttgacaaggataatcttgctgattttgttgttgatttgaatgctatgtaaacatgtgtctcagaaaaatatcacatagataaagatctgtttagcaatacatataattaggtatattgattgcataaagaaagttcggtcctgttcactttgatgtcatttttaaccttatcaaattttggtaaagttggcaaaaaaaaagtggctacatttagtttgctacaaaattttggtaactatatagaaaatcctgccaaaattttaataagttgccaaaattttcgcatttttgacattaccaaaatttggtaagattaaaaatagcatcaaagtgaacatgcacga

SEQ ID NO: 72458 - DNA, 2090 bp, Oryza sativa
cggatttattaagcctaattaatttgtcattagcacttgtgggttactgtagaactttatggctaatcatggactaattaggctcaaaagattcgtcttgccatttccatgcaaactgtgtaattagttttttaatcaatatttaatacaccatgcttgtgtccaaagattagatttagtgtttttgagcaaaattttttggaaggccgtagtaacgcatgtaggggtgaaaaaaaagctcgggctcgtgagctcagcttgggcttggctcgagctcaaatgccaaaggagccaagcccatgcctccttttcagctcgttgctgaaatgagccaagcccgagctagctcgtgagtcgctggtttggctcatgagcctaggctatcatgtatttatatggatgattttattttatagtgaagttattatttgtaattatgcaatttataatttataatttgtagaattgaatatataaacttattttagttatacatgtcgacgatttattattgatcatctacaaattatatatgaagagatgcttcaatgggaaggctcgcaagcctgctcgatctggcttgagccaggaaacgagccgagccgagctcatgcttgagcctagtttattgcgagccattgcaagccaagcctcgtttccacccctgcacgcccggcgcctcaggtctccatgctcaacctctcccgatctctttctcttcctattcttttatgttaccaaattaaaagcaagaaaagctataattttagtattaaggtgaccataattttaaatgtacatatctaatttctattctatctaaattgttcctgtatttataattaaattgacaattttagatccaatgttttgctatacataagtaatatgtcattgtggtcttcttaacgtctggtattctcggaggcattcggatgggcgatttctggtgatcttcaatggtgactccggcaccgccgggagggtggaatttctctcccggggatgcaatctgcgatgaagcttggcattgtttccgaccgccggttcatttctcctctaagttcagctcggttcctttccggttagtggtggatctacctcgctcaaattttcgttaaacaacttcttcggtggccttagccctcagggctgtgattggtggttcgcctgctgatctctctgtttcccttctcaaagatcgtctttctctttttttgtctgctccaaacaagtgggtttatggatttatcgtttgagatcttatacttgcaatgattttgttctgcgcttctttctttggagaaatggtggaccaaattggtagtgggaacttgatgtttagagtcgtgaacaagagaaagaatgggtttttgtggctcctaagaaacgtgtttctgattctttgaggcaacctggtcgttcttatgctcaagctactcagcagcgggttattcctatgaagagtgtttttgatagattaaaggagtccttgaaggtgactggcggtgatactccggcaatcactgttccggtgaccaaagttccggagactaagctggtggctaatcccaaaattcaaaatgttagaggtaatcgggatcaactttctaagcaagttttaaattctaatttaatttgtgggcgttgctcagagaagggtcattctttgtctgtttgtgttgggccctttcggtgccgaatttgtaagagttcgggtcatgctgcccgtttctgtagctcaaagcaatctccctctgagggtaaattgccaaagtctgtttctaccccccgcattaatgcagttgctacggtcctaaactcccggggtaattgcaatcttgtttggagacctaaaaagcttgcgccggttatctcgtagccttctcgccttctccaatctactgttgagaatattgttcaagcctccccagcccaaagttccatgccaatggcagacctcaaccctaaccctcatcgtttccgccatcaaggtcacattgtgcatttgggaggaaatttgcgtgtccctagagttgatctcaccatccctcaaaggcctgttcgagttttgtgttgctttggtggag

SEQ ID NO: 72459 - DNA, 2467 bp, Oryza sativa
tgaacaaggaaattatctgaagtagagtcggctaatggatacaaatgtattgaccccctccggaccaacttcagatcaatatacagttagataagccccttttgtttttttaattctgtgatgtggacagtatgaaattatgtaattatcttttgacggactcaaaatcttatattctgaatgtatgcatcttgcagctattaccaagatgactaaaagtataaggggcaagaaatgttcatctcgtcagctcagatcacataatcggaggctcttcagccaatgcaatttcaagagagttgctaacaaggaattggcagcaacagagaaatgtgcgtggaaagattcaatctgtccagtttgcttggaatgcccacataatgctgtccttctactttgttcgtctcatgataaaggttgtcgtccatatatatgtgcaaccaattaccaccattcaaactgtcttgatcaactcatagattcgcggagaagctcaaaagattgtgaggacctagactccatagagcttacatgccccctttgccgtggtgaggttaagggatatacattggttgaacctgctcgggaacagttgaaccaaaacaagaggagctgtatgcaagatggttgctcatacatgggtagttatggagagctctgcaagcatgtaagaaagaagcatccttcagtgaagcctcattctgtggaccctgtacatacttacagatggaggcgacttttattccggagttcactgcaagatatgatctgtgcaacgagttcaccaatggtgcggagggttttgtatgttatgttgcagtttgaggagttgatggcatctgtttggcacgaaggtcctcatggagctatgcaaatcaatgaaatgaacttggctgatccatgatctcaacctcactgaaatgtgagaatatcttatgctgttctcgcaatggggtcagtgatttgagccatgctgatccatcatgtgtgacctgacacagaaagatatagcttttttagttttctgttcttgagggaatatttgtcaccatcttcagaagaaacagatcctatcctatgctgccatgaattcaagaaacctggtcaaattgtgggtggaatgtggaatggcgttgaaggcttttgttgatactatctcattgtagtcccccctttgtgtcgtgtgatgaattgatcctgtgcatcccttttgcactgtattgacattacattctattcggaaatgcagagttcacttgctcctgtatgttttattgttcctacctcctcagaaggtacccatatatgtttgttgtttatgtcgcgtgacagattggtgtatactgaagatgaaatttgcttaaaggcctcaccgccaagctacgcgtggcaaataattattcgggacagataattattgtactggtctctccgatcggtttgtcgagatggtttagattagcacgaagaatatgctttctgatctgaaatagttccatcagatggtcgctgtgcagttctacaggcagtcaagcaacacttgcacttcgaatttcgacgcaccagttcacgtaaatggcaaggcctttagagtttagaggaactttggaggaaatgaatcgtttcatacgaaaatcctgtaaaactcctgcgttccaagaggagacctaaacttcgttgatcctcccaacgttcggatcactatcagaatcgtcctgtcgctgtgcagtgtggcgccaatggcaattgcaagcttggagttataagtcaggactaacataacttccagtcaatatgatgaaagttcaggggatcaaaccgtaagacgagtgaaatgacggttcaactaatcaaaggagtgaaactaagctaaagaatatgagctcgagcaaaaacgcaaacactagtcatgcactcagacacgtcatgatctgaagaatatttagcgcaaacgaagttccgcgtgcaaaggagggattttaaaagaaacatacggttcaaaatcaattcagatattcactggtacgcacatgcaacaccaatgatatagccttgtagcattaaggatgatccagctaggttcatatatatcataatatcaatacctgcacatctgcataagcatgtcaacggctgccggccgcatgtcatactctcactggaaccaaatgggacaacttgacaatcatcagtccacgaaactattggtctgcaccaagtgacaaagtttacagcataaatatcaaaccaaggtttctctccaaggttaacttaaaaatgatagttaaactcagggaggtatatatgctcttcacacaaatcataagtttagatgatgatagagacatcacatttggtaaatcatatctccccctcaaaaccatgtctgaatcatggtagccctataatgtgttgataaagcatacaccaattttttgttatcaagtaaagatagaggatgtaattc

SEQ ID NO: 72460 - DNA, 2940 bp, Oryza sativa
atctatggtacttaccgatgacctccctaagggtgtgttcggcacccccttttcccaaccacccttctcgcttgtttttttccgtgcacgtttttcaaactactaaacggtgcgttttttgcaaaaagttactatacgaaagttgcttaaaaaaatcaaattaatccattttttaaaaaaatagctaatacttaattaatcacgtactaatgaaccgctccgttttccgtgcacactatttgtgttgggatctgggatgccagcctaaggaccggaagaaatgcagggctgggctagataggataacgtgcagcccgttttatgttgggctagtccgctactgtgacatacgtgcggtccaattaattggtccgaaacaaatgtgatccacatacggcccatactaattaggctgtaaagggagtgtggtagttgggccggaacacacctttgctcacgcgcacggcccaccgaagcgccatactagtgaaccaataatgccttgatctgagccgcacagcgcacaagatcggacggctcgcagggacccacgtcgggtggtgtcgcatttctggcctctcctctccggccggcggcgacacccggcggccgcagaacgccggcgagcggaggcaagcagccgcgatcaagacctgaaccgcacgcgcgcctccgtcgttcttggtgagaagttctcctacctgattttctccgagtagttcattcttccgcctctattcgtcgtctagggttttccatcgcccctgctccgccttagcttcttcgcggcctctgctaggaaccctgaatcaggaaatatagggttttcccgtagttgtttttgacggagattcttgcatttgagccaaatcgtcagttggttgcagatgctctccacggcaatggctattttttttgctgcaactgtggttggtaggctcctgggactggaacactgggggaaggggttgctccgaggaaaaagaaaaataataatgtgatttagtcatgtttgatttctatgacgattgccgcaacgaatatctagattcattctcctctcacggataaaaaggctaaaagccatggcaagattgtgtgggtgttggtgtttctgttcttgaattgccaccgaaattgttgttaatttttttcatgtttcaatctccttttccattttctgcttacgacaatgaattcttgactgcatatttactagtgcagtgtagttttctgtcttacttattatcttcctttgctcaggattgtttaattttgtagagacaccagtttgctccacacctgctcgattgaatgcccctgatacaacaacttcttccagatacagggatgtccatctctcactgtgaggataatgattctgacaggatcagcaacctacctgacaagctgctgcaccatgtcatgtcctatctaacagcgcaagaggcagtgcggacatgcgtgctgtcacggaggtggcagaacgtctggtcatctatgatgtttctgcatgctaacgcagccaagtccagcagcatcacaagtttcaagaaatttctcgataatgtgctcctgtaccgcaatcctgttccactgaagggactttgggtttctgccgcctgcgacaactctgatgattcccttgattattccgacatccatcgatgggttcgtcatgttcttaggagcaatgcacgcgaagttggcatattcgttcgttgtggttccaagcttctttctatagatggttatccctttgctttcaactcggtgcacttgtctaagtttgtgcttttcaagtttacagtaaatgactgttttgccaagaagttttcttctggttgcccggttttgaaggatcttgtgttgataagctgtggcatcgatgtcaccatgttttcctcaaccacattgaagagtttcgtcattcacaatgcagaagacattgaacatctgcccaaacaaattgagtatcttgtcatagaaatgccaaacttagttaccctgcatatagaggagattccaagaagaaatattcaccttgtggacttgtcgtcagtgaaagaggccacaatttacttttttgaacactcttttcgaaattccgctgttgactgcaatattctcagtgctctttcaaatgccacaagcttgaagctgatatgtgattctgtctatgatgaagtatgctacctcctttgaacattttctcctatcggtttttatgtgtttttctgatacacctttggacttgtcggcaggtgtcaaaggtattaatgcgtgatcttccaaggtgtaaggcatttgacaacctgaaaaggttgaagcttggtgagtggtttctgagaaatggatgctatccgctactcttcttgcttcggtactcacctcacatagaaaaacttcgcctgcaacttaccaaggcaagatataacacctccccccttccacattgctgtttttggtcacggcttgagtttaatggtttccttttttattcttgttatcagcttggagctgaggagtatgagaagtttccaactgctgcagcagcaatagatcctccatgcaaagaagcagcaagaacgtttcattgtgaaaaacttacagagattgaaatcgtctaccctcagggcgataaaagggtgcacatcattgtgaggatattgattgcgaacattagccctctccctgaaattaaaatcaagccctttccgaaatccggattatcatggtatgtttcttaaaattgcccattcatgcttattgaattagtggcttatgtttggaggcatttgacacacatcatttaaactattctattaggtgatctgtggattttggtgactgaggtgtctatctggctggattagatattctgataccaaggatgatgtttttggaagacttgttcagctatcctttatgttcatagtg

SEQ ID NO: 72461 - DNA, 8654 bp, Oryza sativa
tgctatgcatagagatgccctggtccatagtgggccgtttgtttatgatggagtgcattcggtaacttttgtgaagcatgatcaaggcccaaattggagagcatctcaatgccatagagagggttggttccttttcttggattaccaccttgactttattgattgggaccatctaaaccttgctacggctacatttggccaactttctttttggcttgaaagggatcagatcaaggggagagttctgataagggctaagttaaaggataatgattttgtgcctccaaaaattgtttttgcatgatccggtgggtatgggcggaggaggagaatcatggacagtttccgtgtttttgttggaaggggatttcattaacatggctcctgatgaagatctgccccctgcgggcccccaaccaaatcctaatggtctagatgatgatgatgatcctaatgtgggcaacatttggcagatggggcagcctcctgttggtccaggtgactgggatgatttggtccaacagcagcaagctgcagaggctgaggtagaggatgcttggggctaagactatccaatgggccaagtaatggaggtaaatcctgatggtctgcttgctttggtacctattgtttcagaggatgctagcccttctgttcctgctgttgctatgcctaatagggggaaaaaggttcaggacccagtccaagacccgaagatccaggaattcttagctaacttggataaactgactagaagtgaatatcctagacacccttatttttatccaatgtctggcctgaatgagaagattgacctcttgtgcaaagaaaagggaaccatgcaccaatttcttgcttctagttctgttcctgctgccatagatgtggtcaatccttttactgctcttgttttgcccaaaaagacaatgtttgatttttctcccttagtgggtcaagagacaagtgtttgggctccggattcaacaaagtctgatgttggccccctggaggcctagacccaagctgctatggaagtacttgatgtcatgcccttgtctattcagcctcccttcagcccagtttgtgaagcaccagctcttcctgtgttacctaaggctccaattaagaaaagagatgtcaaaactttgctttataacccttacaggaggcagagtgcaaggttgcagcagaataaggaggaagcagaactgcaagtggatcccagaatggacattggcaagccaaggggtaaatctgcaaagaaattgaaagagcttgcaggcttgcaggtatagcaaaaatctttgatgatagtagcattaaagagtctgattttactaaaagtgcctatgatgatattcattctgattcctttccatctgattgttctatctcattgttgcaaaagatgggagtggacatgtgcggcttaactcctgaggaggaagttgaatccagcatggggagtgagattttgggggggggaaagtgaaagaagaaagaagatgcccaggcctgacatggaggaaaaatgattttagttttcagatgtgttttagtagacctgtacttcccttttaattatcatgtaagggtctgtatttggaacttcccttttaattatcatgtaagggtctgtatttggacaagagcttttcagactttgtcatattttggttcagttgtatgcactataaggttatgttatttcaggctagttgtactagctctggttggtttctctttcaatcctgctttattcatgagtaattatataaatcttggaatgtgctttgctggaatattaggggaaagaatgcagagccaaaattgctctctttgagacagaaaattgaggactgtgagtgccaggttttttttgcattcaggagacaaaaaaaggatcattttgatctctcagatatcaggaagtttgccccaaaacgttttgattcgtttgcttttgcaccctctagtggtgcctcaggggcattttggttgtttagtcttcaagggtttttgtcggagctgtggcggaaattaatctgttctctgtgtttgttgatttcaatttgaggcatactgctcaaacctggtccttgacttgtgtttatggcccttgtggtggcccagagagatctgattttgttacttggtttaagaacattggcaaaatttgctataggacatccaaaaaatgcgtaattagctatgggacaccgtaaaaacgtgtatttgctgtagggcattgcaaaaacctggtaattagctgttggacacccacgacattattttattatttttggaggaataggagagagaaacagttgtgtaaatacggttatacccttcgattttttttctttttctttattcttccttattttttttttctctctaattctctttctctgctcttcattcaagcgagccccagggagagggagagcgtcgtgacggcgtggaccagtgcagcgcctcggctggggcggcgttgcgcggtcgtgcgcaagggtcgaggccagcacgacgcggcggaggtggcgcccgagctggagggttaggtggtgccggcggggttgggcggcgtcagcgcgcacgcaaggacggccgggctcagcgggcgcgaccacgccgggagcgcagcggctccgggccggatttgggaggctggaccagatggcgcgaggcggccgccaacggcgacgcggcgaggctcaagccatcgcagcgggcgctcttctcatgcatggaccttcagcacctgcaaacccgatgctgagcccaacaacgatgcccaataacaatgtcgtagcgggtatgagtggggacaagggtagatcgggcacgccgtgcggcagtgatgcggcggcggcggcggcagtggagctgagttgctatcatcaggagcaagggatgcataggcattagcagcagcaaggtgtggcagtgcagagtagcgttgggccgttgtttgtcttcgtcgtctttgtcttcgtcttcacgcagtggaggctgtcggtgcatcacccgccgcaggcgttggggtcggcgggaggtggtggtggggttgcgatgatgatgagcacggagccacggaggagaagtttgtggcagcgctgcgaatggtggagacggagatggaggcggcagcgagggcggtgccggtcgccgtcgtggtcggagttggcgcagctatgcgggagctagcgacggcgaggcttgtggcgaaggtgttgctggatgtggggcccacattggattcatttgagccaagggcaaatttgtctttaatgattgtttctctctcctattcctccgaaaataataaaataatgtcgcgggtgtccagcagctaattaccagttttttgcgatgccctacagcaaatacgcgtttttacggtgtcccctagctaattacacgttttttagatgtcctgtagcaaattttgccaagaacattagcattggtgatcagcaaaattggctttatttttagtgacttcgatttctatagatcagtgcaggatagaaacaaatctggagcagatatgaatgatatctttttcaatgacattatcagctcccttggcttgcttgagatccctcttaagggtagaaaatacacatggagtaacacgcaacaaaaccctcttcttgaaaggttagattgggtgttcacttcagctccatggaccttggctttcccaaacactacagtggtgcctttaactagaaatatctctgatcatgtgccatgtgtagtgaagattgatacaaaaattccaaaatcccctatttttagatttgagaattattgcgtgcagatggagggattttttgacattgttcagcaggtctggtctttggatccagggtttgaggaccctgctaaatgcatttcttttaagcttaaattgctaagaaagagattacttgcatggagcaaaaatctgtccaaattactgttgcttctgaccaactgtaacaaagtgattgattttttggatttggtggaagaaacaagaattctctcagtctttgaatggaatctaacagaaattgtaaaagtgcaaattctcaagttgcaggaatttagaaagatctattattagaagaagaggtgcactaacaggtggatgatgcttggagaggaaaatactaaatttttccaatctattgcaactgagagatacataatcaatgcagtgtcacaagttttggatcaaaatgggtagattgtgcagctacatgcacaaaaggcatctctttttcttcacagttttaagaatagaatgggagttacagctggtcctcaaatggcctttgatttgagtactctcttctcccgaagcacagatttggaatgtttggtggacatgttttccacacaggaaattgacagtcttatatccattgtcccagcagataaagcgcttggaccagatgggttcaatggtttctttatgaaaaaatgttggcatataatagctcaggactactacagattggcatctcattttcatgctggatgcacaatttggaaatcttgtagttcttatataactttggtttcaaagaagaattcaccagagacggtcaatgattacggacctatatctcttatggggctcagtttaaagttcctaaccaagctaaaggcaaacagacttcaaggggtaattctcaagctagtaagtgaaaattaatatggttttattaagggaaagacaatacaggattgccttgcttggtcttttgagtacatccatcagtgtcagcaatcgaagagggaaattgtttttttgaaattggactttgaaaaagcttttgatactattgaacactctgctattctttctgtcctgcaacatatggattttcctgaaaaatggatgcaatgggtgcaaatggttttctcttcagcttctttctactgtctgttaaatggtgttccaggaaattcttttaaatgtaggaggggtgtaagacaaggtgatcccctatcaccacttctttttgtccgtggagctgagctgttacagagagtaatgaataaagcttttgagttggacttaatctctaagccaattaatgaaaatgatgggagtgggttccctatcatacaatatgctgatgacaccctgatcttactcaaagcttctcaaaaggaaatcttctgtttcaaaactatcctgaacatgtttgcacagtccacgggtctaaaggtgaattttaacaaatccagtttgtatcctttgaatctttctcatgacaatgcttctttgctcgctggtattttgggatgctccattggttccttgcctttcacttatttggggttgcctcttggtaccactaggtctagagtggttgattttgcaccattggtggacagagtagaaatgagattgacagcaagctctatgtttttgcctcaatggggaaggttaacattgattaattcagttctttcttctattccaacttattatatgtgctctttgcaacttccagtcactgtcataaaggcaattgatacagcaaggaagagttgtctttggagaggcaacaacccatcctcaactagaaaagtttttagctttttgggacagagtatgcacacctaaagataagggaggtatgggtgtgattaacctgagagttcagaacattgctttgcttttcaagcatatggtaaaattatataatggtgttgagctgccatgggtgaaactgatctcacagacttattatgtttctagagtaccccatctggttttgaacaagggttctttctggtggagggatatcacatctctttcagatattttcaggggtatagctaagtgtacaattcagtcaggtgcaactgcccttttttggaatgatctatggaatgatgattttaagtgcacaagctaccctaatctgttcagtgtgactttgtataagaatgattcagttaggaccatgtgcctacggccaatggaggactcttttgttcttcccctctcagatgatgcatgtggagaatttttgcaactgcaagaggaattgaatcatctgcagcttcagctaggaagaagtgatgtttggagttttatttggggaacaggtatatacacagccaagagattttacaagctcaattactcttctttgcaacctcctaggcccatgatttggctgtggaaaccaaatgtgtcatgaagattgttcgcatggcttctgttctgtgatagacttaacacaagggatatgcttgacagaaggctttgtgcaaaagaagatgatgatctcacatgtgctttatgcaatacacaccaccagacttcatctcttcttcacatgtcctttcagtatggcttgttggcaatagctaggcattcattgggattgtaatttggaattctttcagatgattgttttggcaagaatcaggtttgcacaaaggggtttccttgaggttttctttctggcaacatggcatatttggaagcaaagaaatgggctaatttttcagaatattcagccttcattccaatcatggaagtctttgcttatgaaagaagttcttctgcatatgtacagaatgaaagatcctctcaagcaatctctttttgattggttgcaaactttataggattgctgtttttgcagtttttatttatccctttgtaactttgtacatattttttgatctataaaatttaaaactgctgggcatagtcctggcagtacttccagtcaaaaaaaaatatcattgtggttatagacccatgcactttgcaagtttgcatgtcatctaaatataaataaaatacttaaaaattttgacaacgtgttgcgtttttataggtcaaccttcaaacgtgtcaccgttggttccaatgacaggggcacataggtttcatgtgtttgcttacaccgtggtctcgggctcaccatttggaaaataaagaactaactcaaatattaatagcacaaaccacaacataaaaaaaatatctggtgtctttacgggtggttcaagtttgaagcacacgtaagatagcagcctctcgcgtcgtccctcccccacgaaagacccaggaggcgacgccctcaccggtgctcgtctccccttacctcctcctctacctggccgcacccgagcggccgtgcggccacaaggacagcggcggcggggcttcgtcctcgcgctcgggcgggggggggggagggggggctgctcggggcaggggaaccgcccggccagatctagcggtgggtcagccagcggcggggctgagcgatgcggtggcagtgacgtctggtggtggtggcggcggcgtttcgagcctagatctggcaggatggcgactgcggcgggggtggcgaggggatggcaacggtgaggcgaacccggccgcgctggctgcggagttctggacaccctgtggtggctcggagttcgtggcgatggcggcctagagctcgcggcgacgacggcaggtcgactgcgccgtgtgccgtcggagctcatcgacggcgagaagatgcaggagttgcccaccacgtggagtgcgttgatgcgtggctctctagaaccacttgcccgctctgcccaaggcgagggctccgatgacagcgcagtcgtcgttggtgacaccgcctggcggcagcggcggctggaagtgtggctgcagcggcggcgactgggacgcaaggaggcacggaggtgcggcacggctggtggctgcgtaggctggcgaggcacggacaaaggcggcatgtggtgacatgcggcgggcgccggtggcgtgcggagccaggccggcggggggcgccggtgcagtggtgcccacgcgctagcagaggttaagttggtggtggagcatcggtgtgtcaacggtggatggcgggtgaaaactgtaacgccccgatttttgttcgggattaaaaatcattaaataaagcatttccataaattaaataaaagttaaagcaatttaatcaagtgaattatggaggaaattaaaatttcctttaaaaatcattggtcgagaattttttgtaatattctttgtgccctaatgaactctctgaaatttcccgagaattttcggagctcgagaaataattttaatagcacaaacatcatttaactaattaaataaaaagaaaacaaattaaaaccctctttttgtctttgggccgccccggcctaatcccccttcccctccccgtggcctcttcctccctcctcttctctcggcctagcccgcaacccggcctgctcctctcctttcttgcaaaagtctattcccccccagctcctctctctccctggctgacatatgggaaccaaggctccacatgtcagaaccttctcctacctccagccgcccgcgggcaactgccatgccgcccacaccgctgccaaaaccgccgcctcccgtcttctgccttccgcacgcacgtccaaccgtgtggacgtggttgccacccactcctcctcattttcccccacttttccccaaaaattacgccggtttgacctccctcgagctccacgtcgccaccccacatcgccggccggttgccgcccgattctgcccctctcggccacgatttcccctcccgtagctataaaaacacccccccccc

SEQ ID NO: 72462 - DNA, 9342 bp, Oryza sativa
gagagaaaaagaaaagaagagggagaggaaaagaaagaaagaaaataaagaaagaaagagaagagagaaaaagaaaggagaaggagaaaaaaaaggaaaggaggaaaagaaagaaaaagaaagaagagagaaagaggaagggaaaaataaatagaaaattagagagaaattaaggaggattagaaaatttaaaataattagaatttaattatagattaattatagtcgtagaattgcaaaatttaatataattatagattatttttggtaatctctataagtaatcaattcacggtagaaattcagatttaattactaggaattttagccgtgtattatatttaatcgtttagtcatagactaaattaaatcgtacaatattataagataattttaggaattcgtccgatatttagctcgcgatagaaatttctaacctattatacggatataatactcgggctgattaaattaaaaacttgtgctaataaaatatttataccgcgaaatagcttaggatggataaattaagatcggattagctctaattcacgaacaaaaataggtaatgtaagaaactgacttccgctctcgatatcttcgtggatttacttggatctttatttgaaatctaaccgaattcaaatcgtttcttcgcacgtaattttagagccagagggagttgcggatccgagcgaggatcaagacccacagaactacgagcaaggcaagtcatcactattctttaaacatgttgatcccaattgcgaaactattttgtttacaaataaaattgcatgcaatgatgaacatcccacttgtgattatgccatgccttgattattgtttatccttaaatctttgtaaccatgattatgtatgagtccctagtcaaccatgacaattgcttagaaatgctactctagattcatgcatgctcatatttagcaaatgctatatgcctgggcaattacctttgggaaggtaattgagatgcgacatgtggagacaggagcgccacattgccatgataatgatgacatgatttatcaaagggaaataaaattaaacaactatttttgactaggacggacggaggatttgggtggtatctggaaaaggctagtaccgtccccggtcaattaaagaccgagccatgaagttaagcatgaaacaacccccgtacaaccgtacttctcgaatgggtatagacctagcggattagatagccgagcggaggcagtatccctgcatagatggttcacccctgagtgagacaggtgcgctacggtggggcagccgttgaggtagggccgagaggcgtgccctacattggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttgagttcatggagcgggtactgccaatgcaaggttatcgaaaagctttgccgtgacgcgtctcatgtgttgagacgaggcttatgtgttgggcagtcgcggagtgcgggtaaagtgtacatccactgcagtgtgagtaaaccaaatctattcgaatagtcgtgctcgcggttactgagcaccgggacatgtattacacttggctagactctaaattcttaacctgtgtgggatgggatattgcatgatgatttttatgctgttggagccacttcctgagagacgggaaggtggacgtcctcagaaaaccatgacgattcaatggcgggaagctatccttgggatcacaatggatggtggacagaaccgtcgttgtctaatgtgaacactagtattaaaacttgatcagtctatgctaggtcttaggcttgtgaaaagaattacaaaacttgctttgtgcaaaagaaccatagccattccttgaataccctctatcatgtgcattgttgctgtggtggcttgctgagtacggttggtgctcacccttgcaatatacaaacttaatcagaggtcggagatgaagcttcggaggatccctacgcttactaccaggaggatgatgaagacgatggcgctcagtaggtcttagttacggtcgttacctgtggcaatggcgtgccgctgtcttaactccgctaccttatctacttctgcttttggaatgtatcccggaccgctcggtccgatgatctaagactatgcctgcgggcttatgatgtaataattagcactagactctcgtgtatgtgcatttggtatgttagctatgaactcgtgtgtaccagactacttgatccagggaaatggtactgtttacacgattgattcctgttacaaaaatgggagtccacagcatcccccttcctcctctcctttccgtcgcccttcgcgcgccctctcgcgccaccgctcaccgccggtggccgtgcaccgtcgcatgtcatgtctcggctgggccggctctgagccgtgcccgtgccctgggcgccctgccctgtggccgcccgtggaccacccgtggtctcggtccatggtgccgtcccggccgcagtggaccgtgtccaccgtgcgccctcccccttgtgtcactgacatgtgggacccgcctgtcggcaccggcttcccttgctgacgtcagcggcggtccttttcctttgtaaaaataaatattaatcgcgcaataatgcgttaataattatagaaatttatttaaatggctcaaaacttctaaaattcatatctaattcattcgaactccaaattgggccgttcaacttgcaaaattcatctaaaattgaggtctacatgattgtttacttttttatgtactatttgtttggtttttattagagtttttcctcgttttgcgtgccagcgagtagaatccatcgtttcggaagtccgcggtcgctaggaaaagagttcagaagatcaaagttaagaagcaagcaagtcacacattccccttgagcattttgatcctaatttacaaatgttttaccgtttgcaaataaaatttcatgtcttgctaattacatgggatcagggtttacctatctgctcgcttgtgccatgtttacttgatatctgtcctttgtcaaccgtgggtaataaatcgcctagcttgtattacttatgtgacctagctagaactttatgcttagccatgcttaattaccactagctcaattgatgggataattacagttttagacatctagtatcttgacaagctgcgtgctcgagacatctagccatgtttcatggtcgtaattatccaactaaaatgcaactgaatggtgggctgtgggtgcatggttttgttagttgtgcccatggcaattaaggaccggttcacgagaaaccctagaagaattacagtgcttaccacaagcgggagtgggtaactgcttgatctggagtatagctcgaccctttcctaggcaccggtggcgagggtgggcgtcatggagttgggtcggccggggtgtccggttgtccagctgccggattcaccgcggcgcacgaggggactgccggctgccttgcgaggagtgcaggtgaaaccttagcgtggtgtggatggttaggggagagttatatgaagggtcttgtcacaatcactcgacatggtgacgtgttcatcatgggcacatgatgacacggtgacatgccggtggattgtgtcttgtgggtacagttgtgcacctctggccagagtaaaactattcgaatagccatgcccacggttataggcgatcaaccagattcaccgtgattagtctcacacttaataaatcgacccaatgcactgtagttcaggtggattggttgggcctgttcaatgtggtgtagcgttgttcagtcgagagttaatattaccttaattactcaactgttttactgttttgatcaataaaatgttctacaaccgcctttatgcaaatagccacaaaccatcctcgtatccccttgcacgtctgcatcattggtatggcttgctgagtacggtggttgtacttagccttgctattgttcccccttttcagaagtgtagtgcttctgagctgaagccgaagttagaagaccaaggctcagaccccagttgagttttgcctgtggagtggagctgaagccccgctaggatcgccttttttcgctgctgtcgttctctttcggtgtgaggactaagtgcctcttctgtaagtattttacgctttatttacgtttggaactgtatattacttgtcgttttgtgtaccctggttggtcctggacagggatttagtacacaaaatagtctagaaatttgggctaaatttctgggcgtgacaaaaacccagcccggccgaggccgggctggcaacgatggcactcgatcgtcattccccctactgagggtgttgtcgtgccgtctcaccccatctagtggtggctgccgggtgaaagccctgtcaaggtttctccagaccttgacagacagcagcggcgatgctactgtcgcttctctccatggagacgccgtctaggtagcacccttgccaaaacctcccaaacatctgttgcaagctcgttctagagtcatttcctcttgtatcggcgtcctagtttatacaagttggctatgtcgaagggcctaggggggagagcggttctattattctctctcaccctctcttcctaaatccctaagatgtggatagagtgtgtttttgtgtcggttgtaagggttgggttttgagcgatcctagttgtagttcctttgttggcttagcggcggtcggccaagcttagaggcagccggtccgatgctagtcttctcctgggattgtgtttggcgtcgtcagtgtgtgggtggtggtattcttttttccttttcctggttacgatgtcccaggattgtaatcttataatttttttctattgtatcaatatgaactttgcactgactagttcaaaaaaaaatcttgtgtctttaggtagaccaaacaatccaattagtctgtgattttttttaaaatatgctcaaataataaaagcaaggccaatgaatcagggaagcattcaaaaaaatcacatcccaaaagtaatggtgcatctttagttatactagaaaaaattatctgggcattgcaacaggtgaaggctattttattttaatcttattattgtccactctgaaattcattgtgagaattcgatgttatatggtttagttaaggtgagattcactatgggaatttgcttggatatataattttttagaaaattatgagctgcagttaggagtccgttcgtatcaagttagcatgcgagtttttttacgactccttctgtattttcattcaaaagtgaacgaacttaaaacccgacttaaatacggatctgtattttcaaaagcaaacgaactaaaaaccgactcatacacggatgacgtacaaaattaccggtaaaaacattttatagtagtagagagttgccaaacttaaaaaccgactcatacacggatgacgttcaaaattaccggtaaaaacattttatagtagtagagagttctaaaaacattttatagtagtagagagttcccgtctgtgttctcgctgagctccttgaatcgatcccaaacgggtgtctcctacactgtgcagtacaattgaactctaaggccccatgaatttagccctcacatcccacagccaatccattcattaacttatataaaaggtgattgacttttttaaaaaagttggcaccttaggtgtaacatctttatttatcatctcacgtcatttgaacttaaaaaaaatgcttgcataaaataaaacaaaaaataggaaatgccaataagagtaaagcggaccaattagggaaaatcttataaggtcttagaaaaaattggttcttccttttcaccaaaattggaacacccgttaccatatccattgcgtcattttttagtgtttagatgctaatacccttcaggtggcattattagtttcactacatcatgcacacaaaagacataacccactaaggtagaaatatataattggtttaaaagttatattaaacttgatattcactttgtttttttcttaaaaaaatactatgggtctaacacatcgtagggaagcaggggctagataagtattcgaattatgtcaatatgaatcagtaagagggattgttaacttcatggaacaactgaaacataattatttgcaataatagttttaaaaattttgttaaaaaagagagcccgtaaacattccatttgaataaaaactacttacttttaatttacacttacctgtttccaaaacaaagtatacttttcttttgaatgataagtcagatcatagttaatttcttaccgaatgaatattgtatagtatgtagtgtaaagccaacgaatagcttagaaaaagttacccaagcaataccgattaataccgattaagaaggtttttcagacaagtcacaatttttgaaatatagtatgaataatccggttgatggtatataagtctctaaagctgacaataagatacacgcccgcacatttgcgtgggttacctttctagtctaatttaagaaactgttgggaacaaactcgatacaaattggtaaaacacctggagaatataataataaacaaactcgacaaagacagggttttggtgctgtcaagcagcagcattttctggtttatactcaatttaaaatagcaaatcaacatacatatcatgggagggcaatgccaccatgtgcgccacccccgtccacgtcatgtgccatcccacacgccaagcatgccacgcaactagacgcactccggcttgagccagcaagccacaagcaaatacagacgcaacaagacaaggaaaaaaaacagaaaaaaaaaaagaaccaacaagaaatgttccatcagaaatagacttcaaaaccattagttcattacaaacaatctagatcagtcatatgctgaacccagataagagataaacttgatatatccaccaatgaccaatcactgtagggactttagtgttgttcttccaagtatatgaatcttgtatggatcgatcatcgatgtcggtgaccgttgtagtcaattgaatctacctgcagttggaattatagaagaaatatatcagatttgcagaaaagaagttgtgccctttcaatatgctccatatatgataagttcacaatgcactataaaaacaggttctagtttttgacctcctggtataaaagtttgaatatttggtacaaacataatgtctgacatatgtacatgtctatataaatagaaggctactgcagaacactataccattccaacagaatagattatatataacgacatcagcacggtatcttagttagatctgatatttttaatactagataggtaccagatctagtaccgtggtacctgatacaatacccataggtattatatttggtgccaatgataccagatgatactgcatggtactaaatcctgctacctaggtaccatgctgacatcatgatgatgtcagctattccgttagaacagtgtatcgttttgtagtattatgatataaataccatgcaattaaaatatcagaagaacaaataattttgaaataaacattttcatgtttaaatttatctaaacttggtgaaaggattccataggttatgaataaaaataatatagatgcatatgggttgcacactagtaaactagaccatatagcctttgcttaccgtactactaagtaacctagttgaaaacaaaatggctaattctgtgtatcttttctacacctccatcttggtgtgcgcacataattgttgctgatttactatgcagataaacaaggagtaccaaatgacagcaggccgccattatagccagcactcaaaagttagccacttagcttcaaacagtcttatcatttttttttttgccgaactaatattttggtgcgacttttcatcagatattttacagtgctggaacttcaaaagagtgcaaaaatagtttttctaggggaagtattgagaggttaaataactattcctgaatcctgaacagtgccaattaaaatgtagggcctgggtactgtgggcctgctggtttcctattagttggaaaatacagataagaatagtttgtttccttgctaatttggtttccctcagatatattcacatgtattaaagataaaaattacattgtagatagagttttatcttgtggggccaagccaagtaatctgtacaaaaaggtagagtgctagcatgtataactattactagtaagcaagcaatgaagatgaattaacctagtctctccccctttctcaaaattgttcatccaaatctatgatctcccatcatgtacatacatacatacacatacacgcacacacatatatatacctcactatgttacctctcaattaacactaaaaacatttctagttcccaaggtccggagaaaaccacgcaaggaaaattaacactaaacattttacaaattgcacttgtattcttctcttaccaacctgttacaaccaagaatcgcatgcctagtggtattgctagccatgcaattcatttccaataaatccctaaatttcaaataggacctttactttatttcccactatacaccactgtcctccataacttcatttggggtttctcaaaaaaaaaaaaacttcatttggaaaaatcaaccaatgatggaatcagcatgatcaacaaaataaagaggaaaatataataaagcagtgttgcagtaacggaaacaaacttgaaatggaattctgttatactagccatgcaaatctatagaatattttttgcttattggcttatagaggtatgtggatagatttgacctgagaatagagcctttgggcaaggccttcttatagtattgcgctgactgccgcttgtagagcaatgactgatcatagccaccttctttctgaggccacactaggttatcccaccaatccttctcacagtatactatgggtcttggttcatgcaatccttggacgtcaggcaggtgtctaagactacagcagcccctgatcatgatggcctccagcatgggagctgacattatttttgcctcacatatccctttcaagctgggaagctcatgcaggtggacgtgcttcagctttgggaaatcaatagcatcattgcttactgtccccttggagtttgctgtgttcaaagggaaaacatatatgaggctggtgcagtacaggatctgaatggtctc

SEQ ID NO: 72463 - DNA, 1173 bp, Oryza sativa
caaaattgtgagatggaagaagaaaggtatgtcaaacaacttcatgcttatctttgcaatttttttcagtcatcttgtgtatgcgctttgcaaattcttttcactatgtgtgtacacaagtcatatacttgatgatgatgtttttctatatagagagaggctactgccatgtatggtcccccatgttggtatggaattcaaatgttcagatgaggctgggatgttttggcatagatatggaggtcaaaaaggctttgaggttagaaaaaggtacacaaagaaaatcagatggtgaagtaacatcatataggtttgtttgtggaaatgagggtcatcgaggaaatgacaaaagggatcatctaacaaagtgtcctcgagctgaaaccaaaactaattgtcaagttcgtatgagtgtagcaatggacaaaaagaagggaaactataaagtgtctgagttggttcttgaacacaatcaccccttgcacttgcatgaaaccttgcacttgatggcctcgtaaaggaaaatttcagatttacaagcttttgaaattgaaacagcaaacgattctggaattgggccaaagacggcatatgagttggctagtcgacaagttggtggatcacataatctaagctacaacattcgtgatcacaagaactatttgcggagcaagcgccaaagggagatggcatatggtcaagaaggtagaactatttgagaactcaaggatggatgcttgctttcgctataaattcctctcccacaaatttctcaacttggcacaacaagctgctagctatccagagtgcaccttgttagtaaacaatgcccttgacaaccttagcaagcaaattgaagagcaactcagtggatgtgctagtatctcggatccaagtataactcacacggaggttacgcccccaaacaatttgttgagtaatgcacacctaaagaaaaaggatcggaggttcgtgttagaagttcaaagcgaacaagaaattggcttgataaaaagcgtaggactaggaccagacaacaagggaaagggaaaaagggaaaaagttcgaggtatgttatacaaaaagttccaacactatgttactattcagtactatgttttatggatcctctgatactcttttctttgaaggaacaaaataatgggggagatg

SEQ ID NO: 72464 - DNA, 2046 bp, Oryza sativa
ggacaatctgtatacatgttaagcctcactctcacatgttcaattcagcaacaccagcacattctactgtcagcaacaacaactgtctcaaatatttggcttaattcaatttacaatcacaatccatatcaatttatattctcctctcagcttctcgagcagttgctgtaagcctccttcagaaggcagaggtgatgatattagcctcctctagaaaatgcagcagccagtgccttcctcctgtcgtggtgtggcccatgatagtgctctgctgaggatgtggccgaagagttcgacgagggcgccgcctcccccgccgtcgtcgtcgaggcacgccggtagcagggtgactctcgtgcaggggaggccgcgggcaagagatgggaatgagggtggtgggctggtggtgaaaaggcttccctagatctatggtcgagctgaacccgccccaaggaaggcggcgagcttgcgagcaaaagcgagcagccggcggccatggagcaaggcgagaaaggagaggagaaaggtcgcatcgtcggtctttgattgttgactgtgcttctgtgggccggattttgttgtcatgggccgtgtgagccagttcattttttcacactcactgattgccgtctgatgcagatcgtgcgctccatcttgctgctacttccctctgacgtaacttcgactacgtcagacgatccgaatccctttgcttgtgttggagttggtcattgttgtggttatactcgtctgctcacatttttacagtgttcaacgatgtggattatctttgttctttcctgataggtctatttttctcgaacgctttcctgataggtctaatatttttttttccaaaacaaggttgtaatcagctcttatatttaatcaggcttgtttcggaaaaaaaagattaggtcaatttggaaccaagatggctgcaaacctgcaaattacacatgaagggtgtgtttagttttttgtgtaaagtttttgaagtatacggacgtatatttgaagtattaaacgtagactaataacaaaataaattacagattccgtctataaactgcgagacgaatttattaagcctaattaatccgtcattagcaaatatttactgtagcatcacattgtcaaattatagcgtaattaggctcaaaagattcgtctcgcaatttatatggaaactgtgtaattggttttttccccacatttagctaaaaacatttgatgtgatatttttagttaaacttttttggatctaaacaaggccgaagtgaacatggcacaaaccctccaagtatatgtctggcacatatatagactcccaaatcatatctagcataaacttcagattgttttttaggcaaccacagaaattttcttggcttcaaacccaacccctaatttcacgctcaaatcatacatttacacacacaataaataaataaataaataaataaataaataacaagggaatagaatccagtggactgaaactcgtcactttcacgaacaagtctttagtggcaagataaaattgcatccagtgccagtgaagtcctcggaaacacattagactgagacctcttgatttctaaaattccaatggatcatgccagctgatgtgctccagtaaaaagcttgctggaaaagacaggaaatactgcaggctgctgctttcggcgagctgctttggataagaaaacgcattgctatcgttggcactgttacgactcggtctgtggttctgacttccgatcatatccacaaatccacaattactccagtttgttttgtcaacagacaacagcataaagcatagatttttatttgaaggaaaacacgttgaggcaaaatatctagattacaaagtagttttatttcccagagaaaagcatccctcctaaaaagaccacaaacgatgtttttcttcaactaaaatgtactgtaataacaccaaaggagcattgtgaaaattgtcccgcccaaaatgtacagttgacacgagtaaagcattagtgttactcagatttacagtct

SEQ ID NO: 72465 - DNA, 8414 bp, Oryza sativa
gacgctaggatccactgtaaggatgcccttgctgcggaggtgcaggaagccgaggtggcattggcaaatgcagcacacggccatcccaaccgtccagtccttcgaactgatagggcatatgagaggatgatgcgctcacctgatgacgataaggtacgtgtatgcacagtacgtaatgtacttagatcatttcaatcgattttccttatgctggttttctgcctacatatataaaatctgatcttaattatttcttgtgcttatatatatttttcagccaacaagctggtccgatcaaaaagtttttgagatacatgtctatccgtcgtcgaatgaccatcatcgttaccttagctacctccggttgttgaagaagccacgcctggagaagcttatagtcaacatatatgtgtccaaggatggtatggttggggatgtggatgaagctgtggcagctgcgaggaacgtagtcgaccatcatatcaaccatccaacacttgagataaatagaatggaagaaagtatttctgaccaacatcaacaggcaagatatatctctcttcttgagctcgtccccaatattgtactacagagaaacccagttaatttgtaacaccaaccatcacattctgaatcatgtttgccttttaattgtttttatgcatactctacatgagagtgctatatatattttgtttcacttgcagttgctcatagtcatttcacaagatacatatgcatggtggtagactgctaaaactatagttcatcctaacatagcattattttttgactgtttctaggtccctgaaaataattgagtggcaagctgttcatttgaaggttaagattggcacagtgatggcacaatattaatgaatccgagccagactagacgggaagctgtcatagcattgactaatctgtaatccgatttcaaaatgcaggatattcggatcaatttcctcatatgtcgtctactcttttactgtaagtatgacactttatcttttatctcatttatgtatctttcgtaagtggcacagtaataaggtgacatcccattgttattcccacacatttgtaaccaaattctttaataattgagtgcagttctggtgcatgtttgattctctgcatttggtccaagcagaggttacagcacattatcaacggagaaaataactgaaaaaaggtgatgataaacagaatattatgggtgctgtagcataattgactctgcacctgatcaccctcctcatgggttggtaagcacaacagcttgccatcttattgctgtacaatcttttgtgaatgatgataggtgtaattggatgtgtgctggagaaaaaatgctcaatccaagtgacaaattgcgcacttgttttgatctttaattccctttcagagtgatctactctaaggacaatcttggatcacccttggatgaaaaacttaaggattggatgttggacattttacctttgataggcctaaaaacttcatgtatatattatatccaaactagaggttataagtgtgttttggctatgtgcatcatagctatgcaaatgccgggagtatgctcaacatagttgtatcgcctcattgtaattgactgcgttcaataaaatcttccattatctaaaaaatggaaagcttcaatccaccaacagagtcatggccacatgattccctcattggacaccgaaagattcaaagaaagcagacttcaggctgtaaaattgtttgtgaaaaccttcatgttgcatgaatgcaagagtgaccttgaatatgttgcttaatttttcagattatgtgtttcacattttctaatttagtatactgtgaagtttgcgggggaatgtatagatttagttgatgaattcagtagagcaaacacaaagtacaggtacaaaacaataacatgatgggattcagatctcagaaggtgcacagattcgtaactgtgaacctacagaggcacaatgcaacaacaggtcaccaaataatatctcaactgagtaacaactaaaaatcattttacttgaacaacttgcccaaatagagtcatcaaaaggagaaataacaacttgcccaagaataagaaaatctgatccaccttaagatgaccaccctagtcatcaaaatccacatcacttacaaaacagatttaggatcataaccatcaacatcttcaataacgtaactggtggcctaggttgtaaaagaaaacattgaaatatgagtcatggaattccaattcaacagacttgagtgtgcaaatgctgaaattaagatgctcaacattctcagccattttggggatggattttgatttgagggagaggattaataatggaaaataagatcttcacaatgatgtggactcttctatcgccttgtgggcaaatgattttgattttcctaagcttttcacagttaactgctgtccctgttccttcgcatgtgggatctaaatctgcagtagcatttgcagaattggtgtcgtgatcataggcataagctccatgctggtaaaatgaacaaggaaacagttaaactcaattcatgagaagaaaagaaacagcaatgtggagagggggagatataccgaaccttgacaagatgcagggaaagtttctctatgttaggtgagtgccgaagcaagtacagtagtggatagcagccatcactaaaaaacaactcaccaagtgccaaactcgttagattgctgaatatcccacaccttggaagatcacgtagtaataccttttggaccacctgcccacaagttttaaactccaaagatgttaaagataggaatatataaacaacaaataagagcaattgtaatttaaagcatttagcttacatcttcgtagatagatgaagacatcaagtgcaatcttgcagcgtttgaaagagcactgagaatagtgcagtcaacatcagaatgtccaaaagagaacctattaagggtaaactgaagctgattccactgatgatatgtctaggagccgaagatttctgtttgcaatctcctctacatgcaggcagataaggtttggcatatttatcacaagatgctgaaaaccttctgggtcatcttgagttctatctgcagctgtaatggtcagaatcttcaatgtagcagagcaaaacatggtggccttgatggcacaatgtctcaactccagatgcagtagctccgggcaaccagaaaagagtttctcgacaaaacggttatcaatagaaaatttgcaaaggtatacactcttcaagtgcaagaaagtgaaggggacaggatatccatctacagaaaggagcttgccatcacaataattgagtatgccgagagttttaacgttgcacctaagggcatggcagacccatggatggatgtcagaataatcaagggaatcatcagagctgtcataggaggtatggatacagaacatatccaacagggcacagctgcgctgcaggagcaaattgtcaacaaacttcttaaaatgtttcactgtaatgaagttgcacgagtcaacattgaggtatcccacagatgcccagacgttctgccacctccgagatagcacacaagtctgcacagcctccttcgctgttaggaatgtcatgacatggtgcaaaagttcgtcaggcagagcactgatcctgtcacagacactcgttcgcctgctagactgggacatatctctctctctctggaagagcttactttatcaggggcattcaatcgagtagttggtgtgcgagggtgccaactgccatatccacagaatggagaaatagatccacacaagcaaaattggatacagcacgttagtaatttgcaatcaaaaatttgttcttgtaagcaggaaacaaaataagattgaagtgcgaggaaaagaaacaaattttgtggggcatttctcttctacccgaaaaagaaaacctcaaaaacgcaatcatgttccgccctgttggtaggactggatatagaaactagatattgctaatcacagtacagagaacgctagtaaccacagctgcggcaatggctaaataaatcttttccattttggagagaagagaccctggcatcctattacaggaagtgtactacagcagtgaagcatccttttctccaatgcaaaaagcgacacatccacataagacttactagtacttggcactcgaacaaggaataaaatgtactcttaaacaacttgggtggcatttcctttttaccctctattaatggaaatggaggggcttccctcttcttctttaattttaaccccaagatatgaaaaccatcgcacacaattttgttccggcctgttggcaggactggaaataggaaccagatatcaccaattcacaccacaaacaacatctgcagctattgctaaaaaaaaaaaatgtgcattactttgaagctgaatggctaaaactaaagatctcattatttggctcaagtgctaatcgacactacggctacggtcaacagaaacatggcataggggggttcattttattcatccaaatcaaacacaacattgaaataacacccaagcccccaaatggaggcggggaaaaaccctagcgggcgaatggcggatggaagaacacagtaattgcctcaggaagtcagcaagacgaaacgcctcacccaagggaaccggcggcgggctgtggccttgctcgcgctggcctccgttcttcaccggcgtgcggcagccgtcggagggagaggcctcctgccaaagaggaaagagggggacgatgtgacaccaccagctatccaaccagcaacactgcacgctccggcgccgcttccgcctacctccgcgccgcgcaccggcgtgcgacggccggcgaggagcccaaacctgcacacgacggcgcggccacaggcagcgctgcagcgtttccacaaaagatggccctcgttatggcggtgaggggagaatctgccgggggcattttactactctctccgtctcataattaactattctgaatctgctgtcacctctatcgccaaaatctttttttttaattgaatccatgtcattacaaatttatctattcaaaaaaatgtcatcataattcatctattagcagttgtaccactaaaattttataaaattataatcatgccactgttgtcacctttttcattttcttttttatcttcttactacttgctcccgtcttctttcctctcctctcttctttgctcctccaacccggccactgatggagccgctactccaactcgacatcgttggccacgacggtgaggggttggagtcaccgacttggacgaggcaacgccgaggaggtggtcgagggtggcgtgtaggccagcaatgacggcctccttgttgcgggcgagctagacggcggtgatctcgtctgcgagaaagcgaggcgaaaggagctcgggcaaccagatcggcaaagagcgaagtggcatcgcagcagctgccatcgcaaccattgcttctactacgaagtcattctagaacttaagttattttaggatttctcacattcgtataatgcctagattcaccaccatctatataaatatgaaaaattctagaatgacttacattatgaaacggaggaagtacaataaacaacatcggagtggggctcatttttccgagagatgttcctttcattaattgattaattcccccgtatacccggattattgtaattagtattactcctattgttccatccagacattgtagaagcaatgcattgatgcatgtggaacagtctactcaacctgcttggacgctgttgtactccgactgcagtttttgccatctttttcaaaaaagaagaagaagaagaagaagaagaagaagaagaagaagaagaagaagtggagtcaaattctagagcactgtccacgaccaagtttaatttggggggaaaatgtctgaagatacatcattgcatacacttcagcattcaactacaacggataacaagcaccatgctgctggacaaaagtttcgactttccagttaaagagcatcagtagtaacaattttctggggagagttggtattgtgcagtatgacccgcaggacactgcaactctcatcaacaaaatgctactacctccgtctcaaaagagaagcgcagccgtggaaatccgtatccaacaacgtttgaccattcgttttatttaaaaaatttatgaaaaattttaaaaaaattagtcatacataaagtattattcatattttatcatctaataataataaaaatagtaatcatatttttttaaaataagacaaacggtcaaacgttgaaaataaatagtgtaaaacttcacttattttagaacggagggagtagttgtcataatgtcatatcaaatgcaaacatcctctactaggaaaaccattttttgtcgaatatgaggatcaaatcctccacaaatccttattatccttttgcttcaaaggagacctaagcctccaagtcatccctttcctctacatttcaaaaccctcatagatcctcattgcacatagcataatactgccgcacaaacaagaaaaatgcactccagtacagattaatccgacccggcaaaaaaatggatcaggtaaatttacagcaccctcccctaacattgcatgctgaagtaaaccccactgttaatccatttgagccaagatcattcatgcagataacactagcaaatgcgaaagtcattcacctgattctacccaaaaaaaaaaagaaaactaagagatgacctaggcagcgaggaagctacaggatacaggagcaacaggaaaaaaaaacccggaataaggaggattaggagcacagagagcacgcacccaaggtgaccggaggagcgcgctccgcttccgcttccgacgacctccgcacggcggcgcgcgactccggcgagatcgagatggcccggaacccaagcagaagcagccgtggcaccagtgaccgagttgtgatgggggacgcgagcatgagccacagacaagtgggtcccacatgatgaaggcgcccgcatgtcagtgagcaaaccaaccacatcaactatagtgggccgcacgtctccagcctaaatatttttatgggccgagaatttccgttctcattccatgggctgatttggaattttttttatttttaatttttttattaaaagttttacaaaaataatttttcattttgaaaattgacagaagtggtcgcctaccgtcctctgggagggcgatttttaaaaatcgctatcccagagggcggcgaaagtgacgtggcagacggccgttcgctctcgggcgacggccctcaacgaaatttgcaggcggcccccttgccgccctccgctagggcgattctgtggcgtccggggggccgcctgcaaatgggcggcggggggcctggaattttgcaggcggcccccttgccgccctgggggagggcgattttatactgtgctttatatttttgtattaatatcaatagttatcaaatctttttatattgaaaactatacaagattaaaatctccaagactggtaaaatacaattttattatttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggcaccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgagtattc

SEQ ID NO: 72466 - DNA, 655 bp, Oryza sativa
gaggaaaagaggaaaaagaaaagaggggaaaaggaaaaaaagattttcatgggatttaaataatgcacatgctcatttttaattggttaaaattatttccaaggctctgaaaattccactaaaaatcatgttagcatattttgacatgtagaacccaagaaaaattccacatgtcgattccgattattatttgtatttttttaatttagggtttctctcttgcctttaaacaaataatttcttgcaacaatttattaattaaattttggctagggagaataacttcagggcgtgacaacatgcctcctcaggaaggcagcgttcgcttggtccgatgatgcggagcgcgcattccgggcactccaacacactatcacgtctgccccaacactgcaacttccagatttcgcgcagcccttcatcatcgagtgtgacgcgtcgagtgcatggtttggtgccatcctgcatcaaggcgctggaccagtggcgttttttagtcggccgatagcaccacgccatcctcgccttgctgcttatgaaagggagctcattgggttggttcaagcagttcggcattggaggccatacgtctggttgcccatttgtggtacctaccgaccaggcaatgtgggtctattgagagtgcatttatttg

SEQ ID NO: 72467 - DNA, 3991 bp, Oryza sativa
tttgctttctcttcttttcctgttttatcaacagttttaatctggccaaacaacaatggaaatgcatgctaacgggatgaattactatcaatgtatgttccctcacctctatatctctttttccttttcccatttcccccttaatcatgtaacattctaacttctcatttctatcaacaaaatggctatagggtagagctgctctaccttcttatgttaaaaataaaatcattttgagtacctccaaaggacacacgaaatagtatcaaatttatattaacaagagagtcacatgtcgtcactattttccccttttgaccacttccacttgttcaatgatccgtgaatgtgcatatactatgcgtagctaaataaacccaactaatggagggtcaattcatttagttatcatgcaagatttttagtttaactatttcagatttgcatagggtctagggtttagggacctcattaacaacctctcccctgctgatttgttgctttgattttttactgaaaatttgcctagctggtttcaacagagtcctcttctccggtcatctcctttcttcacggctgatcacaatctaaaaaggtgtctttctggtagggttgctactgctactccactggatctgacatctgggaggggcgcaccaaccctaaaaaaagctacagcatttcctctgatttgtgtttatattgcttgctgtttctcctccaaccccttcgctctgcgatttccaaccaccacacgccggccatcaccaagtgcccacatgtcaaccgagttctccagctttactgttaggttcctatgcacaaatccatccatatccactagatagagcaaacaaatgttttgccatatgaaccctagcctaatataaagatcccttctgattacatttttgggttcttgcaattatcagttttttacggcctcactcactgccaaatgatttctcctgccacaggattagggaatccatgcactgcagttgcccgcggtttctcatcaccaaacatatttgcaggtacagtttactaccgttgtcttctacgaataacggcactgacaataaaaaaaaaatactatactgatatgaactgaaaacaatcttgctaagtgtaaaattataaacccagaacaaacaaaatcaattgttattttatttgcgcctacaaaaggatatgttatattaataccttttcttagcaaatttattctagatcccagccttcgtcatgcacaaagttctatacgatctttttccactatcaatatcgttttacatattgattaaatttctcctggtacatcaccgtatatattaccatatccatatacatcgattgtaacgcaggcctatttaacatgtcttataagttaacacaaaagactatggtgcccatcattacatagtttatagctagcgatgcgaaagtaattaaggctagaataaataaaataatctcagaggcgattagagcagttgctacccctctactgtgatcactatttttagacaagctcaagtcctccaaacatgatcagtataccacacggatcttaaaatatcacagcacagtttgcaacctttatagcaaggtcttaccgaccagtcctctaaccaatatatgattttgttcccactctgtgtaattgtaatttaaagttattccttctgttaaacctcatatcatagagatcatgcttactgtttaaataccttcacaaagaaacatatatcagaagtacctaaaaccttgctatagcagccattggctcttcttcttcatcgtcagccgcagtgcatgcatcacttagcctaatcttcttcacctttacttattattgtatccttagatttctcagacgttgctttatcttcccgtgcaaacacacacacacacacacacaaaacccaacataaatatgtattcacagattcaatctgcaccttgttttgcatagttatggatccaccaacattcttcacgatctggatgaccgcggcaaatcagcactgtgcggtaaaatctaagacaaaactatcctattcaatatataaagtatcctatatacaacaatgttaatgtatgttctttattggccagtgtattccacccgcaattgtgcaagcatatgaactcaaggacggtcaaaaaagttggtgacagcacatcaccttaaggtctacattgaactgaggaaagcatctaacaacatgtacatgacagcaggatgggcccagtttatagaagcaactggtctgcaggttcaagagcccgccgttttcagggttttatcaacctcgaagatgcatttcatcatatttgcaaaggacggttatcttagatgcccagttccagacaaacccagagactctgaaccgaccagacaatcgtttcgcacatcaagcccacaaggtaaatgaaccgtatcttacagctcatctcctggcaaaacaaaaaaaaaaaaaaacatcctggtgtatactgccatatctgcatccattagcctatcaactttattacctactcttgtcaatttctttttttttaaaacattatttcacttgcagggaaagccactacaattacttcgcctatccaatgctgcatcaaagggaagctaaaacatgatggcacatccacttctgcaagtacacatggttcacttgatattctcaatatattcatcaccatctcttttcacctacactgctatgttcattcacatcccttgtaacaggcaacaacaggcgcactatcagcgaaatgtgtttctgcaccaaggacatcaggttatcagctgaagtcaagaactacatcaaagatattgcgccattcctccagccctcagacaaattttatgtgactgccataaatgcaacattcatgaaggaagggagagtggtaaaatcactagctcattcctcttttctgcactatacacttaaaaactaatgttctgtttttatccagtacttagtaaaggaattttcaaagaagtacattgcaccgcttgcacgatgaaaagacagcacaaatcaaggtacgaattcctggacacccctcatccaccatggttctccacagatgctacaacttgaaatcgggatgaacccgttttgtgacaatcaacaacttccagattggaacaatttgcatattccacttttacaagacagatcgcctggaagcaacggcagatgtcttgtgaaggcaatatgcatcggctacaacctgtcatcctcctgttatcgccaagtgactctgccagggctttctaaatatctccagcctgtttctatgtttattattagcgccctttatagcctttctatagacatctaattaccttgtaaatattgcacccaagctagcatgtgtgcctctcactagacaccagggtcgaacaacatctccagtgctgtaatcagttattttggtcgtagctatatgcaatggacagcctatgtgtatctgttccataccctttaatgccccgtcggtccttcgtattataccatccatggttcactagctgctcgatattttcgcgctgttacatactatgcgtgtgcaattatatgcagggtgcacaaaaaaaaaaaaaaaactcatcatgtcgttcctacacagatgcattgtgcacaggcggcgcgccaatggcgcgccccagcatctagtgcaggtaaaaccgcggggtgtgtatcactgcatcgcctatccgtttctaggcaaaactcagataatcacgttgcctctgctgcaagtcacgttgcctctgctgcaagtctgcaaccaagacttggcttgctgcaagaaaacagtatggctccctgcaaatatgcatccacaagagaacaagagatgcacatctgggaaaatgcctatagatcaacaagagagcatttttggagaacaaataatgcactcacaatagaaccacattggctggtcggtaggtaccacaaatggg

SEQ ID NO: 72468 - DNA, 682 bp, Oryza sativa
aaaaggaatgatttgccagccgttccaacatttcatcaatgaagggtagcaggaaatgatccttttttgtagccttgttaagtttcctgtaatcattgcgggattagttcattttgagcatttgcaacgaccgtcattcctcccttctttggcacgacctggactgggctaacccactcgctgtatggtacgggatagataatcccggcatgctagagtttcaagaccactttctttacaacctctcgtgttgcattattaagccatcgttgaggttccctggaaggagtactctcggggtcaataggaatacgatgggtgcaaagcacgggattaatccccctgaggtcttgaagcgagtagccatgaacagaacgatgcttttccaacatggtgagaagacgttgagtctcgttttcagagagcttgtcactgattatgacaggagcttctctgtcattgtgtaggaaagcatatcgtaggcctggaggtagaggtttatgctcaagcggaggtcgaggtgacggttccatgattggcaggtcgagagtctcaacgggatctgcttcttccttgataaaatcggggacctcatcttccagaagggcctcgggagactcgtgagtggggagctgcactaacctcctccgctgactcaatttatgggagggaatcggtcaag

SEQ ID NO: 72469 - DNA, 3718 bp, Oryza sativa
aaagatataacgtagctaaaaaatgcctcttggtcaataagcatgatactgtaaaattactgtaaaaaaaaatatatgtctaaatatgacagagactcaaaatcaccgcactgcaggtacaatggcaaaggtacataactatctttcactcttgcttgccttctctcaggatagatgcctttatttcatttgatgagtgactaaattttcagttagagaatctgggatacataacctaattttctgattcaccaataaacaatgttgcatcagatattgtaaagttgcacaacccattggcttccacggtttcgtccttcataaaagtatgcatttcccacatctaaagtcacatatacacttttattggcaataaactaaccaaggccgctctcaccttcggatcaaaagaaaaacagataaaaccctaattaacaccaattaaaatgcttaattcgttcaatataattcaaaatccaggttattttttttaaaaaaaagagaacagcatccaatcaccatgctgaaaaagtgaaaaaataaataaatttactgtatgaaatcaacaatgcaccacattccatcaatattaatcccagctacagcattttaatatgcattaattcggtattgtataactcatatccgatgttaatgccctcctttaaaaaataaaaacgacgcccctttttgatcagtacgtgtagacaccaaacattgatcttcccatatttcctccaccaaacaaatgtggcattgtactctctgatactgagagctacacaaaaaacccataacaggtgtaacttttttttttatggagtcgagtttgcacattgcatatacgcagttatgtcctagctcgatcaaattacgttgacgcaacaactgatgcagagatcagatcacaccaggaaaaggtagatcagccaatcccaatgaaccgagatgccaaacaggacgtttgctcacctgcgcgagctccttgtgcgcgtcggcgtcgagcgcggcgaccgtggcgacgcccttgaggacgcccgcggccttctcccaaatcggcgtcagctgctggcagtgcccgcaccacggcgcgaagaactccaccagcaccaccccattcgagttcagcacctgcacccccaaccgaaattcgaactcagcgagagcccccaagtaagggaagccgatccggagacggaagggaagagtgtgaggggggagtcgatcgagagaccttggatttgaagttgttggggttgaactggaggacgggagagccggcggagtaaagggcggaaaccggcgaggccgcgacggcggcggcgacgaggaggaggccggcggcgaccgcggggcgcatggcggggtcgagaaggttctaaaaggagtggagaggggaggaggtggaccttgcgatcggcgccggggtgcgactgcgattttaagttcgctcgcgaggaagacggacggacgcgtgtgcggaccaatggagagcctccacgtcggattcaccgccacgtcggagcagtttggctcgcttggcgtgaggggattggccagagagcgtggagtttgtggactcggagcaccgtgatacatcggatataactgggcccacacacgcttggaggtggtcccaaagttcagtgagcctaggctacactcagttgtttggaaacacgatgtggccattgtggccggtgtgatggaatgttcacgaatacaaattctcatacggccttgctagctcggaaagtccgttgactctccctcaactatactgagcctgattgtcatccctcaaccgtgaaagtgaaacagatgtatggtcttcctcatacatcaaaaccgacttattttacatgattttatcgacgggctgaacccacctatgagatatttgtaaagtataggaattgttggtaccaaggtatacgcgaaacttgagcaaaagagacagtagacatggatttttatacaagttcaagccccttaattgacatatctaaccctacttctggtgactgaaccagtgctgcctttatatatatcaatatcacatgagtacaatatttgagatgatctaatctattatctatcaacctaatgacgtggtgctctcacatgtgatcgacggttagcgtagtctggttcctcgaatatgaactcgatgagattggagatagctctagctagatcccttttgtcggcctatgtggctccatattggcttttttaaggcttgcctttggtatattttggtttgtcttggattggctagatccgtcttggcttgtcttcgcctctctcgatggtcttgtatttatacccccggatgtccccttatttaagtagaactagagaactaacggggtcatcgtttaacttatttagggaataagctaaacggtgtgtttgcaaacaaaaataatttgttaataaaaactgttatatacgtgttcttagcgatctaaaagtaaaggctagaaaataaaccacgatttaaaaaaccccccaaagtgaactccaaatttaaggttaaaaattcaaattttggcttataagcatatgcacaagcgaaaagataaggttgtaagtgtagatataatccgagtggtccttatcgtgccgaagcgggactatgtttctcttttcttatccaaaacatctaatgtatatgaggcttgattgcttataaaacttagtatgtggtaggcttcactgagcttaacacaagaattattaggtatgatttatccataacattgacatatttgaacagtggttttgtcttacatggcgcctacatggcatgttgacctaacttcgaacaacgtgggacccacatgtcagtaaccaaacatcttcttttctactacacacaccctccttactctcgtccctatgcaacagtagaagtagctggcaacaaggtagtgcttgagctcccggaaggtggtagtcgagtgctctctctctcctatccggtcatagagctcgaggatagcgatgggcggagtagtagcaacaggctagcttggctccttggcggcacaacatcagctactgtcaacatttcctcttcgccattatcaatccgccacctcgatctaggtactgcccaaggctctatgcctagatctaacatcgtcgtcgccgccaccgtcttctaggagagcttgagctcaagcttcgctaacgctgtctcctcctccctaagaagttgatagaagctggcgagcatgagctggaaaagctggcaaacctcctcattgagccattgtctctccttgcctcttccgccctaaggggaggcgatgaggcataggaggtaggcaagataggttcccgccgacacgagctcttccgctaagtcggcaacgaagaagggggggattggtgatgccgccattgccttgttgttgatgccaccaaagatgcaacaaggcatcagaaaaaaggggaggaaaaagagaaaacatcttacattaacacgtggagcccattgccttttttgttttttcccttgctaaatttgtcataatagtggagaaagctccaaatcacatttgacacatgcatacatgcaaggctgcgtctgtgtctgtagcatgcacgtagtgaggagaaaggctggcgcatgcatgcaagcaggagcaagcaagctagctgccaaaatggcatgacaaatcaatactttctctctcttttaatcaaa

SEQ ID NO: 72470 - DNA, 2371 bp, Oryza sativa
ctggtaattgggcaacatatccaatgcacacaggccctcacgtgtacatacgtgcacaccaactaaaaaatgtaccaaaaaatctagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctgtatgtagaatgaatttgaagatgcgactttgcacataaatgtaatactattgaaagtacatgtataaattttcctagaattttttgtgataatttttagttggtgtacacggtgtgtacacgcgagggactgtgtgtataggatacgctccctggtaattgatggttagtacatcccaattgaatgctaatggctgaaaagtctgctgcttgtgccaagtcttctaattagaaatctaatcttcttgctttgcttgaaaaatcattacatcggttgattttactgcggagaaatcaagcaacctttccatggtttttgctcccgcagcccgggccactgcccgcccaaaccgggcggtgaatccgccgctgcgcgtctccatctcctgactctgatggaagtatggaactgatcccggtgacggccgtttcgttggctgctgcacatggcctcgccttgcttacaaaccctcccgttgtttcaatcaacgttcatttcgaactttgtcgacctactgctattggtacttctgctggctgaaccgctgaacttgtgtactaccttcctccctaaatgtttgatgttggttagttcgattttgagccttctttaaacaacttaaaactcatctagacctcgaggagaatgtgacatttttttcaccttatgatatattagagtataaacttataggatgtaaatctttgggttattaaccttcttgcgtttgttcggtcgaattatgacttctgaactgagatccttttgtatctgttcctttggttcagatttcagagtagtatgacttgtaggatcgctactggatataattttttttagataaatatgacaagaacttcgataggcgaaataagcacacgctcgcgacacagatctctaaatctcctaccctagcttgcgttgattggaagggacggagagtttgaataatattgcatcattgcaagctcccctcgtttccatacccaaattctctgctccatggccaaaccaccataatttagtacatgagatgatgagaatgaggtgtatacaccccattaatccagcagttcgctcaagcacaagcaaagccctcatgtcttcagggtcagtgtcgagtcctacactcgtgcatggacacggtataaaacacaaacccaagaagccttgtatctcactacattctacatcccgttcaaggtagtagggtagtagtagcatttgctgccgtgatacgctctctgctgctccagagaatggcaagcatggcggtgttcttgctcgtcttgctggcagcgcttgtttccgtggatgtcgccgcggcgcattccggtggcggcttcggcttcaaggcgacgcttacccacgtcgacgcgaacgccgggtacacgaaggcgcagctgctgtcccgcgccttcgcccggagcagagcccgcgtggcggcgctgcagtcgctggcgacggcggcgaacgcgatcaccgcggcacgcatcctgctgcggttcagcgagggggagtacctgatggacgtgggcatcggctcgccgccgcggtacttctcggccatgatcgacaccggcagcgacctcatctggacgcagtgcgcgccgtgcctgctctgcgtggagcagccgacgccctacttcgagccggcgaagtcgacgtcgtacgcgtcgctgccgtgctcgtccgcgatgtgcaacgcgctctactccccgctctgcttccagaacgcgtgcgtctaccaggcgttctacggcgacagcgcgtcgtccgcgggcgtcctcgccaacgagacgttcacgttcggcaccaactcaacgcgtgtcgccgtgccgagggtctcgttcggctgcggcaacatgaacgccggcacgctcttcaacggctccggcatggtcggctttggccggggcgcgctgtcgctggtgagccagctcgggtcgcccaggttctcctactgcctcacctccttcatgtcgccggcgacgagccggctctacttcggcgcgtacgccacgctcaacagcaccaacacgagcagcagcgggccggtgcagtccacgccgttcatcgtcaacccagcgctgccgaccatgtacttcctgaacatgaccggcatcagcgtcg

SEQ ID NO: 72471 - DNA, 644 bp, Oryza sativa
ttgaggaacataatttaaaggcaaagttatcgacccttgcgtcaaataacagaagtagctagcacccggagaccaggaaagttaatatgaggcagttggtagcaagttagaagcaaatgacaagcatgatattcttatgatgacaaacatggtatcctagtaatgacgagctgatctcgacgcatgacatgaagtgggtaacttgtatgaggttgactccaaagatatgaactatgcgaagttctggaactgaggccccatcttcaagtgccgcaacccagtcgaagtcagctaaaggttcaaccagggacaagtcaggtgaagagaagactccatctgcaacaggagatcgagccaagcagtccagagtggagaagttgtgctaggcaagtttgttataaaagacggagcggaagaagtcagacaagaagagaggaccgcccaacctatcttcttgctagcctcctcgaatctcggggacgagattcttgtaaggggggtggatttgtcacgtcctgataaattcattccgaaataaaattcattttctaaaaggaataatagaattaattaaaattcgaaaagaaattggctaacactaaaatacgtacaagaaaaattcgaatgtggcccgggaatttttg

SEQ ID NO: 72472 - DNA, 4496 bp, Oryza sativa
  unsure (1)..(4496): unsure at all n locations
gagaaatccggccgcctcccggcctcgtccgtcccttccttgcccataaaaagcctcccctgagactcctctctcttttcccccactcgccgccctctcccgtgctctccactgcgcccgcgtcgcttaccctgccgtccgccgctcgctgcggagctccggccgcacgccgtcgcagctagggccgccacgctgtgcattcgccgccgctagcttcgccgtcgtgggagctatcctggccgccgctcggttgcccccctccgccgccgcaccgctctccctacgccaagccacacgctgccgcttaccgccgcctccaaccaccgctagccatcgctagtgccgtcgccgcgccgctccgttgccgccgttggccttgcgaggtcaagggccggctcgtccaccccgcgcaccccgccgtccgtcgctcgccgtcgccgttcgttgtcgcctccttccgcgccggccgaaccctggtgaggcaccccctcccccgtttttcctcttcctctccctcctagcgccgagccgcgccgccatcgtcgtccggcacttcgccgccggccgcccgtgtcgtcggccgctcgtgtcgccggccgccgccgtcttctcgccggtcatggccgtcggttgccgattgccgccgccacatcggctaaccagccggccggtttgaagccgcgccgagccgaccgggcgtctccccctccccttgagccactgcccggtggggcccacccactagccggtgccacctcctcccctttgagccactgccgagtggggcccgcatatcggcgccgcccctccccttgttgatgtcatccggggttatttattgcgcgataaatctatgaaggccttttctttattagtaaaaacacacataatcttctaaaattcatatctaattcatccgagctccaattaagtccattcaagtctcagtaaattcataaaaatgcatagaatccattaaaaatggttttgtttcctgtttcagtagacttatagcatgttttgcttgtgtgctttgtttgtcgcgtagatttcggccgtttcgtcgacccgcggttcctcgaagacgttgctgtggtctcatcagtgcgagagcaaggcaagtcatgcattataattgatcatgctgtacccaatttacaaatgtcccgcatttctaacaaatgttgcattattttacaatatcatgtgggatgggtcctactactcagccatatattgtttaccttatgccattgataacttgggtattaaaatgattagatgttggattagggattgcttagccatgcttagttcaactagtacacaattggggaattacattaatgcatagactttgattattggtatagctttggattagtgccaccgcaatggtgttagttaattaatatacactacatggtgggctgtgggtgcatggttttgctagtcgtgcccatggcgattaaggaccggttcgcgggatgccctggaagaatttatcgtacttaccacaagccaacgtgggcaacggctgggcttgtagtgtagctttcctctagccgacgtacccaggcgagggtgggcgtgatggagttgggtcggccggggcgtccgtttgatcggcttccggattcaccacggcacgagaggggggctgcccgttgcctgctggggacggggcgaaccctgaggtgtggtgcgatcagttagaggggattatgcgaagggtcctgtcacggcctctttccggtatgtcgtggtggcatgtcggtgcacggaaacgtgtcatggggctatcttgtgggtacagttgtacacctctgattagagtaaaactattcgaatagccgtgcccgcggttatgggcggtcgaccagattcaccatgattagtctcaccctagttagctattgaactggtgtagttcaggtggttggttgggcctgttgcaacgtggtgtagcgttggacagtgattggttaatattgattaattactacaactattttactgctttcaactactgtttttaaatgctaggggtatgcaaaagaactttagcctcccttggatatatcctgtatcatacctcctcttncggtatgacttgctgagtacagtgggtagtactcagtcttgctctcttttcccccacactagagttgaagttcttctcagttggagatgtctcgaagaagttggtttcgtcgttgccgtcaaggatgcctgtggaatggaatcgcccgctgcaggagtcaagtcttcaggcttagctcgcttttatcttttctgctgcatttgtaatcttttatatttttgtaagacgtggatctgtatgtcaacaattgtcgtttgtgtaccctggctggccctggacaggggtttaatacacattcagcttagaaattctggttcgtgaatttctgggcatgacacgtgtcagggacgccgcgatgacgccaaacccttggatgaaacgccgatagtatctaccaaggccgaggaaaccgcggaacgcccgcaccgaatgaggggtcggccagtccaataccgcttggactttctatttgtccatggagacgcattccccggagatggtgtggcccaggtaggccactgatgtgacgccgaaaaaacacttggagcgcttgaggaagaggcggtgctgctgcaacaagaacatcttgtaagtttcaacacttctttcaaggagggacatgttatctataagggcaaaggagagcccgggtcccaagacaagctaggaccctggcctccttagccttcaatcttaagatgtagatcttgtacatttccacgctcctctcaaggacgacgtaccgcttgaggttctggttagatcaatcgaaactaaccgtggaggctctggttgatcccttttgatgagataaatccaatggcctaaaatagcaggtttaccaatttaaatgaaaatcaagggttagatgtttttgtttcttgaagtttaatcggacttttagtatataagagataaccataattgcaacaaatagtacaactagcacccatgagaaaaaacatttggtcattaataaaaacaaaaggagatcaaatttcatagaaaaattaattccatatgttaccgaagatctcagtatagttttataccccaaagttcaaacatgcaaataaaagtcctcggcttttgtccatgcaagcaagtcttaaaggaccacctagatgatttgggataggacataaacggcttacggatgctttttctttaggaaaaaagtatatagttagaaagaatctttaagcatcataaagattattaacattttaacatttgaaaaaaaaagatgcgggcttctctttaatataactttgcttgctagctactaccctatatgatttgcacagacaacaatctgactgcgcataaatttgtgcgaaaattagttggtcataatatcaatgatatcaaaccgtggaaaataagccttcagcctctgcgttgctaaagttatgcttgacaagaaatcttctcgtttcttacaagtaatatgcccatgctaatagtaatatgcctgtgctaaattctacggtgcaattatatttgtctttaataatttttcaaatttcatgttagcaaaaaatatttttatatgatgtgcatttgaactttaattcaattcatatcatacatcaaatatatttcatgtaaagttctatatgatattgcgtggggaccataaaactttacaatacttaattatatataatcagttcagtatacaatataaaagggcaatatacgcttaaaaatatgttaaaaatatagaattattccattatttgttgcagccacaaaataaagcatatgatacatatatagaatataccctgcaggtaaataactatcctaatgtttagcatttgcagtacacttaagaaattctcgtgcgccgctaggaatgttgctttcgcactcattttgctagtacatcaatagatgtacaaaaattgttgccttaggccgtctatcaactactgtagactcatcgtagaaactacagagaagagggaactatatttgtgagcgttggatgccaagcgtactttagattccttcatgtcccatctagagttgatttctctttggcggtctatatgccttatctttttattatacggtggaaataaaggagggctcggatcgagattttctgtgcgatgtcaagcaccttttttttggataatgtcacgcgtctcttttaatttttgccacatgtttgataaatagtttatttttggaatttgtttgtattcatattaaaacggatagtccattttaattttttttttatatatgtacgagcatagtatactttgtgatgtgtacgcacaaattatcgcgtgtgtcggaggtggcttgcggcaaggccctagatcctgattccaccaaatccaaccgtcgtcgcctccatggcggatttgcggaatcg

SEQ ID NO: 72473 - DNA, 699 bp, Oryza sativa
acttcatgcacaattttacaatattcacttcgttttgagtcctgcttcatggatgcttttgtttgtttagtcttccggaaaagtgacctcccaaagaatggaaacccgttgtgccaaaggacacattgtgaattgtgatcactcgctgttggagtattttggttgtttcagtctttcagacaatacacttcatctgtcacaatcagagttttgatagaaaaagaacaagaaagcagagtactctgcattcactaatatacgcatttgactagcgtaatcttgtttctttggtgtactacctgaaggcatattcctattataagactgaacaacatcccgcttcttcacaccgacatggagccatgtattctgaacaggaacaggaacttccatcttgattcttgaatgtaataactgtagttcatccaattagtatcatgatctggccccttggaatgccatggtcacaggctcacagcccacaggatcctgcaccacacctattctgtctgctcctctgtcaccttacaatattggtagtcttgtctcacaccaaggtccatagtatagctagcagccagctccaaaattttgtcatgttaaaatagagctaacttaagagacaactcatcccacaactaactaccagttacctataagcctgcttggctcaagcctacctatatacattacatagtt

SEQ ID NO: 72474 - DNA, 3930 bp, Oryza sativa
cgatatatggtttaaactttaatttgttctctagaccgtatgaatatggattatacagtctatatgtcttatctttttattatacagtggaaataaagaatggggctctgatggagatttcctgtgccatgttaagcacgttttctggataatgtcacgcgtatcttttaatttttgccacgcgtttgataaatagtttaattttggaattttttgtattcatattaaaacggatagtccattttatttttttatatgtatatgagtatagtcaagggcggatccaacgtgggtgcagagggggactcgagtcccccctacacccacaagacccatggataccctctggagcacccccttcaattttttcatcataaatgataaactaaaggtctctagatggctggagattgaataaactatgtaattgagcacccccaatttttttgttcctggatccgccccaggtatagtatacgttgtgccgtgtacgcaaaaattatcacgtgtgattttttatataactgaatatcgccaatacttgtataatcagacatggattttgaccactttcttttacatatttgccaaacaaaaattatatttctaaaaaacaacaatcatgtgaattaaactgagtacatgcaggaatgcagaaccatttaaaggtcgtcctcacctcaagttgagaccaccctgaagctcatccctcatcaaagttacgcaaatacataatccaaatagcgtagttaatgagttaattaatgcacttattatatggttcatatagaccaattcaaatctaaatttcaacaaacttaacaaaaagaacacttgtacataattttaggtactgccatccaaacagaattcagttgtcattagagaatcctagaagtaatatttagtgttgtcgtgtgctgcacgttgatccatttcaggttgttcacataaagcaaaaatgttcggtgataccagagagtttcaggcctgctgtccagtaatttgaccatatagctggatttatactaccagcagttagcgtgggctctaatgacaaacataatgggagagttgtgcgggtatatgctgaacataattttcttcaagcgacaacaacaatatctactgtactggatgaatcatttagaatgcaaaacatcagtaaatagttaaactttacaggagcacaggcagattccatgaaagcaaatttggagagaaaccggctagggtttaggcggatcaggatcagtgcatcgtttgagggtttagtgtgatgttgatattcccttggagatgaaacaaggtattcagtgttctgagatgaaacaaggtattcattgttcatctattagcatttaggatttacctagctagcatggcccatttagtagccacttctgcatgtatgaagcactgtgaattgcctcaagccaaatgtcacaggctattatatacatttttcgttgtttgtattaacatcatatgataactacaaacatgtgatataattattatttccgctacaattatttaatattatcttactgtttgggtttaaattggtgtacaatttttacatgttgcaacccaacgcgcaggcatttgtttgctaacatggaaatttaagtaagacaatagaattgcaccgtaggaaattaaaagttattgacacaagagaatgtttccatgcctcaccttggagagagatggcagcacgcacgatgggcaaggacttggcagtgggtggtgaatcgtggcgtgagtacggatcggaggcggaggcggaggcggttggttgtcggaggagatcagtgagccgtgacgatgatgacgatccactctgccggccgaggatcagttactgccaacatgatatagttactaaagacagccattcatctcaaatttcatacactctcacggctataacctggcaacttgacagtacctgtgatagagatgctcacattcaaaatgtagcaagcatcagaaaatgggacgactaaatgtattatgatagttctgataaccgaatagctctattatgatagttccgaagcacgcactatgtcgccgaaaatagaagaacagagacaaatttttctaaacatgtaaattataacagcaccaccaaaaatagaagaacagagacaaatcattcagggtaaattaccattgattctgagatggcgatcgttgccaataacaatgaatcattgtgtttactgcattagttttttttcctaaacatgtaaattatgtcagcaccatattattgaatgtgacgacgccgaatattggcaccatattaaaattgaaagatcgacggcgtcggggacatatgggaagagaggtgacatattagggatgggtgaggggatctgtacctttctgcggcggaggagatcatcgtcggtggcgatgctgatcggttagatgggcggaggcgcgcgagcagcggggaaccggccggtaactgtcccggcggcgcagaccgatgcgatggtcggaggggcggcgggcggatagggggtggcctcggcgagcggtgggcggagggggtggcggcggcgagatggagcgcgtgattttgctgggggaggaggggaggcaatccgatctggatcggatccggagagtggtggggagccgttggattcgagtcatcggatattttcgatcgtcggatgtctaatgagtaataaaatcatttgttactatattatagggtacatgtcagaggcagccagcagcaagcatgtgatggagaacaccggctacgaagaacgtgaattgattccaaagcatctagcacagaagaataaataaagggtcctccgtgacaagaatatggacaaaagtaaaatttgttaacagagaaaggtacctgaaattaattaaggtcatgtttggttggaaaaaaattttaccccgacatgtcacatcggatatacggacacacatttgaagtattaaacgtagtctaataacaaaacaaattacagattccgccagaaaattacgagacgaatttattaagtctaattaatccgtcattagcaaatgtttactatagcaccacattgtcaaatcatggcgcaattaaacttaaaagattcgtctcgcaattttctggaaactgtgtaattggttttttttgttagcaaatgttttgttgttggaactaaacttagtttccaaacaaaatttttcacgctgtcacatcgaatgtttggatacatacatggagtattaaatgtaaaaaaaccaataacaaaaagggttaagtccgatttaccccctaaactcttgcgaaagtacgctgtaccctcctaaactataataccagacatattacccccttaactatttaatccggacacttaacccccccccccccccccgcgaccaatttcggctggttttaccgtttgatccgacggggcacacccacgtggcaaatgatgtggcattaacatgaaaatacccctaccctcccacacacacactctctctccctttctcccgtgaaaaattccccaacccaaacccctaaccctagcggtgaaggcgaagcttggcggcgcggctgcgtggtgaacggcggcgcaggtgaggctctgcggcgcggcacgacgctcgcaaggcagcgcggcgctgcgcaggcacgatgctcacgcggctgtgcggcacacatgcggctgtgtagcaaacagcgctcgcgcggcggcgaggcgcacgcgcggcagcgcagcggcgcggcgctcgcatggtggagcggcgcttgcagggcggtgcggcacacacgcggcggcgaggcgcactcgcaaagcttcgatctgaatgcaaaggtgcagatggaggccaacgctgctaggcacaaggaacatatggaagtaatagggaagcaaaaggatcctggaa

SEQ ID NO: 72475 - DNA, 1219 bp, Oryza sativa
  unsure (1)..(1219): unsure at all n locations
cacacactgtttagtagttcgaaaaaagtgcgcgcaaaaaacaaaagacgtgagttgggaacatgaagtgccaaactcagcatggacaattatgcatacacgcttttcaaactattaaacagtgtgtcttttacagaaattttaaaacgatgctattactacgacggcggtgcccctccccgtcgaccgcctccagatcgatgccgccgacgcgatggcgcccttgccctcccactacgtcacgagagagaaggtaaagagaaggggggagaaagagaagggatagggagggaggaggaagaagagaaagacagaggatgacatgtgggcccacatttttttcgagtaaatgacatatgggacctacgaatattttctaatgccacataaacgtcatgtgggatgaagccaacaacgccacgtcagcaaaaccgccctccaaaaccactgagggggatcaaattgcactggtttgaatagttcggngagtcgtcctatccggtttttgcgattgagggtcacggatcagattcaggttactttttaagggagccaaagtggacttattcctagtctgatagtaaccgactaaccgttgctttctgggccgtgttgtactggagcacaggttatgacgtgcggaggcccaaagagttttgggccgtgggggttgcttatcttgccatccttgacgcgcgctgagctggcccagacgcccccagttccccttttttgatgctttttttttaacgactcgcacgagacggtgcgaagttctaattacaagattataaccctggagggtcgtaaccaggaaaaagaaaaaaacaacaccacccacacaccgacatcgccaacacacaagcccaggagaaggctagcaccggaccggccgccgctaagcgtgaccagccgccactagactaacaaagggacacagctgagatcgctccctaggggatgccaaaacgacgtcttcaagaagagaagcgacggaaaaaccgccactgccgtccgtcgggactcaaaggagccaagactaggctttcgcccggcaatcgcccttgaggggtgagacctacggctgacacaccgatgctccaccaccacacaagctctgccgacatgtgggacccctgcaccggcgtcccctgccgaccagccttcgtgcgccgaagatcgcgccacacccaccagcagcttcttctcacacctaggt

SEQ ID NO: 72476 - DNA, 1189 bp, Oryza sativa
aacgtattcccagagtgatccagtcttattttttccagttcttatcacgcaggaaattacaggacacaatatctgctgcaatttgatggtgatgttgttgaattaaaatttaggaacattaattggtttgagttatctagctaggcagaaatttggggtcgacaaggacaactagtgatgatcattgcgttgatctttctgtcttccagagattaccaaagcatcgatcaatgtcaacgcatgtgctcgtcagtttcacgaacagagtcatcgattgctccaagtctgcatactgtacaccaaattgatctcatcaacgacatgaaccttggattctacctcaagtggaggcgctaagctagcatgcatccttctgaaaccatcataggcatcgacatttgacgtaccaatgttcatcattttactcgatcaagacaacatatgattagtagtactgctgcaattacatatctgaagatttttctgaaaatgcaatgtcagtatgcagcgcactagtaaactgcagtctgcagaagaacacacatggaacataaatcccagagagaaaacgatctggcgccttgaagtggtgcaacttgtggtagtagtttttcgccgtgtaaatggcatcgtcgatcaattcacagctgctgcgtgagcgaagtaatgaggctagctatagccgtgtccctgcttaaatgcgtcggcagttacgttcatgtcctccggtcctccccttgttctgactgtcagagtgacagtgctcacgtttactaccaccctgaacccagtgaatactagcattattgctacgtacagtactagcatagtaccacgatgcagtgcttcacaaatcacaatatgcatgcacgtacagtttctgaatttcatctccaagatctgcatgcatggctgttgatataagttttcagagaagaacacctgcagcaattaaatccgtgcaatgcatgggtgtgatatcattttcatgtaaacatagttaagaacttgatgagatcgagatttgatgccaatgcagaaatgcaaggtgttgaggtgcataaaactgcagggtagcagttgattcagagtcagtgagaactgagaaaatgagaagctcgcagcatgcgtttccccgcatgagcagcatgcctgacacacatatacactgctcactgtctacaaaaac

SEQ ID NO: 72477 - DNA, 1499 bp, Oryza sativa
gctattcgaatagttttactctggccagaggtgtaccactgtacccacaagacacaacctcaacatcatgtcaaccatgcatcacgatacttatcaagtacccgaatagagattgtgacaatacccttcgcataacacaattcaaagcagtgcaccgttcctggatcataatcaccccttataaaacaaggcatggactccccagcgacccccgtgggcttatctccgccacttctcagtctggtgctctacaaagaaccacactctacaaaaggtaaagccgttgcccacgctggcttgtggttggcacggttaatgtttcacaaccgaaactcgtgaaccggttcttaattgtcatgagcacgaccatcaaaaccatgtgctcacaacccaccattactatgttttagttggcatcttaattaatcaacctatcatgattaatcatcacgagctactattaagccatcattaagtaatagtgaatcattaattatcccattcatatgagctagtgtctctaagcatggctaagcatcctaattactttagctaaaaccatgtaatgttctagctaatccaattattaaccaagtgacaaagtataggtaatcaataacaaaaggctataacaaaggcaataggttattcccacccaatgacattcaaaaataaatgcaatagttgaatagaaacaataggttgaaacgggatcaacatgctcaaagggttgtttgggatctgtgtgacttgccttgctggccttgaaactcttcaaagtcttctcctgcaaaatcggactctccaagaacgtcggaatctatacataaaaaagcaaaatcaccaaaacagtacataaacaatcataaacaacacatgtggatatttttaacatatatatctcgattttacaaaaatttagagacttgaaccaactaaatctgagctaagatgaattagatatgaatttttgaagattaaaccggattaaatcatttatttagattttaattggattatgacgcaataaagaattatttttgaaaaggaaaaaggatttattgtgtcagcgggctcgggttcacggtggaccgggtgcacggaaacggtctacggaacgaaatggacggccgagatctaactgatctaccgcgggtctacgactgacgtggcgctgacgtcgacgatgacgcatcaccagcggcggctcggcaccccgtgctcatcggcgaacaacggcgtggcagcgcaaacggagggcatctacgcgtagagggtgacacggcgaactaaacgagggctcggccgacgacggacggcaaccgacggcgacggagggagttcgaccgatgtcatcttcgccgaagcatatgccaggatgtgattgcccaccgtagcccttaccccagcaccagcctcgcaccgtggtttcggcggagaagcagttcaagttctaggccaagcacaatttctggtagctttcggcacaggcgaaaaca

SEQ ID NO: 72478 - DNA, 10652 bp, Oryza sativa
cgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgagccggccgccgtcgctgacgtcatgctgacgtcaaccttagggctgacgtcattgtttccagggctgacgtcatcatccctttttccttttcctttttccttttttctaatagatcaaatctttggaaaatcataactaaataaccgtagatccgttccaggtggttcaagttgctaaattcttctaaaataaagatctacatattaaaattgtccataaattgagttaaatttatttaattctttttaaatgggctttaattagatttaatcttgtaaaattcataataaattcatttgaagtcagaatgaggccgttcaagtctcataattcatctaaaattatgatctacatgtttgtttactttttatgtactgttcatttggtttttattagtctttttcttcgttttgcgtgttagcttgtcgtttccgtcgttgcgaaggttcgtgagtgcgccggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgtcatatatatatatataattgcttagcaatgcttagaaacattagctcattaatgggatgaattatatacactacattattattatggttatatttaatggcagctcacgatggtcaatcgtgattggttaattaattatttgccaattaaaacttgataatggtgggttgtgagcacatggttttgatggttgtgctcatgacaattaaggaccggttcgcgagctactgttgtgaaacattaaccgtaccaaccacaagccagcgtgggcaacggctttatcttttgtatagcgtgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacagcctctattcgggtactttccagtatcgcgacgcatggttgacatgatgttgaggctgtgtcttgtgggtacagtggtacacctctgatcagagtaaaactattcgaatagccgtgcccgcggttatgggcgagttgagcaatgtttttcgtgattagtcccacacctctcacaatagttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactgttttacttctcttaaatgttttgctaaatgctgcctttgcaaatgagcctatattatgccatcctttggtatctttgtgcacttgcatatttgctgtgtggcttgctgagtatgtcatatgctcaccttgcaataatcaatcaacctcagttgaagaaaaaggatccagaaggagaagacgtttggcttaggcttataccccagttgagctgcctgtgggagtggagccggagcttcgctagattttattttcccgctgcagttttcttcttggtgaggactaagtgcctcttaagtaagtatttatcggtttagttattatgatggatttgtatattaaattgtcagtttgtgtacctcggctgattcctggacgaggattttatgcacaaatcagttcggaaattattagtgaatttccgggcgtgacaagttggtatcagagccatctcgactgtaggataagccaaatggtcaaaccttaaggactaattttccgaaaacataatttgtgaaagtttctcttttcttccttatctagaattcttcgcaaatcgttttgtcgttctctcctcttttccctctttcaacgtgagtagttgttaaacttgatggagaaactcgaaggcgtcgatgttgtcaacttctgcaagtaaagtggatcgaggaagaaccgaagtgcccagatatcaagatagagtgaagttggatcctagtttagaacctatgccgccaaagtgtctttgaagaatagttagtaggatagaacgtttgttgcttgcttgtgtgtaggtatggttgcattcccgtcattggagtagtccaatgatgagtgtgtaactatactaggttgtttgcttaatcaacttgaacaatataatggtttacacacatcagatcagtgttaaactggttaaggtcttgtctttagtgtaacccctctccttctatcttctctaatctgcaacagatggtgaacactcgcactagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccacctactttttctagcactaccaacccagtggaagcaggtgattggctgcacgctgttgagaagaagttggaactgctccagtgtacggatcaggagaaagttgttttcgcttcacatcagttgcaaggacgtgcttcagaatggtgggatcatttccggatgaacagagcagaaggacaaccaatcacttgggcggagttcactgaagcattcaagaagacgcacatacctacaggagttgtttctttgaagaagcgtgagttccgggcacttaagcaaaaggatcgtacagtgacggaatatcttcatgagttcaatcgtctagctcgctatgctccagaagatgtgcgtactgacgaggaaaggcaggagaagtttttggaaggcttaaaggatgagctgtcagttatgttgatctctcatgactatgaggattttcaggagttggttgataaagcaattcgactggaagacaagaagaacaggatggacaatcgtaagagaggaaggattgttttccaggaggcacaggatagtagccagaggtagtgtatcaagccactccaaattggtgaatctttttctgctggtcaaggacagtcacaacagttgggcatcagtggtgagattaactcagagactaatgcaagcaatgaaggcaatgatgagcaagctactcaatcagtgtcatttcagcaggatcagtctcaagaagataacagtaatggaagggagcagcgggtgtgtttcaattgttatgagccaggtcacttcgtaaaagagtgtccgaagccgaagcgtcaacagccacaaggccaagtcaacaacattgtcctcacaggagcaaatgcagtgccggttgtgtcttcaagtgttacaactcagccactagtatcaaagcagcagtagttttctttaaagccttagaataattatcgaagttatggaataagatagactgcagtttatctatgccctttttctttctagccgttccgaatctcgggacgagattctttgtaaggggggtagatttgtcacatcctgattttcgtttcaggatttataaattatttaataaattattaatagaatttatattaaatgttctttaatttacaagtgaagttaaatgtgggaaataaaatttcctaaataaaaaaaaagcatggatggatttaatttttattaagtcctccatgattaattatactctctcgaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatccggcccaactcctctctctttctctctcttcccgcgcgcggcccacgccggcccagccgagccgcccgctcctcctctctccagccgctgacatgtggggcccacatgtcagggccgtcttcaacctccggccgccgcgccgccgaagcccgaaccctagccgtttttgcgccgccgtttccggccgaatccgaccccatctcttccaattgattgaggggttttgttcctctcggtctcctctttcttttcccccaagaatcaaagcaaatggttgaggattcgatccgaatcgaactcgttttgttttatctctaaaaaacgagtccgagttcttcccgattcgattcctctcgtttgcgacttgatctcttcgattcgagctcatataaaccttccccgtgatctcctctttcgtttgccccctttcctgagtcctcccgtgcctcctagcgccgtcgcgacgagctccaagtccgccgccgccgccggccatcttcggcatcgtcgcgccgccgtctccgtcgtcgctgtcggtcgccgtcaccaccgttaggtgcgccgtgaggagaagaagctcggccgcccctccgtttttgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgaaagctcggaacagctcctgcggtcggtggagtcgaaagcgtcctcctgctcgtcaccaggtccctctgagcgactcctggagcctggcagatacgtctcgccgctgcctgactgcgagccactggagctgctgctgctgagatcgctgctgccactgggagtagcagacaaccaacccccggtgccactggctggacctctggcggctgacgctggagcgaaggagagagcggacgcgggagctggagctggagctggagctggagctgcaggaactgcgggcagaactggaggtgctgcgggagctgctgctggaggtgggtttctgggcgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtccccacgtaaccatggacctccaagcggacacggtgaggaagctcgccactgagcggtggaatggtcgtgtactccggcgcgtcggggtagcccaccaccagtgtcatgcgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagggaatcaaataagagcagaattttatgcatagatcattttacatgagagcgaataaataagacagactcacataacgataaaataatgagaaattagatacataataataataacgaacaaagcataaataccttgcaacccatgttacagagctaggacctaatgcattgcacccatcaaaccccaactaactgacgaataaatcccaataattttactaaaaccctagactgactcgttttgaaaaatctcacttaaacgagcgaccaagatttttcccttgaaccacaagaacagatccccattttcccggaacaaaaccaattgcaaagaacatatgcaatgacaaggattcagagggctcttaggtttttccatttggcttgtcctacggtcaaggtcggctctgataccaacttgtcacgcccagaaattcccgaatagaattccaagcagaatgtgcaataaaatccccgtccaggaccagccggggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaacagttgtaataagtaattaagcagtattaatcatccactgtccaacgctacaccacgttgcaacaggcccaaccatccacctaaactatccaaattaaaggattacactaaggtgagactaatcacggtgaatctggttgaccgcccatgaccgcgggcacggctattcgaatagttttactctgatcagaggtgtacaactgtacccacaagacacagccccacgacacgtttccgtgcgccgacatgccaccacgacataccgaaaagaggccgtgacaggacccttcgcataaccccctctagccaagcacaccacacctcaggtttcacccccgtccccagcgggcgacgggcagtcccctctcgtgcctaggtgaatccggaagtgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccagagcggtggtattaaaccaacattatcatataaacttatagtctaggttttaaatgagattccccattgtgtgctagttgaactaggcatggctaagcaattcctagtccaaagtctaatcatgttataacccaggctaacaaaggagaatgatatccaaaagcatggctataacaataggtaaccatcccatagtactattataaaacaatgcaatatttgaaagaaaacaatagagcatttgcaatataggatcaacatgttcaagtgacaagcatgacttgccttgctctgctgctggagggacctcggcgactatctcgaagtacaccgaagcgtcggaggaatcggaatctagcgacatacaaagcaaatattgcaaacaggctataagactactgaaacagagaacaaaaccatttttaatggattctacacatttttcttgatttactgagacttgaatggacttaaacggagctcggatgaattagttatgaattttagaaggttcactgtgtttattactataaaagaaaaaccttaaacaatttattgcgcaatattaaccagggctgacgtcagcacgggcggcgcggcgccgacatgcgggacccaccggtcagcggcacggggaggacagaggaggcgtcggcccgcgggcccaccggtcagcggcacggggagggcggtctaccgtggaccgggaccacgcaggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgctggcgacggcaaccggcggcggaggcgacgcgaaagcggcggcagcggatggcggcaacgacccaaagcgacggcgagcgcgggcggcggcgacgcacggggaaacggggaaggagaggagaggagatgcctcaccgagggtggccggcgcggaggaagacgatggcgaatggcgacggcaagccacggggggcgacggcgaccggcggacgagctccggcgtgccctaaggaaggagaagggagggattagagagagggagatagaccccggcgaccggcattcgaggccgaaagcggcggtagggtttagaccctatcggagcgcgaggagacgggggttccggcggcgaacctcgacggggaaggggcggccgaggtagatctcgaccccgcgaacccgacggcgacgacggaacggtgcggcggcgaccctagcggtggctagcagcggccgaagtagcaaaaacggcggcggcgggtggttgcacggcgcgggagcgttggggggctcgggagaggtcggcgcaatggggaaaaagagagagggggtgccggcgatgcttaaataaggggagagggggccggacgtggccgggagcggcgggaatcaccggccgacgtgggggagtggggaggagagagaggcgggattcgattttcgaatcccggccatctcgggcgcgggcgcgagcgggagagagaggggaatgggcgcgggggatgcggcgcacgcgcgggcgtggtcgacgtggcccggggaaggcggagacgtgggcgcggcgacggttgcgggcgcggcggcgcgccgggatcggcgggaggagggagacgggcccgacaggtgggtcccacctgtcggcgaccccgggagggagggaggcgggcgcccggctgccgggctgggcctcggcctgcggccggcccagcagagaggagggggaaagagaggggaaatgggccgacggcccatttaacaaaaaaggaggaaaaagaggggaaaaagaaaaagaaaaaggaaaaaggattttccctggaattaaaaattgcactttggtgatttttaattggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaatttggcttgggaggaaaacttcggggtgtgacatcagcgcaccttcagaggcggacgacattcctgtcccactctgcgagaaggactcgaccgaacgcgccgccgcgattaacgtgagtgtactcgatgattcctttacatctttcttctcgagatcgcgttgtgacttcatattgtgcaggctctccctctgacggacgccatcggaccactcgtggatcactaggtggtgacgtcgttgaaggagggcgtcaccaaggaggcatcagacgctgttgctgccaccatgtcacgactggaaataacccaacaggcattccttatgtgcgtgcattattccttgtcccaggaggcaaggtacaccaaaagttgatacaattcagagtttaacaagcggaagcgtaaataattaatttattacatgggcggcgaaggcccagcatacacaaagacaaacgggaaacagcggaagactagggcgatgaccacaggcgcttaacggcaggcacgagctaaacaccaaagccttcatcattcaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttgtaaatacgatcctagagctataccagattattaatgagggccgtcaacccacacgaatctgccttaacccaaggcctacgatgattcag

SEQ ID NO: 72479 - DNA, 34973 bp, Oryza sativa
tactccttttagtgatcaactgaccatcactgtcctcttcaaatgaatcatttgcactactgtcatcataaggtgttgcatttccatcatcctcaatctgtactagtgctttctcactcctctgactagctctttctccacaaaacacatcatcgagatcagcaacttgaccatccttcagcttcttctgaaactccttaaatgatttcatgatctcatttgcttcctcatcctcctctgaagagcagctgtccctacctaaataatcactatcagaatcagaatcactttcagcactataaggaaccaactgatcactatgtgctaccatttgtgcctcttccttgtccttcttagcaagattatggcactgtctcagtgactcaatttgtccctgagtcttatctggtattgatgttactatcataacaggcttcttccctttagtatccacttcaaaaatttcagcagcctcctcatctgaagaaatttcttcaatttcatcttcaaaatcactgtcattatcacttcctacatcttctacatctgaactgtcttcttgtgcaacttgtgtctcaacatatatatctgcaacctctgcttcactagtacagtctgacatcagttggcaaacattatcgtccaacaaaacacaaagaccatccttcagttctttcattgggaacaaccaatgcaaaagcattggttcctcaactgcacaatggtcctttagatggcccttaacctctggcaacgaaactttgtcacggtcaatgtgtgatattgcttcagatccaccacagtaatgcttttgcctaccatcgtatatgaactctccattataggggaaccatacaaccaaaaagttctgaacatccatcgcaaagactctacaaccagaaaaagcaaaccactaatcatccatccacaattaaatactcagaaattgataaagtaagctcaacatcccactgggcagccataaacaaatcaacaaatgagagaatcatatgagcatcccaatctcactgtcctaaattgacaaataaataagcagctcacaactgaaggccgtgccacgccgccgcacgagcgttgtttgctgcacagctgcgcgagcgtcgtgcctgcgcagcgccgcgctgccatgagagcgtcgtgccgcgccgcagagcctcgcctgcgccgccgttcaccacgccgccgcgccgccaagctccgcctccaccgctagggttaggggtttgggttggggaatttttcacgggataaagggagagagagagtgtgggggggggaggggaggggtatttttatgttaatgccacatcatttgccacgtggatgtgccacgtcggatcaaatgggtaaaaccagccgaaattggtcgcgggggggttaagtgtccggattaaatagtttaagggggtattatgtctggtattatagtttaggggggtacagcgtactttagcaagagtttaggggggtaaatcggacttaaccctaacaaaaattatggaccctaatgagaagtttggttgtgttcttcctcctaattttactcgtatctctatcttttgttattatggcattgtttagttcccaaaaacatcacatcgattctttggacacatgtatgaagcattaaatatagataaaaagaaaaactaattgcacaatttgcatgtaaatcgcgagacgaatcttttgagcctaattagtccatgattagccataagtgctacagtaacccacatgtgctaatgatggctcaaaagattcgtctcgcggtttccaggcgagttatgaaatagttttttcatccgtgtcaaaaagaccttccgacatccggtcaaacgtccgatgggacaaccaaaaatttttatttcaccaactaaacaggtcctatgttaaaaaattgggtttattggatatgggttataaggccctgcttatacttggtcaacaaaagaggagataaggatgtgatctatgaaatacttgataaatgcttggctaatgttgaatggtgtgataaattcccgaacaggacgtgcttatcaccttcccttacttttatggggaccatgctccaatttttattctgcttaatcccaattgcaggaaagttggtggttaatgaaggaagagtttgaagaatatgcaatcaattcttggaataagtttaggaattgttcttttgtcaccaaaaccaaatttttgagtaccagtctatccgaatgtaataagaaagaaaaaagagcctctcaagcatcaaattgctagtacagaagaagaaatccttcaaatgtatgctagctatgttaggcatcaaatggaggataaggaaagagagctttttattttttctggaatactaaggaaaatgaggtaatgacaagtatgattgattgttttttttaccatgactgaagaaaatatattgtttgccttcttgtggttatagcagcttgctgaaaaaaggttgtgtttctgtctacttctaacacccaatgtttttactctatgcctgaatatatgcaaaagcttgctgatttccataggctaagagcaaaaaaaacatttggtgtgatgcaaaagctttctgatttccagggcaaatagaaaaaaaacattgtgtgttggaaggagacagacgacgacaaacgggcatttccagtgaggcaatgtaagcagactgctgctcagcgactcaatatcgagaacctcggggtagtacttgatgccacaccgaatccatgtctccacatgttgatcatttcgataactacgatcatccgcccattcatatgtacaacgtagccgaaactcattcaaggagacggcattgctatggaacaagagaaagttggtggtgaaattctcaaatctgctccattcttcctcggcggcctcaaagtcgtccaccgtgaaatacccaaactccttctcggctgtgtttagttcagcgcaaagtttgtattttggttgaaattggagatgatgcgactgaaaagttgtgtgtgtgacaggttgatgtgatggaaaaggactgaagtttggatccaaactttgaatctaaacacaaccctcgtcgatatcgaattatcgataaagggcgtggagcaccagaggtctttgatttcgggggggcatctccttcatcttcctccacacgcgcgcggcgtgtgtggaggaagatggaggagatccggatgggctgatgcagaggaagtaacccggcaaaatcagtggttgccacttgcaagtgaaccaaaaaaaaaggaaaaaagaacactgatcttaaacaaaaattaatcaagaacaaacttcgtgtcaaaaagaaaaaaaaatcaagaacaaactacacaagcagcacaccgcatgtcgtccatgacagaaatatgtcaatggccaagccacattccaagcaagaacgaactgatcatcagaaaagcaacaacttgcatagagacataatgatccaaaactatagttgatgttccctactatatgagtactaaactaatatgtagcgccgtatattagtcgggcccgcgagaagtcgacggctcgcactcctcgactgccaccaaattgttggcgaaatgtgctacagtactggtactggtgtttaacttcaatccatgctttctgttttgatttcttcttccctaaaataatactctctccgttccataatgttgcaacctaggatgggatgagacccatcctacgactacgaatctggacatacatgtccatatacccatcctaggttgcaacattatgggacggagggagtagaactgtgggagagatcgagagtgagaccacttgaattttgagcatgatatcgcctgacaccgtgtttagatcccaattttttctttaaacttccaactttttccatcacatcaaacttttctactcacatgaacttcaacttttccgtcacatcattccaatttcaaccaaacttctaattttgacgtgaactaaacacagcctgagttgatccatccaagattctaacttcattctctctgcaatctgtagatgaaaaagggatcaaaactgatgtggtagcctactgatgtcagataccttagcgcctgttgtcttaaacaagagttcctggccgtacacattcttgaagtttgcttcgtactccataaaagtaaaatgttttccttttattaaaaaaaaaacgaaactctaatagtgacatgctacctaagtaagttttttttttaagaaaagggttgcatggatccggcttatgtagaaggccacaaaacgacatgttgccaggttcacgctggtgatataccagcttcacaatcaccagttgagaaagcggagaaacttggtcacacccagaccgctactgaaaactataggtcaaaagcttcataactactccctccgtcccagaaagaagggattccgggaagcccaaggtagttttaggacaaagagcaaaaggctaaactaccctcagtactagtacacctaatcattaggtacaaataaagtattattactgccacacattaataaaacaggagtagtactccatactcaaacacacaggcagacacaaggcgtcaaggtgccaaataatttgaatgaagaggttaagcgccacttcattggcgggatgtaatacaaatttagcacaccccaccacaacaaaccctacaagtttcaaatcagaagttaacctcccactttatcacttcataactctgcaaaaacacaagtttccctcccactttatcccttcatatctctgcaaaacacatccatgggtttagatctaaatatagcattagatgatggagatgaacatgctataccaaacctcaatgaagcagtggctgaagaagcagcagtggctgatcaggaggatgaccaggttggaggtgatctccagggaggtgccaaccatgagcttcctggaggtgatttccagggaggtgtcaaccatgtgcttccttttgatctcaacttgtatgcatctgaccaccaaggagaaatacatctaggtaaccttgtaaacatgaatagaaaacaattgatcttcgtagatatggcttgcataaatcactctaaaatctttgccatttctctgtaaaaatgatctataacatgtgcattgatgcaattgctatcttcttggaacaaaattggtctttgataagtttgagaaaacaattaggatttgatttttttctttgatatttaccaactcaattctgtcaagagttgagcataatgaaattcatccccttccataatatcagaggttatactagattctagatatgctagattctgcatggatagtttcctttatagtactggtattgacctaaattgtctgtagctcaagcaacatcatcttaatataaagtaggaataaacatgagaattcagaaagcatgagcactgttttcatctatgtgtaaaatcatgaactagaataataagcaaacaatttatatatatatatatattcctttctaatgttttcagctagtactatgttaggttgtacctccaatgttgtacacagagctctaaacttcagcatgaaagtttgtacagaaacaaacaactcattcatgtatgacccaaatatcagtataccagcaaaataagataaaatcacaatcggaagatttgataagaaatgtgtaacacatttggggaaaaataatcatgagcacttccatcagtataactactactgagatggatatgtctttgaccaattaaacctttgtcatataaaaggacacataattcaacaggacatcaaatatggaaccatggatcaatatagaataatctgcatggcaaaaagtattgtttttgtacatggtactcacatggtatttgttattgtagacgatgttgatgtcatggatcaagttctgcaagtaaatggaggtcacaaccataatgcctttccttttgatctcaactttgatgacgatgaggaagacctacaataccatccaggtaagccctttaaccgacatgactatcagacttaaaaaaaagataaaatgtggttttacccaaaggatcattgtagaataatattatttatctgaaaccatgtttttaattagaagttagtaatattatatcatgccaactacctacaatagtccaaccgtgtcatttggttgtattagttgcaataacaattcaggattgtaaattagacatttcagcacatagtaaatcacaaagaataatgagatttaccaataaatacattgatatcttgtatttacatacaattgtcatgtcaatcggttcactaccacagcaatctgaaagaaagcacataaactaaattgtccaatgtctctgtccctcttagatgtgatatgtatggttaaatcatattacaaataaaaccatgtggtgaacctaaaaagttatgccataattttgaaatcatgttgatcaatgacaataaaatattaaaattctgaattggtacatatgactaaccttataattgctgttgtagacatgcaagagtacggcgtgtatgcgggtgatgtggatgttgttttcgaacaagaggagttggatgattcagatgaggaagatgaacatcaaaacaaaaatctaaccaaaatacaaaggcaacagatatatgcagcattggctggaaaaactaacaatggaatcctgagaaaaaatgctacaactgaagttgcagcaatgtttaatgtgaaaagggctagagtgcaagctatttggcgaagagtgaagcaatgccgtgcccagggaataccaattgatgtaaggtctaggaaaaaaaagaattgtggtcgcaaaaagaaagaaatcaacctaacagatgttgctaatgttcccttgcaacaaagaggcactttacggtcatttgcatcagcctcaggtataccaaagagcacactacataagatgttgaaagaagggctactaagacgtcactcaaatacactaaagccattgttgaaggaagagaataaacaatcaaggctgcggtggtgtctttccatgttagattggcatactttgccaaatcaacccaagttcattgatatgcgaaacattgtgcacatagatgaaaaatggttcaatacaactaaaaggacaagaaccatttatatggtccattgggaggatgatccatacagacctgtccaaaacaaaaattctatcgataaagtgatgttcttagcagcaattactaggcctagatacaatgaagaaggtatctgcacttttgacggcaagataggattgggcctttcaccagaaaggtaccataacctcttcatatatgcatttttacttagtgatttgatctgaaaattaattgttaatctaacttgattattatactacttaggaaccagcgcaaaggacaagtcataatagaccaagggggactctagtcaccaagacaatcaaggttgatagaaataccgtaaggtcatttctgattgctaaagtcctacgagctattatagcaagttggcctccagaagaagcacacaacactatatggattcagcaggataatgctccctctcatgtcccagtggatgatcctcaatttgcctatgcagtttcccaaacagggtttgacatccgactcatgcatcagcctcctaattccccagatatgaatgcactagatcttgggttttttgcgtctctacaatcattaacatatagaaggatatctaggaatatggatgacctaatagataatgttgagcaggaattttaagcctatgatgacaacaagctaaatagggtgttcctaacattgcaatcttgcttgttagaggttatgaaagctgatggaggaaatggatacaagatccctcatatgggtaaagagaggctagagcgtctagacattctccccaatacccttagttgtgattttgagctatatgataaggtaacaacagcattagccaaccaagtgcagtaaatcatgcaatatgggaaagcaatatcatggcttcagcttttggttaaatgtcaggatgtacatgtgataagttaagatcagtgttgcgcaagtaaatgcaacaaaccatgtaatgtgggaagttttatgatggtttcagcttttgaaatatgtaatgtgggaaatttatcatggtttcatattttggccagatttcaggttgtatatatgacgatctaatatcagtattaggagtaaatcatgtcatgtggaaagtttatcatgcttgagtttctagctaaacttcagattatatatatatctatatgtaagataagcattgcatccatcatcgtcatattgttcgtaatgttaggaacaaatattaatttcattgagcacaataaaccatcatattttacaataattctgtaggataccattcataagcactcatgtaataccataattacacatgcttccatatacaaaaccaaaagtttacctactttcacatacttggtcaggctactaattataaccacatgatctcatgtactaccataattacacatgcttccatatacaataccaaaagtctaagtgctatgttaggccatcattcataaccaccaaaccggcacaaaagcaacacataatttaagcattcatctaaactttttactcttaaaacattccagaaaattctttaccgatttttccaaggcatcttcatcttgcatgagttcttctaggccactatcatcgtatggatcttgcgcatatcccccaatgaccatgccaacatcatcgtcgctatccttcatctcctcactgttcccatcctcgctgctcccctcctcgttgatcacatccttagcttttccactcatatcctcgatgttgatttgcccgacgagtgacttctcgaacagggccttgtggtcgctatcatcttccaatattgtcctgcaaaggataaaacacaataccaatacaagatgggatcagttgttagagacttggacttccaacatatattaaagtatttggaattgtggtgtaaaggtgaatctatcaccgaatgaaactaaaatgtattttgattccattatataatggtgcaacatgtgaacaatcaatgtctaaaatgaagtaaagaccaaagggactgatcatggcaatgatagctaaaaattagagtacatcagtgtatatatgtgtaccctacatccagtgaattagttttataaccttcgaaaaagagttgcgctcaataaatgttaagcatccaggctatttctcgtagaacaacagcaagatcatctagttaatttaattggctatgaatggcaatatatgaaaaagctactcctaactattcgtgggtgcagttggatctgttggagcaagctgaagctgttcagggcaaggttccagaactccttattcattattctactcttagtgttactagtagttttaaaataaacaggtcaagtaacagcagctagctagctagctgcagccagcaggggtcccaaattaatcatgccatgccatgcaggagggaacaaaacaagtgtgacaagcagcattcacggacaatagtctacacattatctgacctcctgtaaagtagttttagctcaactgaaaaagaggggaacagggtgtagtgacctaaaaaatgaggggtggagtgaacccaaagactaatatttgcttgtagcatttaggagttggatcctttcaactaatattgtggacatagagagtattatggattatcgagggtaagctttgtaagtttacaattttcccatgacttctttgcctacaatcagtcctttttttaaggcaaaaaaaccttatcaatcttctaatactttttcagaggcccttgtaatatttaactccacctactttctactttctactttcttaatactttctaatatttaattatctcaagaaattggtagaaactcaacatatataattaatcgtccaccggaaacatagattggtttcaacatatataattaatcccatattaacattgcaggagattatatatactcataatgatatgcaagagaatacaaaatttgatggaacatgaaagttgaaataactgctaaaaatatcttctaaatttttcatgtttcaagcacgcactgaacaatattgtaacgagctataaagaaagcgtgccaaccggcacacgaacagaagaactcggtcttgtttggtgccgctgaattgataacttttccagaccctattccattgcttaaaacaagctattgcaaggaaataaatcctaattacaagaaaataaatcctaaaatgaacaactaaccatatagagctactactaatgaacacacaagggttattattaacagtatgcaaccacaccctgtgcatctgtgctacatccgccattcaaagcagttttcattgcatgacaagaatgtattggtggcagggagatggagcgggagataccttttgtggtacgatggattgttcacctcaccatgagatatgcttgatatactttccacaactggaattaaaccacgcatatcactgccaatgtccccaattgttggcgccggaatcagaaaaggagggcaaaaagccacctcctccggtgctgtcccctcctgcatcagatccgcgggctccggcacctcctccgccgttgtcccctcctgcatcagatccgcaggcgccgccacctccttgtgcatcacatccgccgccttgcaaacctccaatgcttttgccgcatgtgaaccgcctccacccctggcggtcgccaccaccttgcgaagcttcgatattgctaccgcattcgatccgcctcctgccgtagcctcttgaatcagaaccgcaagccggcacgcctcctccgccttggctcgcgtatctttaatcaaaactataaaccgttccgccgcttccatgaacgctgctaccgagccgaatccttccaccggagtcgcctccttcatcggatctaaaccctcgcaactgtctgccaccacatccgagcgcccgcatcctggtaaatgcagaacgtcgaagggaaaagcgggagcgaggggaagcggcgtggagtggggagggccgtgcggggaggatcgggagggagatgcggagggggtaggaagcttgctaaggtctcgcatctggacgtcgcggctttgatttggccgtgcgggaggatcgggagggagatgtggaggggaatacgcgaggaacgagagagaggaatagtacgcgagagagaagcggcgattccgggaaagggaagggataaggtttctgtggtgtgagaggagagagagatcggggcccactattgcccacatatgatgcgacacagataaaatatctggtgttttgtgcacgaatcgctttttttttgggacaaagtctccccccccccccagaaatcgctttttctgggacggagggagtaccaccacaaagaagaggattatttggaaagacaacgttagtggcgagaataaaattgtctctggaaaccatattatttcttgtcagttacaaggtccggcaaattgcagctagtgaaacaaatttaacagctctatatttgaaatcaactctcatatcagctagaaggaaaaaaaaaacatcaaattttagtaggagatgatcccagtttagagcatccctgcatacacatcaaacaaacaaagccattggcacctaaaagcatatggctagtacttaggtcccgttcttttctccaacaagagttggttgaagattaagattttcgtggcacgcttttcaaactgctaaaattgtgtgtttcttatattaatctattttttaagtttgtaataattaaaactcaatcaatcatacgttaataccacatcgttttacgtaaaaaaaacacttaaccttcatcagaagaaaaaaaacactaaaattggtttaaaaaaatcaaatctttttgcaccgccgccccccaccccgccacacacacacacaatgccgtggaactaaacaccgcaatagacgtcatcacgtgggattgggggcaacccggtagcccgaaccgcgtatcgtcgccgccatgacgccatcgatcggctgcgacctcggcgacgccaaccgcatcttctcgtcaactccacgacttccacgccaccccacacggcacggctgctggctcgatcggcacatgcccgcccaacatgtgcaagggcctgatgactaatttggctttatgggatttcaaccttggctgtgtctagatttctattttttttctttaaacttaaaacttttctgtcacatcaaatgtttggatacatgcatggagcattaaatatagacgaaaaaaaatcaattgtacagtttgcattgaaattgcgagacgaatcttttaaacttaattgcgccatgattagccataagtgctacagtaaccacatttgctaatgatggattaattagccttaaaagattcgtctcgcggtttacagtcgaaatctgtaatttgttttttgttttgttattagtctacgtttaataattcaaatgtgtctgtatacgtcaaaaaaattttggcaccgaactaaacacgccccttgctaataagtttgcaatggtaaaggctcggtgtgtcttattatttgctatatagggtgtgtttagtttacgctaacattagaagtttggttgaaattgaaacgatgtgacggaaaagttagaagtttgtgtgtgtaggaaagttttgatgtgatgaaaaagttggaagtttgaaaaaaaagtttacaactaaactcggccataatacccgaatacattcgttaagatatttttcccccacttaacctctgggcagttcatgtttcgtttacactgcgtgatggttcaaattttagcaactcaaaatatgatcacaatttttgtatgcaattctcaacaaatacaccaactataaactttacatttggcgtgagtagtaagatctcttattgcataaagaatggaattacaaagttacccatcttctcttttctctcaagctcttccttttcagcaatctgttttagcgtagtccacccctttcttgcccgcttccttgaactaccagacatctgagcagaaccaattgctacaggtttatttttcatactatcgtttggagctgacttggtaggcattgtaggggccttgccagtaactgaacttggcatctccgctttcttgttctgaatgcttcttgtcttgagcagttctgcagaatccttatggtccgtcacatccaccactttgttctttcgaggagtaacaaaacttgatccaactgaaaattctgctttcgaaggaacatcgggttggcatattgcaattttgttagcagaaacaggctcagtttcatgcgtacttttttcatttgtgattgttactactattttctgtgagacattttcctcatcagtagctgatgctgactgattcagttccaccgatgaagacgctacctccttctccatagattcgtcaagaaaattgggtactgggctctcctcatactcgttctttacaagatttcgttgtttcaacccagatgttgactctagttgtgagactgctccttgagaatattccaagccctcttttatagttactaatctcttgttatttatgtcccctttcaacttaatgctggtaacatccatgccaactggctttcttaatgataacaagcccttcataatattctttccgctgccccttattaggttttggtctccacagaaatggcacaggtaggaaatgctgttctggcaagtgtttaacttcttgcgtcgctttgcttttcttttgttgttctttatgcggatggtgcagttgaagcctggctgtaagactgtttcacacctgcaaagtttagagaatgtttcttcagaagtcctatagagatattggtctaatctaaagtagtaatgcttatgatccagacaaatgggtacgcacagtagaaaaaaaaatagcataactaggaaactgaactaccaagtacactctgtttcacattataagatgttttgggttttgaatagattcatacatgggtccatgtatgcgcttcatatattccaaattcataaggatgttagtgaatctagatgaaggatggagaggccaaaacatcttatagtgtggaactgagggagtacatagtatgtttcaccgcctacaatcaacgactcgagcctggcagactggtggatgacggcgagaatgcattttcagacaggctacaggaacatttttgacactgtcttcgcactaatttgctggttcctgtggaaggagcgcaatgcgcgtgtgttcgagcagaagtttcgaagcacagaacaattagtgtgtgaaatcaaagaggaaatccttgtttggaagacagcaggagtattcgcaacttgtaatggcgatagtgaataatttgtaagacccgtagcatgcaactttagcttactaggttggggattttcctcatccatctcgacagcatactgtcgttgtaagcttcaaatgtaacgaactacaagattttcaaaaaaaaaaaaaaaaaaacaatcatttgtttgaacttagtggacaaggttacagggtatgatgctctcatgaactagcagtttttaagccgtgtgaaacagtattgcaacaacagtggttgccgacagataacagaataaatataactgaaaaaaaatactacctagtgacttaatcagttcaagccaatatgaactgttgctttgtgaataggagatttgcacaaatttggttagaacttgagtaatcaatcacaaagagaaagtttgagaatgatatgcacaatgcaaagcatggatccaactaaataaatcatatgaataggtttcgattttacaatatacctgtaaaataggtttcgattatttgctataaagaacttcaagacttggttatctgtatctcataaaactgattcatgaaatgtatcgatcgagttcattaaagctacatatcactctgtcattctcactgatagacaaatgttgcaccaataaaaaaaagcaagtgcaaaattatatgaatagctgcactaacacgactagatagcatcaaaaggctgcctgatacttctatggtgcataggaaattaggaatataggatatagtatctagccgggcaggtccttaaactggctaaaatgctgcttagcataaaactaccgcaatttcttagaggtatgagggggattatgatactaataatatctgcaatggttaaattcaagggaaggggcagattttgttccttcaatatcatgcaacaatttgagagacgattaaccacaaatcagtagaagaattgagtactttgccccacaacacacaggcaaattctgaaggacgcgagcatccgaccgaggtgtagtaagaagtaagcagtgaccctgacctctggcataggaaggtggaggcggccagaggtatcccggccgcctcggcgttggcggcgaggcgtcgccccagcagggcgccgagggggcccaccctggcctccccgcccgcccacgccgccagccgctgcaggtgctggaccctcagcagggaggccgcgtcggcgcgcgtcttcccggagctctcctcgcggagcgacacggcctggttcccggccctgggcggcgccgccggggcatggccatggccaccgcgcttcttccccatgtagccgccaagccgcaaccgcgaggaagacaaccggagggcggcggcgcgggagggagtaggcgaaggcggcggcggcgacggcgagtgggtctgggtcgctgtgggccggtgcaagggccagttgggccgcgccgccggttaatttgtagtagtagtttctttcaggaatagtaagtctttttttttttggggtctccctcatctctttgcccttggtcaaatcacaccccttaaccgtaaaatcggatataacccctcccccaacttcaaaaaccggtgtaaattgactccttcggtgtttctaaaagtggttttgttcacgtggcaagttgacttggtccaagtatgctgacgtagcggcctagtcatcacaggaattaaaaatagaagtaggtcctgcatgtaaatgataaggatgcactcgactaacgcgacgacggttgcgggaggccaacgccgcggctaaggggttggcggtgagcagcgacgaacgcacgaaggctggttcggccacatgtgacgactaggcagtggacttcggtcgcggagatgaaatcggcgacagggtcgtgggaagggacatgctcttgctagcatgaagcttagtggagcttcgctgctgtgcccggatttcgagaagaacttgttgatgaggccatcggagagggccaaccctagtgaagtcatagtattcctcgacatctgacgaagaagagcagtgggaagctggtttgaggagtaggcggagataggcctgcgaggggaaggaagctaggcagccatgcgctggctttggctcgcctcgagctcacagtgttggcaaaggagacgacatcatcggttggtggtctccgagcaaggcgaggtggcagaggagaggaggggccgccatcgcttgtctcctctgcatcaccgcccatcaccgccagagctaggcccgaaggtagatccaactcagcggattatcccaacaatgatggccttggatatcgcaacgacggtggcggggacctcgggagaggcgacgagcttggccaactgcgggggagctcgtccgagacgaagcagatggagtcgaagatttcgaaagacaccagggttgttgcgttgaggaatgtcacgatggccttgaggaaggttgcgaccgcgctggtcagctgcacgaggcggcagcaccgggccaccatagtcgaggggtagtagatcttgtatgccccaaacatcgcgcccatcgcaaggaggatcctactgctggcagtggcgggagaaggccacaaggcaatccatggtggcggctcgccgaagctagggttagatgcggtgagcgtactgtggccgtctctcttttagatctatgccactataaatatgccattttagataaatgccactactattcgcaatatcaactactccctccgggttgataatacttgtcattttggacaagggcacggccttcaaaaagtaactttgacaactattatctattataaaacatatagaaatttcaacaaatctatgattttattgaagtactttttaagactaatctacacatgtggttttcatattttaagataaatattttagaaattatttgtagtcaaagattttaaagtttgactttacccttgtccaaaacgactaatattatcagcccggagggagtactattaacaacagaattttgcatcagattcggagaagaaagaacaagatcaaagcggatttggtgtggaatcgagttggatttggagtcggactgcacatcggctggacactgtattggctgcaaaacggagtctaagttggtcaagctgataaggcaaacggccgatgcagccaatatggtatgacttgggctcggcatgggcctaaattgggtttaaccgtcattgccaattagagatagagctcatttaaggaaattacatctattaattaggttatttatgtcggttttgtgaggtttggtaagagaccatcgtatatggtcttgtttgtattttatctttagaaaggtttgagtcgtgtccataatggactggttttgtacttagggtataaatatgaaccccaggccaatgtaaaaggagagacaatccaatacaactttggcgcatcgccaccctttttgttcttcttttcggcgagttctctcgacaagaggtaaccgtctcgatggcttgtgctatcagggctatcatgtcgctttagatatcttagtccttttatcatgaccatctgctatcatatgtcttagttaatctagtcttagtatctcgatttagctctatcggctagttttcgctttagggctcttgccggtatcggctaaatcgtcttactagataagtttagctaaggcatctaccatcctgaaaagtgattgattgcttgattgtttagactctaggcttcttttcctactttgtgatgcattatccctagtcttgtcttgaattctagaaattaacctagaatcaatcataatttaggatagtgtcgatgggggatacccgtagaccggataaatagggtattggggtacgatggtacgaggatctacgtgatacgacttctagcaaacaaggagacaaagattatactggttcaagccccttatcagataatagtcctaatccagtttatatgatattgatatggaaatccactatttatatgatattgatatggaaatccaaattagtttcattaaatcaataattgaatatattttcataataaatttgtcttgggttgaaaatgttattatttttttctacaaacttagtcaaacttgaagtaggttgactttgaccaaagtcaaaatgtcttataacttgaaacggagggagtagtttctatagcaccacaaagttgacaaaaagcagaaccttacataagggctttggtcgaaaattcgaggaggcccgcggtgagcgtgacccagaggtggtgtcgaggctcctctcccaccgctgccttcccctccctcccagctcgccggccgcctctctctccccccctctccctcctaggcatgtgaagaaaagagaagaaagaagaggctgataggtggggctcatatttttttatttatttttattgactaggatgccacgtcagcggaactagatatctctattgctatggaacctaaattgcacagttttgtatagtttagcggtgaagatttccgatattggggtttagggatgtcaaatgaactcaagatagagtttagggacagtaaatgacttaaagttctaaatatgggctgaaacatatatgtaatctgagtttctcataggctgagggcctgacccaacccaagcaagaaccatccgactcatccgagctagagagaggatgagcagcatttccattgttgcattgccaatttcttttttttttcctttttgtgatctcatggattgctgaaccactctggctccttgcttattctagccaaaaagaaaacgacaccactggttgcatatgcctcacccgtgacatcaccaaacacacatatggtagacatgaacgatgacaggctgataaaaaattaacagggtaacacaagacccagccatgaacgatcgacgaacacatacacaccagccagtgaggcgagcaagcagcttgcgtggcaacgaaagcgaccaaacgtcacttttaccgattggtacgattatgtgaaaggcggcatggcctatatcatccattggccaccaaacccggccaaatcatcgaatcaatcaggtcacgtacgtaggtgaggcagatcgagataggatgacgaccaggctaccctaacttaacttaaatcagaaagacgtgtgtcactaacgtgtgggttttacatgtgagtaatatttgtctccctattttaagttagaagttagaggcatagttattagaaatagatcgaaccgacagtccgaccgaaaaaaactctgagccctttaccggtttggtttgattagaagatcgaatctattgtatatacggtcttttaattgaaccaaactaatgagggctctggtttcggtttttttctactggtccgatcaggtgggaggatatgcacaacagtcaacagctcaagcacagcgaaagctagcgagcgcgtggcaaccacaggccggcaagcacgacacggctaggattaagctgttgatagcggctaggattatgcatggagatatgctcgaatattgtcagaaggttacaacgagcaagggacaatattgccgtcgcgttcgcgtgccatcgttccgatcggactttatctcgccaccctttcgtcaccccgtctcctgtcttgggcggcttttatgctgcagatcacggaacttatgctgcgatggcagtacagaaatcgaattccctccttgcaaaaaaaaaaaaagaaaaaaagaaaaaaaagaaatcgaaacttctacgattacaggcaatttgtatttacgggctgctatgcaataacagaccatataccataattgaatatgaatctcttcttaatttctagctaatcaaatctttaataccgatttcagggttagaaccctagctcttgattgggccacgtggcaccacggttagagcaccggccgaattctcggatggagaagggcgccacgtatcccacctctccatcagccgcacgatagtatatcaacggtgtaaaatacgtccagtggacctaaatgtatattgcaagttttaagaggggttttttaaaaacttcgtcatctagaacagccaggaagcagatgaaaaaaatcctatagggaaaaaaaaagaatctaataaaaaaaatcaacgagcagttagccccgtcccttgcctaattccatagttttgtcactacgcatagccatttgattaaaaattcagtaaaaaaatcttcccacattgcaatctttgagtgtttgttccaattgaagataaatctggaattaatgcatagcgaaaaatccgaaaatgtggtgcggattgtaaagaaaaaaaggataaaaataaaaaagtcaatcttgcctgcccgcgagccgccgccatctcccctcccacaaatcgccatcgtcaaccatcaacaggcaaggagagccacctcgatcctaaaagaagcttcttttaggatggggaagagaagggcgattgcagttggcaacgccacacgacaaatctggtcggccgacaaccaccgcgcacaacgccatctcctctcttttctcccccttcttctgccggattcgtccgtcactcatcgtaagacggtgctgacccgttgagccgtaaaatccgaggaaatcgacgctggaccacaagcagaacttccgtcggccaccacccacgctgagcttcgctgcaggaggtgatacgtcatgaggtggagaatatgagagagaaatgagcagctcaacatctgcccgcatgcctgtgggcagtggcgagaaaagaaacaaagggagaagaacgacaacgtcttctctgttctctctgtccgcctgtgtatgctttccgatgcaggctgcctgaggccgtgatgacagaaaaaaaaaagagaaataggaacagcggtgaaaaatgcatcaggattcaggaggactgaggggagcacacctgtccactcgatgcactggtcactgggcagaggataagactatactcctacagttgacgagtatcaataagtaaatcagtatccttcgtgtagttatgatttttcgcatccaactttaattgtccgtctatttttcttaaaaaataaaaacataagtcacaaataaagtactattcatgttttatcgtctcataacgcatggtactaaaaaaaattacgcatggcttgtttagattggtaccattttaaagcatactattttgggataaaatataaatatgtggatgcattttgttatcaaatattagcgatgcatagagaattttgaacaacacatttagcctatcgtactaaaacttaaaattattgtcaatttatcaatttttttacattacaaaatttttggaaggttcatttgggcactaaccaaaacatgcctttaacttgccacatagtataaaacaataaatagtatgtatattcaatgtataaatatagtttatacaggctatatagatggtgcgccaatggtgcgcacactttcttaaaacacagtacatgtacacactcataatacgcacgcactcatctctatgaaccccaataaatgcacacaagcacaccctagtcctatgaacacctccgaatgactaggccggcatatcttgagattgacgatatcaccacggacgcatctctgttgacgggtacatcgtctaccactgaaagaataattagctaaacccgagtgggctggttctaccataaaaaacttacccagttgagttacacataaattcacctccacctcacccattaattcaatgtggctccttgcaggttgtgctaggatgttttatagtacttgctctaaaaggtttgttacgtactccctctaccgcagaataacatcattttttggccaatcaatccaaggtatacacatttaattggaatttagaaaaaaaaaggaattgataaggacaatagtggtatttctccccactactaatttgtaggagaatcgttagaaataaatttgtttgggggcggaataaatagaacaatatttttttaagttggtgagaaaagttgtgtcattataagatctataaaattgattgaagttaggcataggcattaagagactatgtgattaagtggacaaattaaatgagatattatgattggttgagataagatagtcgttaatcaattgctatattttgctatattataagacaaattttgaataaaaactgttatatttggaatggagggagaattttattttattaatgatcttttttacgtaaaaaaaacactacggtcgttatttaaaaatgtccatttgcaaaacctatttataaatggaccatggtttatttagcggaagatgaggctcaataatttatgctttaaaaataagtatatttcaaacgatgttacaattacataaaaactctttttaataaatccaacataaatagatgaaaatatgataatttttaattaaataactccacatgttgaattaagaatgtaaggaaattgacctaatcctactaaaaatctttcgaaatttctaaattgatgtatgtataaggatgggttaaaaagggcgtgccaaatggctcgccgattttctagtcaaatcatctcaagctggctggttaccgaccaactattagtccacgtggcagggataacttgttagataaatatgagattatcatcaaggaaaaaattgtaaaagtaaaaaaaacaaaagtcatccagattctagagtcttccgaaccatcctcccccttcaagtaaactatctgccccattcaatcaaaccaaatacaatatccatttctacagataaacgcatagagatttttcggctagcttcacaaggtggtgggctagaagatctaggttcaaaacctcacccttctaattatttaaaattagatcattctctaatatttgcatatttttatatctatttctatatatgtcttctccgatcaatcaaattgaacagaaaagtttagggaaaattgaagagaaacaaaagtgaaggtgaagaaaatgtaaaaactaatggagaaaacttccaccaataagctagaggtgaactgccgatgtagctaagatgataatttctaaataaactaaaaaagcatgtacgtaaagtttcgggaaaattgaagagaaataaaagtcaaggtaaagagtaaaaactaaaggagaaaacttccaccaacaagctagaggtgagctgccaatgtagctaagatgataatttctaaataaactaaagaagcatgtactaggctctacctacgaatctttattgatggattgtggagattatggttatcccatatctatatggcggttatattccagctggatatacggtaccaaatacagataaaatatctttatgaggactcgggttaggttctaaacttgtgtgtctagaaagtacccgggattctagccggttacgattgtattttatctgtaatcccatattccgttaggatatggactgtaccttgtattacggatcccttcccttatataaggagggtccgtgtgcctcttggggcacgattcttttttctcccaatcatacaatcaataacacactcggcggaatcatccccggacaggagtagggtattacttcttgaataagaaggcctgaacctgtataaaatttcttgtctccaaacccatccactttcttagcttgatagccacccccttttattattgtcgaaatcttgtttcgacagttggcgcgccaggtagggacggcgtcaagttctcaccgactaagtgcgatgggttccatttctggcatcgacgacttcgccttctccctcgggcaggcgttccggttcggcagcctcaacttcatcaccaacgacttcggcaagatctctcttctttactcggattcaaaccagtcggggagaaaccaggtccccgtgccgttcggtattccgaactcagccgaggcctactccaagatcatctctcctgagtcggcttcaaaccactcggatgagatccaatctactcttccacgatcagatcaagacgatgggtcctatccctcaatcttgatgaaacttcctgatgacttggccgccgtcttcacagccaaaacatctcccactcggagatctaggcgagctccggcatcggccccgatccagtctagatccagggaggttggcgttatactccagcctcttgggacagtctcgacggaagagttggatggctacctcagctcccccgacgtcagttctcgaccaaccgagatcctcgactacgacgacttcgacaacttcgacgacagctatgaggataactacacgcctctcttcttcggcgtattcatggctgacaacgaaacggaagaacagcgccgagcccgagaagcggaccaagatcgcgtacgacagaagctgaacgtcgccgactagaggaagagcgacagcgacaggagcgagaacgactacagcgtgagcaacaagatcgcgaacgggttgcaaaggaggctgaggatcgacgacaacgcgccttggaatccgggcgatgagcgagagaactcattgggcaacaagacgtcgatggaacagcggtctttcgcaccccccagcagaacgcggttgcagcaatcactctcctcgacaccctcctcaaggaagacgcactcaacctagccgttcatgttgtcaacatcttgaaccagacgaagaccatgatcgctgcctcggttccagccaactccgcaggcacccgcaccccgactggtagccgagtccctcatcatcagccaagcctcagcgtcaccggcacaggatctagtcgcaggagcaggggtcacgaagaacgatctgttcactcgcttcccgaacgtcacagggagcgccgagctgaacggcctcgttctccacctcgccagcgtcccgtcgaccttcgcgacacgatcaaccagcgccgtgcagcacgacgtcaccgccattcaccaaatcgctacgacgacgacgtggatggagtagctgccttcactaatgacctgcgtcgagtggattggccagtcggctttaagccgactaggatcgagaagtatgatggcaccaccaatccagagtcttggctcaccgtctacggactcgcaatccgcgcagcaggaggagacagcaaggccatggcaaactatctacctgtggccctagcggactccgcccgatcctggctccacggactaccccgtggcacgatctgatcatgggtggaacttcgtgatcacttcatcgccaacttccagggcacctttgaacgccccggcacacagtttgacctctacaacgttgttcagaagtctagagaatcccttcgagattacatccgacgcttctccgaacaacgcaacaagatctccgacatcaccaacgacgtcatcatcgccgccttcactaaaggcattcgccacgaggacctagtcggcatgttcagacgtaaacctcccaggacggttaagcagatgttcgaaaaagccaacgagtatgccaaaaccgaagatgctatcaccacgtccaaacagtcgggcaccacttggaagccaaagaaggacacgccgactgcaggggagagcggaagtaacaaccacaaggatcgcaagcgtaagcccgaagaacttgtggcgaccacctctccatcttcccgacaacgtccccgcgtcaacaccttcgacaagataatgaactcccaatgtccgcatcatcccaactccaaccacgtggccaaagattgcttcgtctacaaacagttcgcggagcaatacgtcaagaacgcacgcaaacctgcagacggagatcagggcacatcaaagaagaaagatgatgaagacgatgccccgactggttttcaagatcatcgcaaagaacttaatcacattttcggcggacccctggcttatgagtccaagagaaaacagaagctaacagaacgggagatcaatgcggttcagcctaacatgccccaatatcttcggtggtcagagacagcaattaagttcgaccgctcggatcatcccgaccgagtggtccacccggggcggtaccccctagtactagacccagtggttcgcaatgtcaagctccgacggactctcatcgatggtggcagcgcactcaacatccttttcgctaagaccctggacgatatgcagattcctcgcatggaattaaagccgagtaatgcacccttccacggtgttattccaggattgtcagctacaccactcggtcagatcacccttccagttaccttcggcactcgggagaattttcgcacaaaaaatgtctgtttcgaagtcgctgatttcgagacatcatatcatgctatactcggacgaccggctctagccaagttcatggccgtcccgcactacacctacatgatgatgaagatgcctggtcctcgaggggtcatatcactacggagcgacatcaagcaagccgtcacatgtgacaaagaaagttgcgagatggcttaaacccacgagaccactctcgcccgcgaagagatccgactggccgcgtccacggcaagcgagggagaagtgcctgcgaccaagctgacgaagaccaaagaaagtgatgccaagacgaaaaagattcccttagatccctccgatccttagaagactgctgtaataggtgctgagttagattgtaaataggaaagcgcgctcatcacctttcttcagaataataaagatatttttgcatggaaaccatccgatatgcctggtatccccagagaggtgattgagcactctttacatgttaaggaagacgccaaacccatcaagcaacgactccgccattttgcacaggacaggaaggacgcgatcaaggaggaattaaccaagctgttagcagcaggcttcattaaggaagtccttcatcccgactggctggctaacccagtcctggttcggaaaaagacggggcaatggcgcatgtgcgtcgattataccgacctcaacaaatcttgtcccaaagacccttttgggttacctcgcattgaccaggtggttgactcaacggccggctgtgagttactcagcttcttggactgttactcgggatatcatcagatccgactaaaagaatccgactgcttgaagacctcgtttattacgccttttggggcctactgctacatcaccatgccctttggattgaagaacgcaggagcaacctatcaacgcatgattcaaaggtgtttttcaactcagatcggtcgcaatgttgaagcctatgttgatgatgtagtcgtcaagaccaagcagaaggatgacctaattccggatttagaagaaactttgacaagcatttgtgctttcaagatgaaactaaacccggaaaagtgcatcttcggagtaccgtcagggaagttgctcggatttatggtatctcagagaggcatacaggccaacccggagaaaatcaacgccatcctcagcatgaaatcgccaagctcccgaaaagacgtccaaaagctgactggttgcatggcggcgctcagccagttcgtctcgcgactcggcgagcgggggatgcccttcttcaagctgctgaagaaaactgacaatttccagtggggacccgaagtacaaaaagcctttgaaaacttcaagaaatctctcaccactccaccagttttggcctcgccacatccacaagagccgctactgttatatgtgtcggtgacctcccaggttgtgagtatggtcctggttgtcgagcgtgaagaggaaggccatattcaaaaagtccaacgaccaatctattttgtcagcgaggttttagccaactccaagacaaggtatcctcaggttcaaaagttattatatggtgtcttaattaccgtcaggaaattatctcactattttcaaagtcactcggtcacggtggtcacatcgtttcccctcggggatatacttcataaccgcgaagcgaacggacggattgtgaagtgggccttggagttgatgtctttggacatatcattcaagccacgaacttcgatcaagtcacaagctttagctgatttccttgccgagtggaccgagtgccaggaagacatgccagaggaaaagatggaatattggactatgcattttgatgggtcgaagaggcttacaggcactggagctggggtcgtcttaatttccccgactggagaaagattgagctacgtattgtggatacatttttctgcatcccataacgtggcggaatacgaggtgctactccatggattaaggattgcaatttctttaggcattcgccgattaatcgtccgtggagactcttagttggttgtcaatcaggtcatgaaagagtggtcatgtttagatgataatatgaccgcttatcgacaagaggtacgcaagttggaagataaattcgacggactcgagctcacccatgtcctccgacataacaatgaggcagccgacaggttggccaattttggttcaaaacgggaagcagctccttcagatgtgttcgtcgaacatttttatgaaccaaccgtgcccagaaaagagacaattgaagccatggacactcaaggtgtaagcatgatcgaagccgactggagagaaccgtttataaaattcttgagcaaacaagaactccctcaagacaaaaatgaagccgagcggatttccaggcgcagcagactttacattattcatgagactgagctgtacaagaaaagtccatcaggaatactacagtgctgtgtatctttggaggaagggagacaattgttgaaggatatacattctggtatttgtggtaatcatgctgttgcacggaccatcgtcggcaaagcttaccgacaaggttttttctggcctacagctatgtccgatgcggacaagattgtgcggacatgcgaaggttgccaattttttgccagacaaattcatttgccagcccaagagttgcaaaccatcccgttgtcctggccgtttgtggtctgggggcttgacatggtcggcccatttaaaagggcagtcggcggttacacacatctctttgtggctatcgacaaattctccaagtggattgaggctaaaccggtcatcacgatcacagcagataaagctagagattttttcatcaacattgtgcatcggtttggggtacctaatcggatcatcactgacaatgacactcaattcactggtggagcatttaaagatttttgagaagacttcggcattaaaaatttgttatgcctccgtggcacaccctatgagtaacggacaagttgagcgtgctaacagcatgatactgcaagggatcaaagcacgagttttcaaccgactacgcccctatgctggcaagtgggtagatcagctgccgtccgtactttggtctttacgcactactcctagtcgggctaccggccagtcgctgttctttttggtttatggcgcagaagcaatgttgctgagtgaagtggaatttgaatcactacgatttcggaacttcaacgaggagggctatgaagagggccgagtagacgacatcaaccgactagaagaagcccgagaagcagctttaattcaatcgactcgatatttgcaagggttgcgtcgttatcataatcgaaatgttcgattgcgagcctttttagtcggtgacctggttctgaggaaaattcaaacaacacaggatcggcataaattatctcccttatgggaaggaccgttcataattgctgaagtcactcggccaggttcttatcgactcaagcgcgaagatggtactatcatcaacaattcttggaatattgaacaccttcatcgattttacgcttaggcatttcgtttgtatctttcctctttgactgctaacttcaagtttttcctcgaagttttcagtcggggggctactataataataatggagtgtgatttttatcaattcaatttgcttacttgatgtatcagtgccctgtttgatttcttggcttagtcgatgaggactgaaagttttttaacaacttttgcgggttttaggctcaacaaggtttgacaaaaacttttaagaaatcaggagctaagttaagatatcatgcacagcataaattcatcagtattgtacaaattgtgcctccatcatcattaatcatcaagattatcggtacattaatcagtatcagtcttttcatcatcagaaatatcaggaccagtcggtcgaagatcggtgtcctgaaatctctcaactacatcagcagcaattttgtcagccgctttctgcgcattactgatgaggtcaagagcagcttcttcgctcgtcccgtccgcaaagccatcaatggcgtcaatatcaactctcggataaagggatttagtcatcgccaacgccatgcttgctcccatacttccagcttctttgatgttcttgaaatatatatccggagcaactctcagcttgtcgaaaatttcagaagcatcaagtgcactcgggccgttgttattgaggaacatcgcttgaacaattggggcagcagcgttagcaacctcatcctgggctccttcaagttttttgatcttgccaaccaggacgtcgaattgagcttgagatttgatcttgcggtctgcatcgacagattcatattaataagtcagcatatggaggataatagcttttgaggtattgattgttgataccttcaacttccttcaaagccaggtctctttgtcttgccagttctgccttgtcattttccagagtttgaatttgcttctccaactgagatatcttggtagcttgcactacattgattactgtaaatcaagattgcaaagataacagtataagtcagttgggcagagtttgtgcaaacctttcgatgagccactcagttcaaaattggattcctggagctcagcaattcgattcctcagatcatgctcatttttcctggcaagctcttttgtctcgtgcagcagactcctggtggtttcaagggtcccgagatgagggactagcctctctaaggttgccgttttagcttcgttcctaagatgaatcctctgcaagacagtttaattagcgcatgaattaaatggcaaacaagatggttgagatcaggtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcgtgaatcctcagctgcttgtatgcggggaatttcttcttcatcactgatcattggccctaatgtatccactgacagaggttagacaattggtcagagttatttgggtcgacatggtttcagacaaagtgttttacccgtaatgatttctagacgaggacgagtagatttggatgcctttaaaggagatccagatctctggttattgctggcgtcttgaccgcgaaggctgtctgcttgagctccaacttctggaatctcttggcttagccctgcgtccgactggtttccagtcgggggctcctgattaactccggcttcggcttcggccgactggtttccagtcaggggttgatcaccggattctacattatcggttgccggctgattgtcactcggacggtcctcggcagttggcccggtttctttggaagaacttgcgtccacgctagtcgggtcagaatctttcccagacggatctatatcagatggtttcttgcaatttgattatcagtattattgccgcaatggatgcgcatcaatacaagagagatcgttatatgagttgtacctagaagacttcctgatctttggcgcagggcgactggatgttttcttccttggagtagcctgttttggtagtttcttggttgtctctcggtctccaggcctcctggtagtatcatcggcttcgtcgtcacttaagaccagcttcctctttcgagagtctgactggccgactggatcagaagcacttggttgagtttcagaccaaaatcttggtcctccgttcccttgcccagtttggtggcggggagatcggcgttgagcgattggtggatccgactttagcaaagcaaattcctgggtgtaatatctttcattattaattgattcaacaggaagacaagatcatattttgaggaaggatgaaatgtttgagagcataccggtggaggagggttgaatgcgttgaatggcacaacgggcagcagatgtgagtagctgacaacaatagcgtttgagaagattttgtacattctttctttcatgaccttaaagtcaagagaatctggatcttcccgatttggatcatgcttgccatcaaactcaaaagctgtgcgggatctttctttgattggtgctaaccgacacttgataaagtgccgggtgatctgctctccttgaagaccctgttctttcagctttatcatcctctccatcagttctactgcctgagcagcttcatctcccataggcaatgagttccatgtgtcctagtaaaccggaggaagacagcagtactcggggagtacgggcttaggattctgaacacagaaccagttcgcatgccagcctttgttcgaggtttttggctcaaggttcctctgagttggaaatcagctcccccaacaacgcacggcttgcttttgtttggctggggcttgaggaagaagatgcggcggaacaaagcgaaatgaggcctaatgcccataaaagcttcgcaggcgtggataaaattggcaatatgtactatggagtttggattcaagtgatgcaagctaatcctgtagaagttcagaatgccccggaaaaatctcgaggttggaagagaaaatccgccatagaagaaatgagcaaataccacgatttcgtgtgtatcgggggtcgggaatgcctcaccaaatgccggtcgccacccgatgatctcttttgctggaagaacgccgtgtgccaccatctccttcagattgtcttccgtcacatcggagggcgcccactgactctcgaagctttctctttcttccgccatgaatgtgaactggatggattgatttagttcgagatatggctggaaagggatggggaatcggagcggtggatgcggggagaaatcttgtgaagtttttgagggtggattggagcggattgatgaaccctagtttgcccggcgcaattttgcactgtagcaggaaatggggaaaatggcgagagtctcggcggggaagacgaagagacgtttttcacttcggtattattagggtatccggagtactaatgggcctggacctgtacagtacttcagcccaattatgttttcagcgtggcccgttgtgatccctagggacttaggcgctttttgctttggcaatatgtgctcacaatgatgtggcccgatactgttaaaatcctttttaacgtgattcaataattctttggaattattatgatgcacatgaaaaggtgcccgatagaaaggtgttataccatttttgtaagcttttttaggctacaagagctgttgggttaatttgagatgactggtttattagtaatcattctcctagcatgttatatgcttattttggttatgataagggtcacagcctaggctgttagactcattaattaccatgattttctgtcatgtttgggggatcattttaagagtttcttgctcggattcctaccaaatatatctatttttgggccttttgagtgtttgtcactcggcccttcttgtattttttgtccttgatatattcaagttgagaagcagtcgtctaggtatcttactaagtaccatgcgtgcttcgctataaaaccactcggttcttgactatatgtttagtttttcaactaatcacatagtcgggggctacacctaattaggtgcatctactcgatgcaccatgttttattttcgcccttcacagtttttgatttttagtactcgacaagctggagcaagttgaattgaagcactcggattattgttttttgtttcaagaagactattttggtcaactgcgaaggtctcgggggctactgtggagattatggtttgtcacgtcctgataaattcatcccgaattaaaaatcattcgctaaaaggaataatagaattaattaaaatgcgaaaagaaattggcaaacactaaaatacgtgcaagaaaaattcaaatgtggcccggagaatttttgttaaattctccttggtctaaaaggagccctcaaattttacttgaatttttatagcaccggaaataattattaagcaacaaaaacaattaacaaagtttattaaaaagaaaaacctaaaaataaccctccttcctcctttgggccaagtctggcccaaagtcctccctctctcccctcggcccgcggccgaagtctccctttcctccctctctttctctccctctc

SEQ ID NO: 72480 - DNA, 2359 bp, Oryza sativa
  unsure (1)..(2359): unsure at all n locations
cgcgcggtganctttgatgtgcgtccgtctgcaagtagctcatattccttaaacacatcagctctagtatacgggcgatctcctctatatatggttcatatgtttgctgaaaggaagttagacatgacgaaaagttgttcatggtagtccaaaccacaacccggcccaaattgaaaagataggtttaagggtgatccaaattgagacttaggtaataaaaggtggatcaaagtgcaatttactttttttttactgtaatttcttctggctggtttgttggtcgccgttaggaccgggtgacgccgtcaaccccgcgcctccgtatttgctgacgtggggtggcgcgctggcttccgccttgacccgaatttgttttccttccgttaaaaaaatggttttccttttcttaaaaaggaaatagtttgttttttaagtctgtgtattaggattattacacttgaattttggtatatgtgtaggataatttactgcatgtttataatagagttgtactatagatgaaataacccaatttttggtataattcgtgtttggttggaggtcaaaataacaggttattttgtgaagaaaaaactccgtagtatagtaccatatccatcatgaatacacatactgcctagacgagtgattaggatgaatccatgttatattcctcaaaataatataaaccacttgatcttatgatcttatccaatctgttcatataaactggagatataagatggtgcatttcccttttgatttcttttgttgacggccatgagataggtttgcatccactgcatttatatttcggaccaatacaatgcacctattgatacatggggacagctcaactaaccatgatgcaaattgctggttggtgaccagttcttggcattatgataatgataggattaaaaaaaacagtgcaatgtctcggaaagaaaccatgacaaagggtacatgttgcattccagtttctaatgataaaattatgtgccagcaattcaaaaatcatgcgtgttccctacgcaccattctttgcaataaacaagtgcatgcacaatatgattgtgctaagggtcaagaacttgttgcagtggctaagttttggataagaccaatgaacaaacagtactagtagtttgttttatgaaatttgcatttctgcagctgttttctaacaatttcatacggcagcctatgctgattcacttggacattgccccctccataattctaatctttggttccaaataaaatcatgtgtaaccaaactgttgtagtatgaattatggattggtgtccttttttttccctccggactcctattggcaatgtaagactatatgaagtatcagatgccactcggttggagatttaactgaatttgacatgaataggcaagatcacacaaactaaagtgctccagaacaaaaacatgcagattaggctaccaacaccagcctgaaactgttcatggacttgctgcatacaaacaacacagtatataccatgagccctacaaggctatatgaatactgctgagaaagggagaaaaaggtgaggtaagaatgtagaaattaatagatactgtaaacaaactgatattccaatactaccatcatcttgacaacagcttgcttaaatcagaaatccacagttaccaacagtaatataacaagagttaacttcaacagtatttatttgtgcaacttaaaagacaccataggaagccttgaagctatcacccctatgctgaagtactgaaatgagaggaaaccatgtcgttcactcctttttcccgactccatgagacatgttgtacaccccacggccctgtttataaaacaagaaacatgtcactgtctgaacgtaaacaagaccagagaaaacaagccacgcaggaatcaattaaaagaaccccagactcactatcataaacaagctggaggcggcaagagcgaggggaatggcaacggaggtgaccacatcataacgccctttcagatacgtgtgcttggtcaagttctgaaaatactgctgctgcttaaagagcctctcgcgcggcaaaaacggtgattctgtcattctgcatcacaacagaaggaaccaagacaaatctatatcaatatggaaagaaatttatctttcttatggacatttttgcatataaagaaaaacatacagaattagtataattactgtatttgactttgagaactaatgacactagaaatcatcactgttttccttaaactgcttacttagaggagtactaactaactgctatgcagccatatataagttgtgatgaactacttgcaatcgagcacgattgcacngtgcacggcgg

SEQ ID NO: 72481 - DNA, 6088 bp, Oryza sativa
cttcctcttccgaatgatgactccactgaactcggcaaaaccgggtgaccttgtttctggttctcctttcgctggtatccagtatacgaaccggcttctcaacataagttaggtcttcctggatatcaatgtgttccgaatcagcctgttcttcaggtacccttaagcacttctttagttgggacacgtggaacacgtcatggatgccgatcatgttggatggaagttctagctgataagccacttctccccttcgttccaagattttgtatggtcccacgaagcgtggtgccaacttgcctttcgtctgaaaacggtgtactccccggagcggagtgacgcgaaggtacacgtgatctcctgcctcaaaagtgagctcccttcgacggttatccgcgtagctcttctgtcgagactgagcaatcctcaacctttccctgatgattctgactttctcttctgcttccgctaatacttctgttccgaatagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgacccgctcggtctggccatcagtttgcgggtgataggccgtgctgaaatttaaacgggtccccaattcttcctgcagcttctgccagaattttgaggtgaactgactccctcggtcagatacaatctttttgagtactccatgtaggcacatgattctcgaaaggtaaagctccgccaaccttttgcccgtatatgtggtatgtactggtatgaagtgagcaaccttagtgagtcgatccacgactactcagatcgaatcgtgacccgacgatgtccggggcagtcccgttataaagtccattccaatttcttcccatttccattccgggatttgaagaggttggagtaaacctgtgggtctttggtgctctgccttcactcgttggcaaacatcgcagagtgcgacgaattcagctatttctctcctcatgctgacccaccaaaacttttctttgaggtcttgatacattttggtgctgcctgggtgaatggagtactgggtctgatgagcctcggtgagtatcagatccttcaattccttgtcgtcaggtacacacaatctttctcccatccagattgtgccatgctcatccttaaggaaatcccgagcctttccgactctcatgttctttttcagttctgctatttccggatcatttacttgagcggctctgacttgatccacgagcgtaggccgtgcctccagagcggctacgaacccgtgttcaacaattcctatgttgagatgttcaaactcctgccgcaattcctcacacatgctctcgatgcatagagcagtgcagtaacttttccggcttaaagcgtctgccaccacattggccttacccgggtggtagtgaatactcatgtcatagtctttgattagctccaaccatcttcgttgtcgaaagtttaggtccggttgggtgaagatgtatttcagacttttatggtccgtatatacttcgcagcggttgccgatcagatagtgcctccagatcttcaaagcatgaaccaccgctgccaactccaagtcatgagttggataatttccttcgtgtggacgcaactgccgcgaggcatatgcaaccactctgccctcttgcattaggacacatccaagtccgtgacgggatgcatcgcaataaacttggaagtctttcatctggtcgggcagaatcaaaactggtgcggatactaatttcttcttgagctcctcaaagctcttatcgcactccgctgtccatttaaatttctcatctttcttaagcaactgagtcatgggtcgggcgattctggagaagtttccgatgaatcgacggtaataacctgccagtcctagaaaacttcgaatctgcgacacagtcttcggtggggtccacttggtaactgactccacgttcgatgggtcgactgccacaccctgagctgtaatgacatgacccagaaatttgacttccgtcaaccagaaatcacacttgctgaacttggcgtatagctggtgctccttcaacttctcgagtaccagacggagatgttgttcatgttcttcttcggattttgagtagataagtatgtcgtcgatgaataccacaacaaacttgtccagaaattctatgaacactttgttcatcagattcatgaagaatgcaggcgcgttagtaagtccgaaggacataaccgtgcactcatataacccgtaccgagtggtgaaggccgtcttcgggatatcctcttcccggattctcaactggtggtagcctgagcgcaggtctatcttagaaaacactttagcccctttcagttgatcaaataaatcgtcgattcgcggcaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgttaattcgttggccgccattctgtacggtctcttatagattggagcggttcccggtgccaaatcaatccggaattcaatctctctcttgggtggcatggtagtgaggtcttcggggaacacctctggatactcgcagactatgggtatatcatccaattttctcaagttcttctctacggtgtccactgggatttccgtctcaatctgattcaacgagactcctttctttggcgagactagagatttgtacaccacggtttctcccttctcgttggtcagggtgactgtgcgattcgcacaatcgatgactcccttaaacttggtcagccaatccatcccaagaatgacatctaggtctttggattcgagaaggatgaggttggctagaaccggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgcttccgtctccttcttggcttgcgcgggctggcctgactgtgccgatgccactggtgggcgtggagctgcaccgcggttgggctgacctccatggtggttctgactgtcactggtgccctggtagaagttgctagggttgaacgggcggtgctgacggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcagcgtagtacccggatatcagctggttggtcagctcatcatccaggcccgccatgaacttctcctgcttctcggcgtcggtgcggacatcctctggtgcatatcgcgtgaggcgattgaactcgtggaggtactctgtcaccgtcctgttaccctgatggagtgcacgaaattccctcttcttttgtgccacgaccccatctggcacttgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctattgcatggagccagtcatttgcctccatagggttggtggtgctggagaaggtgggtggcctgactcctaggaactcaggcaatttggattgagggggagggggaccaaagtgctggtgctgctgttcgacgtgctgcatcatcctctggtgcatttgctggtgttgttgctgcatctgctgcatcatggctgccatcatctgagtctgatgcgccataacttgggcaagggtcggattctcgggaagtggtggcggaccattgccggaatcactgttggggtgcacgccatcaacgcgttcttcgccgttgctgccctcgcctgtcgtgcggttgccagtcctggtgtagaccatctggagggaagagcagccggggtaaagaagaaaaacagatgctcaagaactaagctttattacaaaggaatttaaactgcaattgttctgatctgaattaaaacacttaaaagagcaagcaaccaatccttattaagacagccataccataggcacatgatatcgaccgtcgtctgacccaaacaaacaacctaaacacacaaactaacgaacaaaagctagacagtcggtaaactagtgggaaaacgagcataatgctcggaacggctcctgcggtcggtggagtcgaaagcgtcctcctgctggtcaccaggtccctctgagcgactcctggagcctggcagatacgtctcgccgctgcctgactgcgagccactggagctgctgctgctgagatcgcggctgccactgggagtagcagacaaccaacccccggtgccactggctggacctctggcggctgacgctggagcgaaggagagagcggacgcgggagctggagctggagctggagctggagctgcaggaactgcgggcggaactggaggtgctgcgggagctgctgctggaggtgggtttctgggtgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtctgtcacatcctgattttcgtttcaggatttataaattatttaataaattattaatagaatttatattaaatgttctttaatttacaagtgaagttaaatgtgggaaataaaatttcctaaataaaaaaaagcatagatggatttaatttttattaagtcctccatgattaattatactctctggaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgtgggcccaatcc

SEQ ID NO: 72482 - DNA, 3837 bp, Oryza sativa
aatagattatactctgatcagaggtgtacaactgtacccacacgagatgaacaaggatcaaatgctgcccaccacacaggtgcgacctacaagtgattcaagctcatcacatatcctttcctagcccgaccccaaccatttaaaccacaccgaggcccccgacgactcagtcacgtgcgtgtgatgtgactaaggcgggctcaccacgcgggagataccccatgccatacctcggccaaccgggcactccgcggatccgaaatcctcacgtttctccgatgggtgtaaatgatcacggtaggtctagtaatcaaacaagccggtcccatgatacggcatgtggtaagtacgtaggttgcttgaatagacgtcaaaatgttcagtccttaacgacccagacggagctactgcatcaggggaaacatacctcccatcatcgccctaccacccgttcaagtcaatcatatttcatcaaccattatttaatgtaagtgcttcagttttagcccattaaccaagttgtctatatcccagaattaacaaaactgtccagccatatagttgtatccccactaagcaaaactaagcataatgaataaaacatcccaactattcccaaccaggagagtaataggtatatggcagctatatataactaaggtaaatgcaccaattaattatataccatgtcacccaaaactattaactaagcaaatgcatatatatatatacatatatatatatatatatatatataggacactcatatggggcaccatggtgcccgggcaccatggtatcaaatgcacaaaatcacttaaattttttaaaattttcaaattgtgagtatatactagttataataactcgattcatacctatacctatcaacaaaacaactcaaatttaactttatttcacaatccatgattacatacctaactaattatatgtatggatgctatatacctagaatcaaaatctaacaaaaataagttcaaattcagttcaaacttgctttgaactagttagtaaagtagctaatgttaatatctaagtaattgaaaaagtttcatactcatttgaattgggtatatactcaatttcaacaatggtgcccgggcaccatggagcaccaaacaaatttactatatatatatatatatatatatatatatatatatatatatatatatattcacaaccaaagtaatttaagtaaaacatgggtgctagatgcttaggtgctcgccttgttgttgcagatcatcagactcaatctcaggttcttgctccacgtactccgaaacatctgaatctaccgataaaagacaaatatgtaaataagattcaaataaacatgcatatgcaacatgctctataaattgatagataaatacagtggacaacgtacaagttgacataaaaactacatttgctgctctagcttaggagatacacaactaaccagtcatatacactaaaatggcaacttttgaaaataaaacaaacagacccaaccatatactgatatttttagcaaccttacgtgaataaaacttatatcacaccaaggagccaaattcactggttctaatataatttgaatcacccaatttagacttggaatgaagtaactatgcgcgttgacttaatgtgacaaatggaactgctactcgctgccccttagcagaaatttgatttcatagcttacaattgaaagaaatgatataggtgcataagctatgtggtgggataattgatttagttcggtaattattagcacatgaatttagtgtaattacattgtaactccagttatctctttctcatatattaccaagtgactttagttccatcctcctctgaatatccccatgcttcttgctaattaacaatctacctaaagcaccaagaacagtgttcctagaattttgcaactactagctattggtggtggagttcagtggcaaagcaatctttgtgaggtccttttgtgtgagagaaaacaaattgccgaggtgctgaaaaatctcaccaaaggatgaggtgcagcaggctggccctaattttcttagggacgacaaactcaacaacaacttggatcactaatgcaaatcaccatgatccactgatggctgcagaaggataggtgtgagctcatttatatcctacatttggtgaggttgcagtgcctggtacacgggtttaccggagaagggtatcaaactatcaatatagaaagagcacgatcaagtagtacaaggaagaacaatacaaaactcaccttgcgctacttgcaggacaaaagcaccgtgagtacttgatcctaaagctaagaacataaatctacaggaggtagagacatgagaactcaccaaaacagaggaactcaaaggaaacatgggttattgttgctggagtggagatatatgaattgtagctgctctttgctctcaagatttaaatcggtgacccatagggagggggagaaataagggattgttagcattataggaactcaagtagggagccatggatgtagaaagaacttaccaacacagaaaagaaacgtgtcatccagctgctgcaacctcgcagcctgcagctccttgctgttcctccttcccgatctctctcaaatggccatgcatgtgcaagatatttggatggatggaaaacctagagccccagggatccaaaggtgtgacatgcagggtttggttttggatgtttgaagaagattttgggggagaaagtggggagggagctcagcctaaggaagaacgtaaagtggctagcaatggaaagggaggaggaggaagatgaagggtttttcttgctgtcttaagttcctgaggtggggttgcacgcccaagaggtgatctaggagatatggaaccggccaggtcagtaagtcgaactgggcccataggacagataaagcaaggttagaaacatagatacacaatgaaattagtgaattttcaggaattttctctctctccttctggttaactagtttgacctagctacaagaattccaaaaatgggtgatctggtgtgtgtgcatagcttgagttacctagtttccatttttcaaagtttcactcaaaaattcgaaatatgttaattctggcaaaaaggtgaaaagggatatgctgagaactaaattgaatttcaatgaggtcaaaactaagtgtaaaaattgtagaaaaattatattaactcatgataaataatctagtatttgaataaattataaaacatatatccttctgatcaatttttaagcacatttaggagttgcttcattttcctgatcaggtttctaattaatcaatcactgtgactatacttgactgatatatttgaggtagtaaaaagagtgataaaatgatgaaacctttacagtggtcatcttaggttgtctaattgacatgaggacctttatggaattttatgttgcttagatttgttacagagtatctatgttcatttaacatgtaccaattagccaaacaaagaaaatcatttaagccaataaattggactacactacaaccaggtacacaagcatacattcactagttactcaatctactagccaaaagctatgcgtgatcgggtagattatcaaataagcgaaatatgagttacaaaattaccgattggtcattcattatagttaaatacaaagaggtttcaatttggctttagagctaaaagggagaaaaggaaaggtggatcttcgtgaattatctggtattgagtcgtgaattatctggtattgagttggcttagtctcttatattctcgttccattcgtgcaaggaa

SEQ ID NO: 72483 - DNA, 3097 bp, Oryza sativa
ataacggttcttaggcatagttgtttccttctccatgaaattctgcataaatttcaccaggctgtccattttgggtggctccacttcgacctcttggatattctgtgggttcggcccatactttattctgaccatggagtattgttccgtcctcggttgaaactcaaacttctcttccttgccgttgacgtggaacgggcgccccaggatgagcggcgtctcttttcccgtgtccatgtccagcaccacgaagtcaaccgggataaagaaatcccgtgtcttgactgacacatcctccgctatccctgccgggtaacggactgacgaatcagccagttgaaggcgcatcggtgttggtgccaacactgtgaagttgagtctatcgaagacgtctttcggcatgatgctgacactggctcccaggtcgtataaggcctggtcgaattgttgtgccccgatctagcaagtgatcgtaggacacccctgatttttcttcttctccgggagcttgtggagtatcacgttgctgcattgcttgaccacctctgttgttgggagcggtctcttgttgttgactatgtccttgagataacgggtgtatgttggtacttgcatagcatccaacaacgacacgttgatatggatcttctggattacttcaacaaaacgagcgaattgctcgtccactgacggtttcctacaccgttggggaaacggcagcaaccgtgtgtcgcagtattcctgcggcacggtcttctctggctgaacctctttgtcagccgagtcactagatggcgcttgttttgatatcccgttagttcctacagggttaggatatagcggatcacgagtggacttacatcctctcgtcgtgatcgccttgactttacctcctcacgagtcgggtcgccccagaatcctcccagtttcatttgcagggtttaaggatgccaactgagctagctgggtttctatcattttattgaagctcagctggttttgaaaagcagaagcgaagccatctaacttgacattaatgttttctaggatcttatcattggccgcaagctttttgcttaatgcatcggtggttttagcttgcgcaaaaacgagatccttcaaggagggctgttagaaaaattaccgttgttgttacctccttgataatataggcgtggttggttccacccctaacctccttgtgaacgatacccattgttgttgcccatgtacatcgcctcctcacgggtttccgggtagtcattcccagaatgacctgtgttgccgcagacctcacatgtgacgtgagagtccaaggccttgacggtgccttgtggccgtttctcgtggtcgtccaagcatttcatgaggaggtccagcttggcagcaagtaactccgactccttgacggtgtgcatgcctcgctgacgcatctgaagtcgttcctcgttccaacccatattggagaccatcttctctattagttcaacggctccttgaaccattttagagaagaaggctcctccagctgccgcgtcgaggtgatagcgggacatcggggtgagtccattgtaaaagttctgcaggatcagctagtcgtccatcccatgatgaggacaggcggccacttactcctgtagacgctcccatgcttcaagaatagactcatctcttgtctgctggaaactggaaatccttccatgaagggcattggttttgcccatcgggaagaatttcgagagaaatgccctagagcatttgtcccaggtgttgacagcagcacggttggcatagaaccactgcttcgctctctcaagaagggagaacagaaatagtcgtagcctgatggtgtcgggactgacgcccttgatggtgtacatgctacagatcttcaggaactgttgcagatgagcattggcatcctcattaggcttgccacaaaacgggctagcctgcgccatcgtgatgaggctagagttcaagtcgaaatccacgtcgcctatgttcacctgtggcccaatgaccacattgtcagcagagggagcagcgaactcgtggagagtcttgttagccatagtcttgaacgtcggtggcgctggtacggttggtttctttgtcggtagagttttctgcggagcaactacttgaggcctgacgctccggaagaaagcgtcagaaatgcttgttggtatttcttaacgacattactagaaatataatccccggcaacggcgccagaaatgcttgttggtatttcttaacgacattactagaaatataattcccagtaatggcgtagaaatacttctggtatattatggttacagagttcatccgcaagcgcacggatataccattgtagcatttcacccgagagtattccaagggtatcgtatttatttaatcccgtgagaagatcataatagagagaaccgtactaataatttatatattacttgtaataatcatagtcaaagcaggggttaatataatccaaagggtagaatgacacacaagaatgaagctactcattctcctactaaattatctaagctaagtggaaagaaaatagaaaagaatatattcctatacttctagtatacatagttgttggtgtttcttaacaacattactagaaatataattcccagcaatggcatagaaatactcctggtatattatcttttgggagatgaagtaagcacaaaggagtaacattttctttaattttcttcacatttccaccatatatcacagacacactttgcacgatcttgatcttgagtatgtttggtaatctattttagtctatgcttttgacttagtaataaatgtgaatgtaagtatgccatgtttgatcccttccaagctccacatatcaaaccttagagtaggaatcaaaaaggtaaaaaggtgaggaattcatattgatacatttggagagacatagtgaatcatttgaggaacttggatttcttttgcaaaatcatttgaaaacttccggaaaaaagttgaataaagattgggtgattagtgcgctaattgctattctgtctttcaaccgctcaaggcaaggatatgcaatgtctcgtgagaa

SEQ ID NO: 72484 - DNA, 46797 bp, Oryza sativa
  unsure (1)..(46797): unsure at all n locations
aaagggtagggtttccgtcctccgatctacctcacctgccccaaaatactcatccgcagctcggatccacaccagagttcggcttcttgcatgtcgggctcgctgnttttctttctttctttctttctttctttgggtggggtggggtggggtggggttcatcatctcctaatttcatggctgaacatggctcatgaccaggattttatagagttaacagttagtcactcacaatcttcaaatcacaaaacctaaaaaaggaggtctgaagtatcaagtatgcaacaaagcatgcatatgttactaagcaacattgtatcccaacagtcttacacctattcaaaattacatgacctcaaacatacatgacaaattatacacctagagcctaccacttcattcctacaagcataatacaagaagttgacttgggcccaaaacagaaacaggttcgtcatttgtcaagcaagattgggccacaccaatacacaagaatattttattatgtgagcatagctgaacaatttctgcggggttctgaaaatcatattggcatcagagtcaaccaaagacaaacagatgctaaacacatactggtacagatcccctagatgtagccacgtcaccttcttctcccctttatggtgaacaccccttcctccatgcacgatagctgaacacctctccctctatatggtgttgcataatttttcattcacgcaatacatctatcacattttatcggtgaggcaatgagttatatattcgtaactaataagacaatgaataattttaagttacggcataatgctattttgtaattttcactgttgatcagctaatgaaatactccctcccttttatataagagaaaggctcttttgtatctaagaaaaaggagatagtactaaaattaattcaattgcagtaaacattagtgtccaaagtttctgagaaacaagtatataactactaatatgttgctgtttccagtgtgatatgttttcacacaagatgttccttctccaatcaaggattggttgtcaactattgatagagccccagaagctaataagatacagattacagagtggcatgtcaaaaggcagtataggtcccggatgcatcatgcatatagattgatgtgttgcagcggagtaagaatatcaggatcgaaatgatgtgtgacccgctagaaatcaaccaatggcttagatcagctgaaatccaccagattgatttggaggcaactccagggcatctgcacccaaactgatacagcgagatacacatacaaaaacacgcgagaaattccatccacgcatcaccaaaaaaaaaaaaaaagggcctcagattaataacgctccacgaatcgcgcaggtcgcaccaacatcaatcgcgtcaggaactcaagaaacacgaacagatctgctccgccattaaaacccctcctctctcaactcccaagcctcccaaccatcacatcgaacatcgaaacaacgaggcggaaatacaggaggagggaaacaccgcaccttgagacggaggcggaggaggagtacgacaacggattgattggacgatccttgcagcggcttgggggattttggatggatcgcggcgagaggtgaaacgaaatggggggaggaggaggcaacgacgaagaagcaggaacggcgaccgagtcggggaggagacgtcttgggaggaaaatgggccggattacttctggcccaacaccaaattttgggccaataataaggcctagtagtactatcaacagctgagggcgtgtttggttagctgcatttaagactatggctaataggtggacgattagctggtatagacgtggaagaggaaaatcagatgtgagagaaagaagctggctcctttacaatcgtccgcttggcatgagcgtctaggtgctttgacaacctagatccacgtcaagagatgggagatagagtgtacactaaacccacataatattaaaacaaaatattaatactagaacaagtgtgtagagcctgctataatataagatttagagccgatggtgggctcctatattattcttgatctaagggtggctcacacctatgtgtgacagttatttggttgtcagtatgaccgtcggggtctagttccagcattccattcatgcgaaacaaacacctgatccaaaatcgctagaaacacgaggaggtgagcttcgttcctcatgtaggttatgctcgtgcaggcaccaggtcggtgtaggaggtgagatagggtcacacattgagtcatctctctttctccaaatgctagtttgtgcctcccaatttgttgtcgcctccatcgtgccccctcaccagtggatccccttccccctcctctttggctatttgtagtatacggtgaaccacaacctcacaaccactagatctgatggtcgtaagttcagtactattggatctggtagtcccgacctcagtttggataaaacatatgagccaagctaaaggcattcgggtaaccaaacatactcttaaaatgtcatgaattttcatgtggggaataaattgattcatgtgaaatttgtattaagggatggttaggttctctattctataaagattcagcggcaccgttaccttttccctttaaggttgcgttcgtttgtgtcggttgggagtctatccctccggcacgaaaaacggaacagcttattatcgcataattaattaagtattagctaaaagtagctttaaaaatagattaatgtgattttataagcaattttcctatataattttttttcaaagaacacatcatttagtagtttgaaaagcgtgcacacgaaaaacgagggagagggattgaaaacctgcaatgccgaacacaacctaagaagggcttgatttctattagtagagaaaatgtggccaacatttgagcccgattttattagcattatcaaaaattgtgtttgactaaattttgatgaggtgtttagtttggtattaccaaactggatcaagaaccagaaaattgctcatgccatctctactagacgtctttttattgtgatgcttctaattaaactgatggatcctaaacctcttaaaccaaccgtgtcatgtgactaagtgacaactaacaaagatctctaaccagctaagttccacaaaaaaaaaaggtgatttttttatttgaaacgatacgcaaaaacaagaataagccttcagaaaaagaaagaaaaaatggagccgatttgcctgccaacagctgatccaagcctatcagagctgatcacacatgatgatcatgccacgattgacttgcaaatttaacggttatggattggtaggtgcgaggcatgaccggatcctgtctcattggcgtccatcatttcccaaaatcttatccagccaaatgtttctctcctctcctcttcatatcactgtatcaaaatgcatatatgattctaaatttctaatctctgtacctatcctaatccgacaggaaacagcttaattatcctacacttacatgcctgcaacaccacagaaaaaaaataggccaaaatgtattgaggggaagggcttagctggcctcttttctgtgccaagaaacaatgcatctctatctatagcttgcatatatcaacatatatattatttttatatggatcataatggaggtttctttttgtgttaaaaagttcagaaatgaggtgttcattgctgtgatggtttaagggtagattagtactagtggatacatcagtaagcaaatcagagaaggctgaccaagtttagacagattacagatggtagacacctgttatttctgcgtgatgaaatggcaacttgaattttttttattaaaaaatgaaatgaagagatacttcagaaaagttttgatgaagagcaccaggttaattctgatatattctgataacagaacgatagtgatgcctaattttccttgcgttgtgtttttaattagcttgcaagtgatgttattatctgatacacctccagccacaaatggatatttaatatcaaatggtaacacaagcaacctctagtgattggttgcagcttggtggaaaatttcatggtgtgtatagaccctagaagataaacaaaacttgttcataatacaaaattaagtcatcaggatcaggaagagatatccagagaaaaattcaaacacatagtgaattaagtggaatgggacagatcatcatccaccaagtgtaggaaatacgtttctttgagccatagaagataaggcactgaagaaagaggtcatactagttccatttgaaatgtctgcatgtgttgtgttatattgttttcttaactaacaagcttaggcaaaaacaatgagcaagcaatgacaaaaaaatccactggttttcttctttatccaatataaagatatgcagccctcctgaaagttctagacaaaaatgtgatgtaaaacttcatctgttaaagataaaattggatattttttaaataagaagatgatttgctgccatgtcagtaccacctaaaaagagccattctatgcaatgatccttaaaagtactaggactatactatacatctgatatgtaccatatcatctattacagagttaaccagcctattggcctgaaatctttcaataatatacctacccatttgagctgcaaagtttgtgttttacttgtttgcatgacaagtcaggtgtaagacggaaaaacttgaagcctgacagttaatatttatatgaaatcaccagtcattttcagggaaaaattatgcagacaccagcctcttaggaaaattatgcaggaaaattataatattttcgatgttagttcccgttgtatggaaaacaagatctaagtacagctagaacagtgcaactgcgcaagttgttttttttttcagcaaggcttgaatggctctcaagagaactaaaatataaaattggaagagggggaagaaggtgcagccaactaactaacttgtgatcatatttaagcacttgtcatgctaccctcacagaagatttagttcctcctctgcctcttctccatctacagaaaactacttgtgctaatcaagttttatcttgtttcttccccatctctttcttcttgttgttcttcagactgaacttagtctgaagattcagaaataaagtgtgattttcaaagctttgctagttgcaaacgagacactagctttggagtttggaggtaagctgctgtgctttccttttgccatatgcgattcaaaatatatgagtctgtagcacccaagctaatttttttcttcacattggtaatgaacattgtcattcatgatgtagggagatcttgcttgtggagaaactcacaaatggcgataaagatgaagggaatattcaaaggcctgaagataatctctcaaatgttcggtaatactcctatctttctttgtttccctatatctctgcctgcttacattacttaagcttgcattttgttgattctggtttataaatccagattcagattcaagaaaatgtagtaaaagcacaataagatagtactgtgtgtataaccgtgagaaatcacagaaagtgatcaatgtacaacaataagtttataacacatggtttctttttcttttgcagtgcataaggagcatgagatggaaattgggtaccctacagatgtaaagcatgtggctcacataggtttgggcaccagtgacacatctccaagctgggtaaacataccaatacttgacagccttttcatcagatgatcaactactgcattatgatttatgaatgttttctgtttatgagttttgcttcatattctagtatttctaattattggaaatgtacatttctcactttcagatgaacgaattcacgggaacagaagatttatcaaccggttctctgagcacaactgcaccatcaaggcagacttcttgggcctctttaggtatttaatgtcctctcatctttctatgtttatccttcaaaaataaagtcaatacaacatatataaaggttaatcaaacaaaagattctaaaatatgaagttccattggtgcttttgaatatgccacttgagccatgcctgatataaaacgtcacaatcatccatagtagtctaattggtcctgaatcttcagaactaatcatttattactatataaacgttggaaatcttcttgatctattttctaaggacaagtacttcagtagtggcacaccacttacaccattttctttttaggttgcttgcatgtttacaaggtgcaatgaacagatatacagaaaaatcatcaaacatggtatccaaacattcatgatgaccaaataatattttttatgcagattttgaacagccaagaagcatgctgccaattgagatcttgccggagaaatctggccaggaggcaccctcctgccctgacatcccaagaggcccaaggaaggtgagaaggaagaagaccagaacatcatcacctacctcatctgcaagatcatcgtcctcgaggtcaagaacctcgttcgcaaccgcatacgacgcattcaacgaatcgcaaagagggtttcgggttgcctgaaatttacagattgtgtttgaaactaccatgaattgtacattgtatgtcggtataggaagagaattgattgtgaattgtttgattctttctttttctttcttttcttttacagtcaagacatagttggaaatgcaaaggaaaatggattaacttaatgtttgaagttgtgtgcatctcaaattttatacttctgactaattcttcagattcttttaatgattggatggcagtcggcagatgttagacttcagtagtataatattttttccccacttcagattgtggattaaaaaaaaagttttctaacatttttcaataacatatcaatataagtaagcttgattcacatcatttttttctgaaacacatacagctgtgagggggctaataatgccattgatcacgacatgcaaggaccaagaacaattcgactaactttttttctacgccaagttgccaattgccaagacaaacgtgcaattgacatgatgcaacgtttcatcatgcctcagcactttgttcaaggactgtaataatgtgatacacagctgatctaatcatataaaaaaaacacttggaaatatcatcaatctttatatctcgtgattatgcactgcactctgctttccttgcatttgggcaaagcataacctgagcatcaagggcaagaaccttttgctacctatgcaaccttacaaaaaaaaagaaactttttgggagtaaattaatcccatttttaccctgacataactattcaggtcttttgcgttgatcaacttaacctgaccgtgagtgcaatgctaagagcaaagtcatggccctgcgttgaccgacgtatcacgctgtgccacgtgtactaactaaccacatgagagtgatttgacccaaacaatcactacattggaaaatgacttttttttttccatgtaccatggactgactcacaagccatgaatattccagtgtcacctggctagtcttgagctctgctgtgaatgtcaggtaggcaaccatggcattgcaacaagcacaagagacagacaagaacacaagatggaagtaaaggtgaggtgtcatatgctttggaagctaatctcaaggtgtccatggaaagcaaagtacaccacagcttgtaaagctcccagccattgaggcctacaaatacccggctacctagcttggcctcttctcatccaccacaagaagtgaaaagcttcactgagcttgatcaattactactagttaattacctatagctaagtagtaaaaaaaaaactagctggttttggtttttgttgcagtgatcaatggtgaaaggtactagtggttacagctatggccttgggcttgcctgctttgctcttgtggttgccatggctggagctactcagctcaaggtcggcggcggcaatggctggagcgtcccggccgccaatgcggagtcgtacaacgattgggccgagaagatgaggttccagatcggagacaccctaggtaatcaattgattaaattcgagttctttgcgacaaatattattccatgcatttgtgatgaagcttttgaggtactagctctgtttaatgttacgagtcgttttgactttttttttaaaaaaattacaacctctttagcttcatcaagtttacagaaaaatatattaatattttcaacatataacaaataaaaactattaaacatattcaatggtagagttaataagactaatttagtgttataaatctatattttttctataaatttaattaaactttcaataaactggactttagaaaaatcaaagcgacttataataaaggaaagtagcgcatgatcatgccggatcatcatctatggacaatggttgcagtgttcgtgtacccgaaggacaaggactcggtgttggtggtgaagccgcccgactacaacgcgtgcaacacgtcgtcgttcgaccaaaagttcgccgacgcaacacggtcttcacgctcgaccgcgccggcgccttcttcttcatcagcggcgtcgacgccaactgccgcgccggcgagaagctcatcgtcatggtcctcgccagccgcaacggcaccgccaccgccaccgcgccgtctccgcccccggcttcgtcgaccgcgccgccgcagacgtcgcctgcacccgccagcccgccgccgtcgtccccgtcacctccgcccgcttcaccgccgtctcccagctcgtcgggcgcggttgttcggagaacgccccggccgggttgttggcttccttccattcgaaggcaaggttggcttgcccaatcgggttggtccccgcgggcccggcaatggccaaacgccccaagcgcccaggggccaagaaacccaagcgcaagttgttcccgccggcccccgggaaagggcccggcgcacccccggttgcgggcatgggccttcccccccggcatcattggttacgccatgctcgcactctgaagtctgaccatgcaatcagtgcaaaagtgaagctgttgtaataacttgaattaatttggagggagatgatttgtgtactatacgtgtgtgtgtatgtacatcgtgtgtttgtattaattcgttttccaaaggatgaataagaacaaaatgatatcgagcatttgtgccaaaatttgatgtgttcaaatccaaatattaacccttgtttttttatttgaaattcgtcgccggctgaagtgcaggcaacacggcgcgtttcagccgacgggggcgggtacggggattcaatctccgatcccggataaatcgttgggctgggccggcccagttgtactttccagcccgtttgtgaaccgttagatggtcgaatccatgacctcatgcctaacaacaaactcttccagtttatgaaccgtcgttagatggtcgaacccatgacctcatgcctaacgacaaactcttttcagtttaaatgtcaaaaaacaaactcctttcagtttatgaaccgttagatcatgtggagattcgtgcaggagtctgcatatggctggggtcgacccacgacattatgcctaaagacaagctgcattaaccagtgagcctcgtgcggatttttctgttgattttatagcagttacatataggttagttatagtaacaatatactccctccgtttcgagaaatatttgacaccgttgactttttagcacatatttgaccattcgtcttattcaaaaaatttaagtaattattaattcttttcttatcatttgattcattgttaaatatatttttatgtaggcatataattttacatatttcacaaaagtttttgaataagacgaacggtcaaacatgtgctaaaaaatcagcggtgtcaaacattttgaaatggagggagtagttaaaacggacatacactccaattatactacagctacatttaactttgcatttgaaagttcttcataaaaaaattgttgaatgttgtacaggtactcccaattaaaaaatcatcaagaggtcctttgaaaagagtgatttaggttgtgttagagaggaggggttgggaacgccgaacaccacctctccagtatgcaaaacgaagcacacattagcatataattaactataagtattaattaaaaaacttaaaaatgaattaatatgattttttaaagaaacttttctatacatttttaacagtttgaaaagtttatgcgcgaaaaatgagagaggtgaagttgggaacattaacttaagaacataacttttctttttggggaatacagttaagaacacaacttatatgggaaataaatcagctcatgtaaaaatagtttcaaatttctatcctttcatccgaaaatataagcatttatatagtttttcacgtgggttaacgagaggagtgaaattaaacgagaatggccggttgagatggaaaagttggtagagaaattcaataactgatgactgtgaatgattgatacgatgtagtaggtgaagatcttataatctaggataaattttaaatgctacaaaccattgtatcttggaactgatgcaacgcaattgcacgccaactaacgagctgattttctaataaacaagtaaatcatccatcatcgttcacccgcatttcatctacttcaatctacattgttccacccaaattcaaacgtaacttatgatctctcaaatcaaacaggtattatagtttctggtgtttctctgctaataaatcaggatcagactaaaatgatctcacatctttaaaaaataaaataaaaaagagaggcctcctcctgctctctcccgacaaatgacattggctgtcaggcagcctgtgcccaaatcaagaatcatattccggtaaaattatccagcttagccccgagtattattctgtccaactttccaagctcgatcggcaaagcatcgattcgaaaggcgacgcagttgacgcgatcgacgggataaacacagcatgaaaagcgatcgagagcccccagcacatgcccctgcatgcctgcacgcccgagcaaaacgttagcttcagcaaggcaccgtgtggcctacagcttgtaaagcctctccccgatcgatacgcctacaaatacacgcgagaaacctgcaacctgacgaaaccatcaccaaaattcaggcatctatcgacagaagcaagatcaggttagtttgttcgttgtgcatggcagcaatggcgagcagctgcagtgtgcttgttgtggcctgcagcttcgctgtgcttcacgtcgtcgccatcgccggcgcgacgcagtacaaggtcggcggcgacggcggatggggcgtgcccggcgccggcgacgagccgtacaacacctgggccgagaagaccagcttccaggtcggcgaccagctttgtaagtatatttacagttagctgctttaagattcagccgttattatttttcgagtgcacggcagatacatactatatacacatagtgaggtgagaatcatcaactataatgtcatcatcattacagtcactagtatataggttctactcttttattgtcccacatgtcggtgtctataataataatgtcattatgatagagaatatgaactcataaggacagacccagccctcggcccctaggtcatggcccggaggcctatggctgaacacccatgtaccttttttttttttgcaccatgatgataaaaaattcagtacacgtgcaacattacagtcacacttttgagtctatagcatatgcgcactgacacataccacaacacacgtaacatcacacttacacaccatgaatgtaccgatcttattgcgacatgttaataagcattttttttaatgtgtatgctagtgttcgtgtacccgaaggacaaggactcggtgttggtggtggagccggcggactacaacgcgtgcaacacggcgtcgtacgacagcaagttcgccgacggcaacacggcggtcacgctcgaccgcgccggcgccttcttcttcatcagcggcgtcgacgccaactgccgcgccggcgagaagctcatcgtcatggtcgccaacgccaccgggagcagcgcttcgccgccgtcctcctcgtcgtcgccgtcgtctccctccggtggtggtggtggcggtggcgctccagccgggcaggcgccgccgggtgctccggccacgccggcggggacgaacagctcgccggctaacggcggggcggccggcggcggcgcgaagagtggcgctgggctcacggtggcggcgagcggcctcgccggctctctgatcgccgccattgcctgcgtcgcgattgctatctgaatatctgacactttgcaagagaagatgccgtttattcgtttattcagaaagtgaattcttctgttcgtttgatgtaaaggcaatgtaccttttagtttgtactacttgttattttcccttgtattgtatctttgttttttcagacaaaccattataaactgaagacatgcaattctaacatgggaggacctaaaaaaactgccacaagtttttggaataaaaaactttcggatataattaaagtgtaattacgttgtaagtacattataactacactataacttatataaaacttgcatttgcatttgcctatggtttggttagttagcattgagatatcttacacatgacacttgtgaaaatttccaatatctttgtccttggatagcggcagatgtaaaagaactaaacttctataagaagttaaataatgagaaactttacagaacattttcacagcatatatggtcatcgagcgcctattctagccccagaacaaaggtaggatgcacgagttttaggtagcttaggtaggatgacaaacacggctagcttaggtaggatgcacgagttttaggacctcagagagaatgaatcacctcctaatgctagcttaggaatgactagttctagtacttcatataaaatgaaaaggaaatgctattcttctgttgacagaaaatgcagtgccaaatggatcaaaattcaactttgcagtatatcgccagaggccacacccacatcgtaacatgtagaaagcatgcgcagatagcataagacaatccaaccatattataaggaaccacgaaggtacacatattgggtttgttaagcatgaaaactggaaatttccttgaaccaaaacatagcagccgaattaacttgacagtcaacaattcaggacactgagcaaaactaaatctctcttcaggaacattgggagctatgagactatccaaagaagagatgctccatggcgacaagttggctgacaatacatctacagcctccttcctctcctacctccctttctgcgggtgctgtccgtgggaaccggggtcacatcctctgcaaaaaggatcagacatacaatcatcacaatgtctaaggaggattgaagcataatgagcctgctacaaacactatccacagcatagatgaaacaaataactatctctatatccttaggttgtatgagtgaaactctgaatttaccaatgcgaccaatcttcatgccagagcgagcaagagccctaagagcagattgagcaccaggaccaggtgtctttgtcttgttgcctccagtggcacgaagcttgatgtgcagagcagtaataccaagctcctggaaatgttcaacagaattttaaaaatacttttaaaaagtcactcaagaactgtccatctgtccaattgagagataatgtttccatacaaaccttgcaacgctgtgcaacatcttgagaagcaagcatagctgcatatggtgatgactcatcacggtcagctttgaccttcatgccacctgcaagaattcagggaatggtcaatttacctcatcagtaattgcagctagagaaccaaatgaaataaataaacacaaatcataccagtaatgcgaacaagagtttcccttccagacaagtcagtgacatgctgcagaggaaaacattggtaagaaactgaataggtggttagactagattgaaggatatatataactggaaaaagaagtacttacaatgaaagtgtcattgaaggatgcgaagatgtgggcaactccgaacacatactctccttcacggacagtgggtccaagagtgacgttctcctccttgggctccctggtcttcctcttcgactggaggacgagtaacagttaagctatggaatgagaaggaaccagctacagctacataacaattacatttctacatgccaagttgtgacaaaactaatttatgccataacctgccatacaagtaggtgtgcacagtacactaagaaattttcatgcctctcatcaagtaaacacagagaccttcctacatcatccaaatgttcactacaaaacatacttggagtatctatcaaaaacagtgaaacacccttgcaacaattacatttctaaacatcatcaacacaaaccagaccttgttcaacacaaaactgcgaatcaaacgccacaccaatcatgtgctagggtcatacacgacccaaaattagaacagcaaatcagtgaaacacccttgcaacaactaaacaaccatttggccatcacatcccagaattgatacaaaccctgtaataataatctccctaacatgccagatgctctagtactaagttacagctctacaaagccaactcgcagaccgtgcgtgctacacaaacctagcatcaaagctgcaaatccgggcaggaatttgacccgagatggggaacagggggggactttggccttaccatggtgggacgaggcggcggagatcgaggcgagcgccggtttcctcctggtcgttgagatcacgagctcgccgccgccggagacacgagagaagagggaagggtggagcagcgagtgagctttatatatgggcgcggcggcgcgggggctagggtttgctgcggaagcagcggtgtccaactctcccgctgcaagtgggaccaggagtgttatgggctgggccaagatgttgtggacggcaattgacggcccaggttagcccatgctgtaggggcggatgggccaaacaagcagagaataattgggccggtcaatgtgtgcgctattttttgaacaaaaatttcatagagccacatctttacaccgataccaaaatttgaatctgaaacataattttgacgttgattttaaggtttttcatagtttttttaaccttgatgtttaagtcattaaaaataaatatgtaaatgtttaaccataatttttttatcagtaatgtaccgttgatgtatttactagcaattggccaaccatgcaacgatagcctcacgaatgattttagctgaatatgttatttacattctcagcaatcactataagatatacatatgtttaaccgtttgttttatttttttttctaaaaaagaacacgtagctatcattttgtctcattgcgagttgatttattattaaatatacttaaaacatgacctacattttttttcatatttacccaactatcgacgtacgtccaaaaggcaataatatcatctataaaaatcacttgtctcgctgttaaatagtcaccgtatatgtctgtgtcgtgtcgttgtcactgtgtggtgaatatatggtgatggatggaaaccaaaatgctctttcctcgtgtacgacggtgtacacgagtacgtcgccttcgtgcatgtgtgcccggcagttcacggcatcgcgtcgcaatcgcagccgtttgctccacaccacacaacacacattgtacggcgttgctccgtgcgtagcttaggtaacctaccctgggcggccggagcccgcctccaccgggcgccggacacgtcgccccggccggcgccgtcgccgtcgcggcgctcattaaaccgaaaaggcgccgccgcgcgccgcccactagctcgctggggagacgccgacgtgcgcgcgcgtgtcgcgcgctcacgcggcgcgggcgcgcgggcggcattaactccgccgttgaacgctagcgcgtcgcgtcgcggcatggcgcgccaacggacgccagccatgtgtgtgtcttgtccgcgtacgtgcgcgccgctggtgtcgcacagttgtgtgatccctatctcaccgtagcgtatgaactgtatgtacagtagctacctgctactagctctgtataaatacatgtactgcctcaagctgggcactgtaaaaccgtgcacacttaagcccacaaaaatcacaagctctcgcagtgtcactagccactagtgtgaggttacaaaccaaagtttttttttagttgtgtcatggcgaaggcgcaggcggcggcgaggatcatgacggaggtggcgccgccgcagctggtgtcggtgatgcggcggaggaagcaggtggcgaggagcctcgacacgatcgccgaggacgacagggagctgatgcaccaggtgccctacgccggcgacggccaccaccacggcgtcaagaagcaggctgcagcgaccagctcggcgagcaccttcgccacgccgacgttggccttcgagcggcagccaccgccggcgccggcgccggcgccggcgagcgggttcatgagggggctcagcaagtggttctccaacaacggcgtccacggccaggaggggtggccggagatcggccgcgaaggtcaccggcgagccatctattcacagcaggcgcacatacgtgggcgcgccacgggattgaattcaagttcattaactagctagtcgagtttagtacgtttatcaagatgagatgtacccaagtacccatatgcttagttatgatgaattacggcttaaaacaattttgtctccttgacaataataatatttgcaagacatagttgtcctctgaaacaaggtatgaactgttacgtaccaacaagtcagcatggtagagatgtgtactgtcaatctgtcacagcctagtatgtctctgtagtggtcaagggaacataaccaagggagatgcgtgccttttattttactatcacttggaacatgagcttccatgtacaatgttcagttcttaattacactgcactagcatctaatacgcacctatcgcgaaagaattttgctcacccagccgacctagtaacaacaccggagagacattatgttacactcaaatgccctaacgtgagcaactagcggtcgagcaccaatgcaaaactatgatgcatcggaagcgtctatgaagtgaggatattcgtatttaagttttttgtcctgaatcaaatgaaaaacatattgtaccactagtttgcatcatataattgtggattatcatcagctctcactcctgtttgaatctatctcctccatatgatatgtatgtacaggtatacaagagtaacaaactgttctctcttacatttactgctgataacctgcatagttcaaaatagaacaatcagtattatagtaaaaaatcatggcaaagtacagttaccacatacaatttgtttggcaatagaaggaaaaggatgcatacaccagtgatatgagggcttctgtagtatactaatgaacattgccgaatgggcaaatgccagagaaaccaagcttatgacttgaacaaatatcctctcatgctttctccaagcactggattgaagggctgtcaaagagtaaaccaagtcagaggccaaaataagttaaacattccattatccaaatgcattaaacgaaaacctgaagcaccagggaaaaaaaaaaggaaactacaggccaactgcagccgaatatgaaagatgctctcccataaaagctgcaaaaggtttattgcctgtagggatatttggaacttggaagcaaagaaatgggaaggtttttgagaatattactcctgaagaggaaggttggttcagaagtattaaacaggatattctcctgcatttgtgtaggatgaatgagtctcttagcccttcgattctttcctggttacagcagttgtagttttgttttgctttctttgttggtttgtaaatatttcctctactaggcaaggcctggtagtattttcctttaaaaaaaagctgtaaaagtaagagaaggcaccatctagctacagggagaacaacatgtagaacagactaatgaagagcaggaagctgcaattaaatctaaaagctaatgatgcagtttagacatcctggaaatttgggatgaaaacaaaaagaatggtagaaaacatttgacatgatagtggtaagattttcttaagcccctgccattaccctatagctgttgacttgttgtatacaaaattataaaacaaatgaagggctgaccttttgttgctcaaaacatgtagcagcaagctcttgttgatgtttctagctacaccactaaccacccacagaagattttatcttgttccgctgaacagtgccttttcgaattaaagggttttctattgaaaatacaatcaaactgccatccttggttcctgccaagaagcactcctctggagtcacaactagtgaagttatagtcttcccagctccctcatacctccatacaacatcaagagaatgcatagagcgaagaacaatttgtccatgatcaccagcacataccacaaactcaccacaacaacttagttccatgcaattgagacggccattggcttccgaagaagcaatatgttttccatttatggaatacatatgcaaggataggtcactgtcggagtaaaatactagtctgccatgctgcgatgctaccagtttcgacaagccagctcctgatggatgtcgaatggatcgaacatattttccctcacgcaatgtatgaaatatacatgttccatcttttgatccactgataacgatatctagttccgtactaacaaataagcatgtgataatatcatcatggccacataaaatatgataagggctttcgataataacatgatccttagtagacagatcataatttgcatttcttgattttttatcagctgattttcctcggaatgcatgccagatcataacagttgtgtcataacttccggttgcaattacacttccatctgatgaaactgcacagaagtgtgttgacagatgtcaagataaaagcgaaagaaatatcagagatacaaggtttcctgaccaaaataatatatcaaaaatgacaacatatacaattaataaacatcaaattaataattactagctgataacagtaaatatacatgatgctgccagttactaataaaatattatttagcaagctctgctatcatacttaggctgcgtttggttgcaggggttcccaacccctctccctcgtttttcgcgcgcacgcttttcaaactgctaacggtgcattttttgcgaaaagtttttgtacgaaagttgtttaaaaaaatcatattgatccatttttgaaaaaaaattagctaaaacttaattaatcacgcgctaaacgctgcttcattttgcgtgccgggccaaccctcactcctgaacacagccttaatttgctaacagaagttcactaaatagtgagaactacacaaagcaaaagaatggaggtgcaattgctagcacttactgtttagttactaatagtggtttaaggttggagcatgaagagtagatttaatataatatactggattataaatatttacctacctgccacacagctgacaacatctttatgctgccggacgctctgcacaattcttccatcaccaagggaaatgatctgaaaactattctcccaattaccacacagaattaaataattatcaccatgaatttgaactgctgttaggcattgccttccaaaatcaacgttttcggccagggaagtgctaattttacggggagaaattacatcagagccaattccaaagaaaggttcctacaagaatgctaccaattaatcaataagaggtcgatgacatctaagaagttctgccatcanatcttnggggggggggtgtcggcgctgacaataaaaaaagatttccttttacctcaacagcaggcttgccgcgctgtttataaccaaatatgaggtcaatccagtgatggagattagagcttacatattcactttcaagagcttcgcggttgatatgaatgaattcttctggacaaccctacacaaaagtattgcatactgatatattaccatatgagttataacttttcagctacagatcttagacaatgtattattgaacattttaactgaattgcattagtaaatactacattataaaatatttcttaggactatacttctattacttttacagatacatcaggttaaaatccttgtgctcgaagtttccacttgaatacaatgaaaggtattccccgcaacacacacacacaaagagagagagagagtacaacgagagttaaaaaccagctgatgtaattacgttatgaattgtgataagcataaaatctaccatgatacaatgttatttgaagcaaatggaacacgtttctgaccaaaatttttataactgaagtacaaaaaatttcaaaactatatgaagaccacaggatgcaactcaacagggacataaaccattcttatggatcaaccgtatgctagcagattatgaataaaaactataccggtgctcaatacaggatttttttctgttcctcacccaagaaaaactaataaatatcatgatttaatacatgagcatggatgcttagtacaatcatatgtggaaacagttcgttacctttgcccatggagggagaccaacattgcctaaaggttcaccatcctgctttacaccaaggtgataggaatttgaattttcaagaaactcgggcatataaaagaactcaggtataagctctttgacatcacttgtatttgataagcagttcctatatgtactttcaatgctctgaaaaagacgatctgcgtgatcaaactttccaccctgtacaaacatgtaaaacaacttttaagataacataattttcaagcttgtagaaagacttagaacaaagtaaaaacagtgcaatgtgccaatatatagtgctgagatcgggccagcaaataaagtaaagaaaaacctgcagattgcggtgcagagcagtaaaaggctcaagcctaagaaggtaataaagaacgattcccatgctagagtagtgagatccataataaaaactgcagaaagaaaagagacataagtttgttataaagaaggacgcaagaaaatgtacagtgtatgtttgatcaaagatcaaaccttggtatatcaggatcacagaaattaagatatctttcttcaaaaacctgcatattgaacatcatttattgaacactatcagagggaatgacaataggaagtcacagcaacccatagctcctcatcataccttaaagcgtttggcatccaaggcaccaacgggttttgacaggtcacggaaactggatgacttgttgaaatcaattttctctgacgaatagtcagacaatatccaagggaatataggatattgagttaagtcattgtaagatcgtccagcaagagtgttgagaatcattagatactcaaaattgctcatttctcttcttctccaactttccctagcactctcagccatttcaagggcaacctttctgtcaacaaaagaaataacactgtttttgtctttagtacttcctttggggaacaaagcatcatttctcagggacactaagagagacccaatgtttttagcatcattttgggaggaaaaattaagaaacacaagtgcattggcatcatcaaagaatatctccgttgcagtatattgtagtaggtaccgtgtccaatgaactgcttttatctggcaaacaaggacaaccgggaattaaatttggagtgacacatatcatgtgcttgtggatggttgtgctggtgcatgtgagagtaaatgatagaggacgtaccctgcttattttccaccttctatggtgtttgatgttgtttgatgtatttttcatcagagcatcaccagattcagttgcattgcctcgtcctccgtcaagactacccttcagtttttctgcaccccccaggtcgttcttggggtcagaatctttttcttgatatctgttgaaaacagatgttcctccagtgccctcaaccaaaaattcaaaagaaaaatgcagggctttttgtgtaatagtcaattgtccagcgagttttctctttggggttacaagaacacattgaactgatgacagaatctgggaaaatgagaaaataaggatcccagggaagaagctattaaaaacggtatgtcaattttgcatatacaaaattacagataaagcctacttactgcagcatagtcgtcatctccaccagtagacactggttctttcctattttgaacactagtagaataacctgaagaatctgcagcatcacttgagccctgggtctcagacagggtattctgggaaggctcactcatgtcattgttatcctcgcaaggttcagaactaacatcccctgtaattccacgaactcctttcagaagtaagtgcttcattttttctggaattttggcactaacagaggggttgacagacgaggcattgctttcattactaaatttggatggtggctgacaaaggcgttcatcaaacttatagttacgcttgagtttcagtcgtcgccgccatttatcttctgtcttgtcaagtttccagtacgtcacagtactatttggaaatgggttagcagaccatggtcctctttcctcactcaaagcacgaaaaatatgtatccatttgtcctgatatgcaacataggtcacttcagatgcactgaaaatatatatgtttggtaaaaaaaactctaacagcttactgcaattatttgctgatcctcatcaaatgcaagctggagagctgcttttctactgtcgtccacagaaatggcagcagacttagcaaactgtatgtcatcctcaaagctttgcagttgttctatatcttcaattaagctctcatcaattttggaatgaagttcctggagctgcctcaggcgatcagcctttgcatccttcatgtatttgacctcatcagcagcctgaaaagcaccaaacatattgttcagccgtagtgtcttttgtgcactgttcacaaaacagacccaaaaaataatagccttcagggttcagtagcaaaattttactcctggtaaaataaagaaaagaaatgtggggcacattcaagaatctgtgatatagtaacaatataagaaccatattgtaaacgttttcgaatttttgggaaagcacaaaaggtttgtaatgaaaaacattgacagatacaaaccgcagcaagaacccggtccttctgaacaaaattaagaacataaccagaatccttaagaacataaccagaatccttattgctatttacttcagtggaatcatctcttgccaacatattagtggcaagcagagacttcccttgtacgagaatttcaaaaatcaatggcgacataatatgagaacgggcaccatcatcaagccccccatactgggatctccccctaagtaaagacctgcagaaagaaaagaaaattactaaaacagccaattcacaaacaatgagcaaagtttgcataagtatagccataccaaattaataaatgcagtctatttttgcactgatcatcttctgaaataagattaggaagcaccaatgtgaattgcttaacatacttggataagttttccaagccagctttgcacagatacaaaattataagatggaagatgattcttgggaatctctcgcctcttaacatcatagctttgtcagcattcttgttcgcctttccacttagtgcagaaccaattcctccagttaccactacagcagccatctccgcggccgggatattcagtgattctaccagcccacgtgcccgttgtccaatagatgggacagcagcatttgaaccctttggagtcaatctattttgtcctctgccattcaaattgcaaataagagtccatatcttgtcgtaaaagctccaccaatcatcactcagtttatctccatcagtatatgtactattactccaaggaaagctgcaaaagtgcatatttacatatttgttgatggtaaatacaaattgctcagtaagttataatcttgcatataaccaaaggcaagcaggaaaatataagaaaatagaggctatcatggatgaagacaagctgcttaaactaatactaacatatctgactccaaacggaaacaaaaccaaacaaacttgagaaaagaagttggtgtcaaataatcggtattgaattatctaactaccaacaatatctttccatcagaaagaatactagaatacttaataatgtcaagtgaattagaacacattcctctctcacgcgtattctctctgagcctgggctttctttatgtgcccgtgttacagttggtatgtggcaatatttactgcaggagttactactatattaaccaactcaattacaaaataaaggagctatgacaacagataagacattgttggtatcgcgattaagtttcacacacaattagcatagtacctatgcatcataatggatgacaacaaaccttacctaaaataaaattagtaagttcctaaaatctaaaaattgtacacatggtcacataagatcaattaaccacctaagtatgcacatgtgaagacaatgccattgtccttaaaagaaaatctagcagacaacacacaaatgtctatgtccataaaatcaagaaggtcctaggtgtggtggggtgggtgtatagaactttactagaagtataggcaattctagcacctttaaatattcagaagagttcagtcatgagatgtattaccttgtaagttggccgctaccctcagcatttagtatttcaacaacagaggtgttaatgtcctctattagagagtcatcagatgaagattgtgcagataagccaggtgaaggaaactgttacaaaagagcagaatgagtgaaggcatacataaataaaccatatcttttcttgcttggcacattattcagatcattagcataccaatagtttaattccgatttgatcaacaaacaattcatggataagcttcagaagatacaatatattatcacggcaaggttgcaaaaaaagattttcttcagaagatgtctcaagcaagcttcccacaatgtcttcaaagatgtctcgtatcagacaggaattcggcaactgaccctgtattttggacaatctccataatcacactagggtgggaaaagggcactaaattattaacttgttacagcataaacaaggagattagctttctgacctgctcgattttcaagagaaggaaatttgttgtatcttccagctgatgccagccacctttcatagagcacaagcagtaggtgaggaccaatgaatacatgttcctcacaaggattaactcattggtttcataagtattatcctcagcttctgaacttgatttgtagtccctaaatacatcaagtttcacagatgtctcaagccaagagctccaaccgtactcctgacaaaatcattttattatgaatagataactagtttgtgtagacataagaaaaacggtaactagtaaataccacaagggcttcaacattagaagggtttgaatccagcaaatcaagaagatcactcaagatcttagtccgtgctaacgtgtcttgacaagattgcatatatttaaatatacagaccaaaatctgaggaacagcaaatggagacaagctcgctgaagagatggcactatcttttgacacttcagattgggaacgtttctgtaagacctgaatagaaaatatgatgcaagcatcagatgatccattaatcagttttggttagtatcaagaagcctgatataagaggataaatataagagtactaaatttataaacatgaagttcagcaagttacctgcttaggactggccccaccaagaaggacatcaaagagagtagcacgtaaatgatccgaaagtggaaatttgaaaagtctttcagatattgaatagaagaacagttgaggtgctgctgtcatgcctttccttagattttcagaaatagatctaggccgtcctacaggaaggccaaaaaattttggtccttttttctcagaaggaactccaaccagaagttctccaagaaactgaagtcccaagaggcgaattggctcgaactccctgaaaagcaagtgatttcatacataaatatttttacaaatctaataagaacagaaatactccactctgcatttcagaccgcgactaatatgcacaaacgaagaatgtgagcaaatgaaaacaaaatatggtccagtagacataactcaaatctttcgaaacaattagtcagcgaaattgggacaggtttctatttcaaacagaaaagtgcaaaatgcataacaatggtattacgtgtgataccttactgataagaacaaatagaggacaaaggcaaacatccatagagcagtacaggtgcaatttgatataagaaagtaactatacagtttacaccgtacgtagtataactcaggaaaatactcaaataggaacatggggtcatcttgacctgacccataggcccatgttcatttccatacaatagtctcaaatggaacatcaatttatacccatttcttctttataaaacaaaatatatttgtaacatgcattaaagcccgatggcagcagtgacaacctgacgtgtaaataactgaaagtgcattacctcttaagaagattaatgaagatgtaacagccaccaaggggattcactttctccaagaaagatgataggagtgaattatgtgatagagcacgaataatcatgtgaagtacatcttcaatacatgcaacatcttgacttctctcgaaaaaggacacaagtgtcgttatatcatgttgagaaacctttagcctgcaatagatgattgttgcattacaattaaacaagaaaaagatgagtaaaattgatagcatatgaaacacaagcaaaatactccttgaaaatgaaagcatctatgaatcaacagttggaagtgcttactttatactcatttctgccagactcaataggagcagacggatcttgcgaatttcttctatgtttggcctctctgcaatcacttttttggtaacaggatgcagagaagtcttagaagaccttaaatcagtcttttctgaataaaactggagtacaatgtcaatgatccttgggagcccacacaacattggcaaacatttcccatcgcattcaaaatattgtattagaagcaaataaagttctctctgcacttcatagcttgcatacgcccaaatatgtgggttcagataaatttgtgaaagagcatctttcaatagaacgtctgacatacctgaaaaggcagaaagttagtaatctatactttctaaacatgcagaaagacagatagaaagacagatagctcaccacagttcttcaaaacattaagcatgtacttcaacgacgaaagagtcttaaaatttagcagctgtggtgaaacagattgaaacaagaaccctaatatagagaatccagaaagaagatgcatttgttgctgatttgctacatttccatccaaaacagatgcaacaagctcaacaacttgacctgccaattcatcaccaatggcaggttctctactatgaattacagcatcgtcaaagtggatcagaagagggaaaaatacagagacaccaccaacacaataaattatttcctgcagcaagcgccgggagcataactttgtcccacccatgatagttgcctcaaacttactcttgtcaagaccatcaagtgcagcagatacattgaacaaagttctattgttactagcctggacagaaaaggacaagatattcatttatcttgttcaagaaactaactgaaaaaaaaaacaacactatgcttagagaccaatgtaaacctgtgcattcaagccaaaaatcatcttggatgaaatgccatcctttccatccagaatacccttgtacagagtgtcaacgttcataagcaagttttgatcaccaaggaaagagtacatgtaacttggtcctagattatatatgccttttatttgttccgaagaaagagcatcagaaaatgcatagactgggcccatttgaccaacaaaggcagaagtgctctcaaaaccaagggaagtaggttcttcaccaatgggcatcaaatctgtgccaatactgcagcgagtcattacttcattaacttttgcccacctaaaagcagaaaacgattcaacaaactgtaatcaggaaatcatagagaaaaactaaaacacatggaattaaatcctaatcaaaatatgagttcataagatacccagcgtgcttttttgcaattaagtcatgtttacagataagattcatttgttaggaaaagagaaatgatatttcttgttggagttggtcggtcagagatttgttaggagtcactggctgagatcctacaggtagtctacaatgttactaagttgtagactatcaagttgagtcttgaagacctaatcaggccatgattaattgatttccaagtacaactactcttatatggatggactctcaactttggatgggccaccgtcactaaactctaatggttcatatgctttatgtcccgctccttgtttcattctgtataagatgtatgtgtttggttttgtttgaaattgaaaacattgcatggcatgttcaaacactttttagtcatggttggttgaaacttgagagaagtcgacagatctgttaatttggcaactcaacattatgactcaatcacaatggtgatatatggctttttctttgaaggcaaacaaggaatgggatcaattccctcatccctctcttctctgaatctctcatccttagtcctccaatatctcttaggaatggagcctaagctgcatggggaaaaactggcaaaatgaagtgcaggctcctctcggctattacttcatccataggccgtaactttttttttttgacgattaaacagcaggagaggctcctactgcgctatattaaaaaaaaaagggggaaagtatgtacaaggagagcatatacaaaggaaagagagcaagaaaaagaaacaaaataaaattccaaatcctccaaattagataaggctttcagaaaactgaacaaggaattgaatagtatcggaaatcctgtagcatgattaaaagtttgaaatagaaaattctgacgaatcacatccggtataccaaacaaatgaagaatctactcacctgcatttttgattagatatctggccaccatcaacatagcatctcagctggcttccagtagagaatgctctccctactgaatgagtaacagaaaggaatatccattgctttgttgggaggcttagaggcgacaaaacacactgatgtttttgactgatagactgcatagggtaaggatagggaggtcaaattaacatatattacttccgtcccaaaataagttcatttttcacccgccacacacataccaatacaaaagcaaaaggatagaatacccctactttataaaatcccaatacaactatccatcactttacccaatacaattattccctacttttacaaacttcgatgcaatgattactctaaaaatgaacttagtttgggacaaatggaagaagctaaaaatgaacttaatatgggacggaggaagtagaaaccaaaatcgaacaaaaaaaatgataaatgaaatcaagtgctgcatccagttcatggcatgtaagcatagctgtgtaaaacgggaacttattaaaaaaagactacaaaattctaattgtctttctattgtccactaaataatgattatcgacagcacatcacctaataataagagcagagcacctaacagtaagggcaaacaggaacgcatggccataatctaataagtttaagaatggtttaacttcaagcattagctgcaagacattgtaagatattaatcagtgaaacttgggacatttcatcaaattgtttgcaattcttaacaaaatttcacatggaaatgtaagtcagtcagtatgttgcattcccaaaattatgttgctagcttcgctagtgccaaataaccatcttgacaaattaatcttttaatcatttgtgctataattttctcattcggttaggtagtacatactccctctgtcccgaaaaaaacgaatctaggattggatgtgacatattctaggataacgaatctggacagagatatgtccagattcgtagtactaggatgtgtcacatccagtactaggttggttttttatgagacggagagagtagtagtcaatgaaaaagaatatttaatgacttgtaagtgttcttttttctgaaaattactaaaatgagctgatggctccaaccaccattacctcaaatattagagcatctttcccaagcatagccaaacatccttttccactttccgtgaaaaaggagaaaagccccatcatgctattctcaaggaaactttccacccttaaccagcagcaaaaggataagcccttattgtaaggccattgaacaggtgattttatttcaatgccctggtaaatggaaaaacaagtaggatatcagataatcaccagataaacatttcctaatggaggaaacaatagaggtacttgtcctgcagagtctatttgagacaatgagaacgactagtgtaaccttgttcctaaaaaaacttgcaacaaaatggaaaatagagaaatgaaatgaaaaacagatcatttaaagagttacaaactcaaaaattatgcccagtcaaaaaaaaatgaaaatagtactaaacatgaaaataaaaactcacagagtcatgaccactaaattcaaagaaagcttcaggtcccttttccttgagcatgtgactaagacttgtcaaaagcaatgaattacgcttctgcttgacaccaatcttctcatcacgcaggagggcaaacatttttcgtatatctttcccgcaaatactgtgcccaccaataatctgaatcaactcggcaatttttatgacagtatcatcagtttcctctactgaaaaccaatcaagaagaaaactaagaaatcctgctttgaaacaagaacttctatttgtaatggatcccttgagcaactgttgtaggaccacaagcccataatgctggagtgcagtgctgctctgccaattagaaatcgccaatgttgcgtatcaccaaaacatggatgtccaaccacaaatatgtgcacacatcacagggagtgcgaccaagagagagacgtaccttttgtaaaacatttaaaaatagtatgatcacatcttcattctgagagaaaaaaaagaaaggttacatcagataacagaaccaaatagaaatgtgggtacaatagagtgaatcacttgattaagcaagaatagcattgcttcaaagatcatgaagattacttgcctttattgtggtttcttcgtttttatcaaatgtcccatcaacaagcatgccaagtatggcatccaagagtttctgactaggtaaccatttacagaagtccaacagcaagctttgcagtgtttgataacccacgccaaccagcattctaaaggaagcctggataagaaaagacagagttttagatgcacataaaaaaaagatgatcagaggagaaacgaatataaagtccaaataatgcttgccagaaatccaggtgacagacaggacggcaaatccagaaacaaatgatactttggttctatattttcgcaatgaaaagagcatacaactactggaaaacaattctgatatttaacttgctagatgctctggtttcacaagaatatgcaggttccacaacaaatgtgaccttggagattgagttgaaaaccctaaacgggagtgaacaaagaaacagcagtactaatggttacatctcgaaatgactcaaaaccaatactggcagcagtctaatggttccaaaaaaattttctcagacacggaggagagctgcctatcattatattaagaagaagaaaggagagggtaataacccttacaacacacacataaaccttacatgagacaaaaagaccaaaacacacacataaaccttaatggttccaaaatagtacaaaatgtaaaagtgtagagaaatatttgattacctttgacacatcattttcagcaagtaatacagtcaacgtctgaaggacattaaggactaattgttcaccaactgcttcatcaaaagtcccattcagtaaggatacaatatgcaggaagcactccccattgcggaacagattttgataatactagaaaaaggtatgagtgaaaagatgcatttgtcagggatgatgtgatattaatgaaaaggacaaaagaacattatttaatgggaataatcccatcttacaaaaagaataccatgcgatctatcataatgatctctctcatgttaactaatagatcaatagacaattctgcgaagtcctccttttcttttgcacgagtgaaagcctccaaatattttgaacatagctgcaactttgctgtatgatcttgtgctgatgctgaaggtaactgattgtgagaaaaggagatagttttagttccaaagaaatcatatcacaagcaacagaaggagagacaaggagcacggcaataccctaaataagtcaagaacttgctccaatacattttttcggaggttttcttcttggaataaatcaaataaacactcaatacaattggcattatgtaaaactagaatctttccaagctcagatattgtggtgtattccttgaaaagattgaaagccaattccacacatgcaatagtacttttaatcttctcatctgaagaagacatctgaacattttctgattgaaaaacatttccacttaagccatctccgggatgggaaagcttccttagatgttgtgcttgaagacatgcaaccttcaggactctggtaagcgcgtccaatgatttaaaggaggatatagtctgttcagtggcaagttgcaggataacatgaaaactcttaagaatagttccagctaatccaggatcataagtgcaacgttcaagcacatctaataacgctgagcactctggctacaaacaaaagtaaattattttaataaggtgaataaaaatagaatggcaaaattcaaattatgaacaatgcgcaacatcttaggtgacgcagcagaaatttaggataccagattgtttgtgttctcatttattgttgcggcaaactccaagaaggaaatagcttctgcttgaagaatgttgacatcagcttgattaaggcctttagaaccagctgattcagtagcatcaataaaatgattgttttgtgtgtcacaaacaatatgatgaatatactccatagatgatccaaagtaaaaaaatttatctgaaaatatcagactccataaaccctcagcgcgaaaagatttgagcagagctggtactgaaatgagaaccttcctgaatgtgcaaagaatataatgctgtagggtatttgccaaaatcctggagaatttagtcaatacaaacaaaaaaagtcagcaaaagaaatttagaaatgaatgatggcattaaaatacataaacatgcaattacttgaaaaaaattacaaaacatgatacttccacacacagattcattgcactcatgaaacaagacggtagccttgcaatcatcaaattaacaaattgtacatgattagatagatattaggatcaacaccattttagacaattgttcacatgttgtatctagcagaatattttaattatcatccattgagttttgcagtactggctatacatcggaaagactaatatattatatgaagtcccctgtaccatctagatattcaggaaacattgaaagcaaagtccacaatcaattcatctagtctaatcaagaaagatggacagcaacattaaggaaatgagaacctaccttatatggttgggcaattcagattcactagcacaagctttgatgcatggaaaaactgttgaaagaacctttataatccatcttgcacattgctcacagtatgccactgagatggacagagaaacttggctatcaactgcaccagaagagttccttatctcgttaggaggaagaagaaaagaacaaagtgctatgctcagctttacagaatactcagtccattcagttgtatcaagaatatcaataggacttgcaaaagattctgatgtaagcgatatcccagtgctttcttcaagcttacagttctgcactcgagagtcaagtgccttttgttgatgaaacccctgaagcataaatgcaggccaacagatgctgtttgcaaacttatgtatccgtccattttcacataagaactgtaaattgttgacattaccaaaactgaataggaagtcaaggatccatagagccaaactatgcaatagcatatggagtctaacttaaacagactattaaattctggataagtaggtattagtgatatattcatttatttgcagccagaatattcaaggtgcaagagtatatcatcgctccaagaagacagaatccagaaaaaaatgtccagtcatgtatataggtgtgttatagacatgaaacagttaaagtccacctgtaacaactagtttgtacttaatatattgttaataaattatgaaagctaaaaatattttttatggtttcagaatacatcgtatattcaattaatgttcagaggtatttctagtcttttttagaaaaaatggatactgcaagaatccagaaataagacgtttcattgactgagagtaacaaaggtgtacaggaaaattcatgcattctcttactaaaaaatatatgtgcatcaggatacactgcctccctcagaatttccagcgataatatctggagctgtagaattccactcctgtgtaagacatgttatggtcaaatcacacaaattatatatagaaagcacacaaacctcctgcattcctgcacctaaggtttagtattgccacagttgaagcacttacctttcatcactggggacaaaagaatactttgagactgacaatttgcttgatggtaatcccagtccatctaatagaacctccagtcctccaatgcttctgaaatgattctgtgcacgtgcatgttgagagattgttgatctcagagcatgcaaagttataaagtgaagtagcacgtcagtccactgctctttcaaattcaatcttcggatgacccttaagagttctgcaagaacaattccagatcagtaagataataacagtgcaaaacatgaactaaccaatttaacatcataaatcctgaagaattaattgtgttatttttctccttttgcaataccacaggatgcataaagaactaaactatatctagacaagtacaattttggagaatgctatgacaatccatgtcttatgtttcttaggctgtgttctttccccctctttcccaactcacctctctcattttccacgcacacgcttcccaaactactagacgatatgttttttgtaaaagtttttatagaaaagtttctttaaaaaatcatatcgatccattttttaaaaatattagcaaagttataaagtgcttcaacactccaaaagctttggtgtctcgcatgggcttctgcactccaaaagcttctcagtggatcagcaaactcgggcagctagcacttcccagtgtgggctgggttgtgtgcgtgtgtgtctcggtgggagggccttggtctctcctttgttttcttctccttaatgaaatgaaacgcagttctcttgcgttttcgagaaaaaaaaattagctaatactacctccgtcccaaaatgtagctaatttctacagtaacttgtcccaaaatgaagctatttctccacctaccctctcctctcaaccaatcacaaccatgctcttcaccaactttctcttctccaccaatcacaacccttctccaatcatctctacctactttcttaatatccgtgtctaccaatgcttacattctgggacagaggaagtactcaattaaccatgcgctaatgagtcgctccattttgcgtgcatgggagattagctcccaacaccatctaaagaacacagccttagtggagggagcataaatccaacacaggaatgatacaaaataaaatgtgttttgtctcatcaccctgaatcgtgcaaaacatttttattgccatcatgaaaattcagttactgaaagttttgctctatttaaaaaatagcaaggtagcatgaataaatataactatatatgtggagtatttactaagcatttgactccataaatgaaagtaaatataactatatatgtggagtatttactaagcatttgactccataaattatatttcattcatttgatttgagactgcgcaaaaataatttactgcagcaaagattatgcagcgtaatcatctagcttcagcatacttgttccatttcttattactggcactcttaaccaaatcatgcacactaacttagaaaggaagcaatggtttgaaggttggaccaaaataataccataagcacaaacagtatgtataaaatgtaaagtagaagatggtggatgaagtttgcaagtgtaaatttggaataacatctcaggacttttaaaggtccaagtagttggggataatatattggtaaaaatgcagagctgtttctctacattcagtgctggaccacaagctagcaagattccttccaaaaacacatcacactaatgcatcagcaaggtttacgccctctcttatcacccttttggccccaaattacattgagcatgccaggatcattcatctcatgtcgtaatctcttccactctttggtttcagaccagaacatacaggtcattgtcaacttgtctctgaatctagaaccaaactatttgtgtaaactggagttatggagtatggatcatgcttactataagagtttatcaataagctagttagcattacagattaagttcaattgtcctaagcaagtgtcaaaaaagaacaatgttatcagatgtatacaaacattgagaaaacaatcctacctactaaccaattgacgcctccagcttccataactgcaacaatggccttttgctgccagttggtatcatgaacagcgctttttgcagatattggagtaactgtggccaaaaactcatttgatagggttttcccagtagtattgacaaattgcgttaacctagtagcagttggctccaagttcatgaagtttgaaattattgtaacaatgtgtacaagtatcttttgcatcatcttcatgttatctatggctttgtttgacagctgttcatctgcggcaagcaaactggtcaaagtcttgagctttacaactgcagctgaatacacaagagaaaaaacgtcagttaagaatagattcatcacaaaagaaaccataccagtattaccacggacatcacaacctaagctacaacagtgaaaatggtatgaaacaaaaaaggggaaatgagcgaaattacttctagaaaggtaaaacactactaaagaaagtattgtacctttcagaagagcagtgaccttctgcacacctccataataactaaatactctacagttatgcactgagcgagtaacaatggtcaagcattccaaaatattcaatccctcagagcttaacatcaggtctgacgattgttctgaaatgttaggagaggattccgaacagctgctgcctactaatacgagaaaaacaagtcatatatcaattattgctggctcactctagttgcaatactttacaaccactgaacaaatcaactactatcatgcatagcctgattgctcatttttcctttagcaggtactatgaatctatgatcttgctttccgagaagacatgtaactgattttacatcagtgtaaatttaaaactgtcatagcatttagatatgacttctgcaattttgataagtcaaatctggcaaaagcatgtttcaaatctttcgtatgcaaagcacctcttcaagcagatgtttcgaatctttcagtatgcaaagctgttatgactgacatattaatggcatcttaaaatgatatggaattaatggtggggtgcaaactacaaaagttgtatgctatgatatataaaaagcagaaatgaaaccatgaaaaggagggaatgcatcatcaagaaaggcatcatggtgttcatcagatccacttactctcagtaatgaaagaagttatttgagaaacctcctgcacaagaataaggatgatctcagaaggatgccctctggagcatcctaaaaccgtatcatctgatattggttcttgatcaactgattgctccgtgtattgcggttcccactctttgaatgcttgtacgaaatgcatgataaatatttgcaaggattccttcttttcagcctatggaattgttggcaacagaaatgaggaagcatgatcacaaacttttggggaaaaaagtacagtttatgccataaaaaatactacagaatgaaataatgccatactacagcataaaaatgtgacattgtttccttaaactaagctatatgtagtctaaattagtcgatacattcataatcttggtcatcgtatctcatagacaggagcgttgatgaggaaactagtcaaagtaatcaatcaaatcattcctcaacttcaacaaagccatctcataagtcataagtaaaaagtgtaaaacaaatatctgttattggcatatcatgtcatgcaaaaatcaggaaattatgttgtaatgttaatgcacatgtgcttgatacaagctgtttttgacatcatgatcaaaggaaatagccgaagaaaaggttggtggcaaaccagcatgcaagattactcaccttgtcaatggcattctcatatttctgccaaagcatgtttaagactccttcaacaccactatcactggaagcagatataaacattgttagaacttacaagagaatcagccttagcagattgtcccctaacaactataaaaactgatgttacatttgattaagatgtaatgttaacatgattgacaaataagtatctacagaacttagttgcctatcaacattataaaatcatcatttactcttttttaacaaaaaaaatcagtatattaagtgcaaaaccagggtaatcaactctagtacctaattttggcacagattttgtgtgtctatagtggaatatcacacacgagctacttatactgttcagtgatgtaactatgcgtatgcggactactgaaatggaaaaggataactaaaacaaccaacgtaccaacaacatacctcttatcaattatccgagttaacagttagcgtgcacagttacttaaccaaataagcagcaaaatctaccgcacggaagcaagcttgagaatgcagcattggttcgtactcggtatccagtagagcgcacgcaccaacacattgagctacacaagcaagtcgcattccgcagagcgagcggtttcctgaggatttgagtcggctaggttacctgaagcggaccctgggggacggcgcggcggggagcctgtctggagcggaggaggaggagccaccggcgccggcgccgccgtcgacgacgccgtcgtcgacccctacaaccccgccgccgccgccgccaacccccgacgaggccgccgccgacttgcggaggagatcggcgacgcccttcacgatgttcatcgcccccgatccgaggcggctagcagcagcgcatcaccgcgcggcggcgggcgccccccgcgggggaaggcgacgaggccaccacggggattcgattcgaatccaatccccctctcctcgcgggcggtgacgcaggtggtggggagggggagggggaaggggagatcgcgtgaggaaggggagcaccggaattttggaaatgctcgtggttttcagcgtgtgggaggcgtgagagcgtgagcgcgacgaggagactagggagagggatctagaatttctctgggggagaagtcaatgggaattgcgatgttggtgctggcttttgtgtcctctggtgcgcggagtcctgcagcggcacacataatacgaatactagcgctacgtggtactattacacttagtagaatggatgaaggttcttatggaaattaaccaacttgaatatcaatagcagtggtaaagatgtagtataacagtatatagcatacctgtagcagataatatttcatacaagcggatagtctttttaatagttctttaataaatatagaatattggacaacaattcatgtccgatcgatccatacatgtaataaatataaagttgagagatgatttctagagttttagaaacaaaatgtgagtactcttaacacttctcaggtaacacaatactcaacacatctggtgtaaaaactctccgtagtcatagttgaggacctccgacacactctttgtcttcctggcgagatagaacactgagtaggatatggcggcactcatgaccatgtgactcttgctcttgaagaacctctccgtgcgaacgaaactccgaccatccgctgggttgttgatatggtcaattaccttgaaagtcgccgcaacttcttgtaacccgggaaccagtcccaaagactccactagaacgctctttcccgaagtgttcaacgtcttcttctccccttcaagctttatacctcttctgatcatggatttgataacagagacgtcttgacgaattcttgagatgtttgatgccatcttattctccacatggcgaggacttgccatggtgcccctggtaagaaaacccttatatgaagcaattaattaatattatatgtttaaacggtagttaaatggtgcccctaactatatgtttaaaaagaccttatatgttacataaagccatgaagtattcaagacaaaggagaatatgagactaaaaactttcacaggcaaagcttgaatcagaacacacaagtcatgaagactacaggaggaacaaaagtttattgtatagattgcaaaaaacaatggaatccttaagtttaaatagctgcatttgtattgacatttatgtaatgatttcaagctgactacacggtactttgtagctagcctaacaggtaatacaccctgtagataatacgattgcaaaacatcttttatttatacgatgtgcaattatattctctagcaaggaccctacagatcgagctgttccaaccagaaatgatttgttattctaatagagaagacgagaattagtctactgctacctctttaaaaaaagatcaatcacgtaaaattaatgttactatcattaaacaaactatcataatatgtatttctttttatttaaaatatattatttttatagatattgttggttaaaatagtatttcgaagattatatcgaagatcaaaaaatacttatattttgtaaggggagtattgcattacagatctactccctttgtcttaaaaaaactatttctatatttgaatctggatatgttcagatttaaatgtagaaatgttttttttcttttttttaacggtgggagtacttagcataggagaggtaaacaaacaaaactactgtagtacagtaatacacagagggcggcatcagtgttatttctggattaggcgattagcaccagctttgaagcaaaaaggcaaaaattttaccgcatcaaattaaagcacggtcacacagacctcaccatcagacctccacgacgaagccaaactgattgatatatagaagcttccataaagaaaagaggaaaaaaagcgaaccttctagaatccactagaaggcgatcgaattactacccagcacacaaattggcagtctccgcacgaatacccgcgcgcgcgcacgaaacacaacatgtatatgtaatgagaataaacaggagaaataaccagctaattaaggagaaacatatataaggttgcagcacatcgaatcgtaacgagatcacaccgcttggaacatgatcagaggctcacgaaagtcccaaccttttgaagcgactcccctccaggaaaagcatcccgatcacattccagaaccttctacccgctagctttcacgccatgcgctggtgtcgcaaaatcacagcttaagcccccccaaaaccccaagaacactcccccctacccccaccccaccccaccccaccccacccaaagaaagaaagaaagaaagaaagaaaaccagcaagcacgacatgcaagaagccgaactctggtgtggatccgagctgcggatgagtattttggggcaggtgagggagatcggaggacggaaaccctaacctttgcttcgaactcgaacaaaccaatacggggaagagacgcggcgccgaggcggaatggttggggagggaaggggagaaaacgaaagaaaggtgatgctgaggtgcgcttgctactgcgctgcggtgctcatatgcgagatgcctctgccacttatcgggttaacgggtcgtatatggtaatatccatcaccctcagagtatctgcttgatccccttaaaaagaattctcagttcatatcaatattacatcctttccccgttttaagtgaagttgtgtatttccgtctctaacatttgatcgtttgtcttatttaaaaaaattaaaaaagttagccgcacataaagtatttattattcatattttatcatgtgcaggctcatcctgctaacttggtgtgccgctggcaggacagcagatccacaacacttataattactagaaaataagcacgctcgttggcacgttattttcatagcccgtgtgtagtcttaatgttgaaattttaccgaaccatatcagagtcgatgtgactctaatgttataaaatttgattattaaaggtatagttggtcaaaattagcaccttaaagtaaaaaatgtttttttatcaagataaggagtattattaatggtatattatatttacatgtgttttatgatagtttaaaatatacatttctcaatacctattttttagaaaaaataattttagttcatttgtttgtgttctcaaataattatcacgaactcagtttcatttatcatccattagctatatatgtgttcatagttttctttttttcttcgcaacataaataaatctggtctcttctttgggatataatgcgtgcactaaattattacaatcgcaacatacagttattttcatgccctttctaaaaaaatattacccccatcctaaaataagtgcagccatggatatccgtacctaatgtttgaccatccgtcttatttgaaaattttaaaaatatttagtcatacataaagtactattcatgttttatcatctaatagcaatgaaaatactaataaaaaaattttcaaataagacgaacggtgaaacattgaccgtgaatagtgcaaaactgtacttattttgggacggagggagtatattttcatgcctccccccaacattgaaaaaaaactattatcgtatatataaattttattcgatgttcttcaacaattgtacatatataagttaaattttcaatgagcagctcacataagctagcttaatagctacgatacgttgtactcccttcgtttaaatatttggcgccgttgactttttaaaatatgtttaaccgttcatcttattaaaaacttttgtgaaatatataaaactatatgtatacataaaagtatatttaacaatgaatcaaatgataggaaaacaaattaataattacttaaatttttttaataatacgaacggtactctgttaatggacggtactcagttctgtccatcagaattaatcttttgagtaactctgtttcaaaaagatgacgcacaccgtgagcaaccacaaccaggcacttatccatcattaggactgtttttttcgaacgattctccccagaaacaacgcaaagtatagagcatgaaaaaaaattacaactctgggagatcgtaaacaggaaaagaagaaaaaatagcaccgcccacacaccgatagctctagcttacaaacccgggagaaggctagcatcgtaccgaccgctgctaagccaacaaaggaattcaagtgagatcgtctaaaatccaatcctaacaactgacaccaaactctactctagccacatcttcgagattgagggagagagtgagagagaagaatggaatggctctccacccaggccctctgacgtggccatcttgcataagctacggcgccgacacaagaggacataagtctaaagtgagcttgcaccggttgtttgtgaggttttgataaagggcctaccaagatgacgtctctagggagaggagcgaaagaagcaccgccgccgccgttcgtcaaggtctcaaagagaaacgagactgggttttcaccctacacccgctagaagagatgggacgacacgacaacaccctaaagaggagaagtgacacccgaaaagccgtcgttgccggcctaaccaaaacggtgctaggttttcacccgtcgcccaccgcctgcctatccatagcagatacacctttgctccatcatcgtctaaacctctgtcggcgtccctcgcatgccaccacatgggcaccctcatcgtgcgctccacgccgactgctccacgccggcctccagcatgtcgcgttgcgccagcttaccgccaccgccagctatgtgttctcatgttgtgtcggcctcacgccacctccacgcagcactcgccggccacgagcctccaccaagcgctgatggcgccatcactgccagccgccggcaccgcccttccactgacgtcggtgtcgtccatgcacagtagcctgctccaccacacccccattgccggccgccagcgtcaccgcgctggcctcccgccgtgtcgctccgctccgtccactagctcttgccgcaccacacgtcgtcgccgcccacgccggctgctccccgcccagatccgtagggtgttgggtctggctacgctgcctaggaggggggatccggtcggggcagtgccggatccactgccccataccggagaagccgccacctcccacccgacgcgctctgctccgcctcccacatcaaggaggagcttcgccggctcggtttcccttgccaccaccttctcagtcgggctcgcggtttctagcggcagcaaggcgtcgagataggtggagagggtggcggcgcgagcagctaggatttcatccccaagctacccgcatgagagtgacgaggggtttgttagattgatatttttaggacactgcgaaccttgaacaggcaccacatggcaattcttttacccactccctgagaacgcaaaaagctcacctagaaaacacagatacagtacagatgttcgctattaccaaagatcgttactaattttgacacgaggaatcttgggggataaaatctatataccctaactctcttctcaagcatataaacgatttcaagtatatcggctttgattcaccaataaattctcgctgctttatatataaaatgtatttggtacatcataagtttgacgtagatagataaaagagttgaggtaattggttcaaagtaacacaaagataaaattattggattcaaaatgagtccaaagcgaaacaccgataataaaagatagccaaaagtaaaactttataaattttaaattctgtaaaatacttattcatatcatggttgcgtattttcactcttgctgcaacgatctttgcttgcaagggaaaagagacagcaaatgcgcctctgcctcgattcgatcgtatgcctgtttgccaagaggacgtcaaggcggggtgttgacgggatggaacaacgaactagcattgccaacgtacgaagaaacaagtccagctgtcatttcaatggctgaaccaggtgctcgtaataaccaaatgctgataagctgatgtcctgatgggttagtaacaattagtctttttttttttgctcggtgttctaaaaaaacaatcattcacgattaggacaaattattaaaaaaatcgcacgagttatactacctatgtggccctgttaagaaatataaggcgcagtttgactatttagttttaagctttgatcaataatttgtataacaatatttaggttttgttggattattcatgttcgaaagtactttctactccctccgtttcacgatgtaagtcattctagtatatctagattcattaatatcaatataaatgtgaaaaatagatgtgaaaaatagagaatgacttacattgtgaaacggagaaattatataactaagaattcgtaactgtaagagaaatttgtttttggcagtcaaatacgccttatatttctgggcggaggtaaggagatcagtacttatttacgtgcacgcctaattaagcaaactgcttagcggttaagttggggcaatatgtgcccgttaggggagtgaacccgttggtgcaacacgtacgtgcattgccgttttggct

SEQ ID NO: 72485 - DNA, 1752 bp, Oryza sativa
ttgttaataactctgctttgatagaaatatcattttgagtaattaaggtttgctgagtgagaattacttcttgtttagttgctaattagcatacgggatcattgttcactatagtctatttatttatagtgattgctttagtgtttgatcggcactagagtagttattaattgcgtagacgcggtgtctgggtaattaatctccagtggttactgcgtatcccaaagtacgtttgaggtgggtgtagaggtggtgacagccctcaagagcacttaagtcctccctatccgggtatgtagtagagcgacatctgggaacagcgggttgccagtgcctgaagtattgcgttaggattaaacataagctttccctagacactgtttctcattaggaaatcctctttgccctctgcccacattagctttgtgtccttggatgaacctgacgaggagataaccacacacgttcccttggattcgatacccatggaatactctgtataggaagtgctacatcgttatatccgtgcgcttgcggattctatctgtgatcgtatgaaataccaacaagcatttctggcaccattgccggggaatggttgctgatcatttccgaaccctgttcatcctcgcatcctttttactttttttttaccttcacccctgctatcctagagaagtattcctgtcaaactcttctcgaccatggagcaactgctttttgagctgtctgctcctcggggcgaattctatgaaccacctccttcatcagagcccatttatacaactggctatgaaattcgtcccgaactaattagtatggttagggaaaaacctttttttggctttgatctagaaaatctctaccatcatctgcgatacttttaacaagtttgctcatgccttaagattcgtggcatgagacaagaaactgtgcggtggaaattgttcccgttctctcttcaagagagagcaaagcaatggtacacctctaccgttggatgtgtaggcggtagctgggagaagttgcgagacagattttgtcttgccttctttccagttactcgtattaccgcccttcgagtagaaattctcagttccagcatattaataaagaatcaattggtcaagcctggtccagattcactaatttagtgcagtccgaacgaaccttgtctatacccgaatatgtgcttttgcagcattttcatacgggtctagataaggagtctgcattttatatggacataactgcatgaggatctttcatgcacaaaactccgtcagaaggaaaaataattctagatcgaattctagaaaatacttccttcatgatgcaatgtgatgaaccacctccagaggcatctgtgtctaagatagaggagccatcgatagtcgaattacaacctaaaccttccacttcaaccaattcaactgacgaactagctcctgagccatcatccgttgaggacgaagaaatttggactccggatcaagctctagttttatttagggatggtttcgatgaagactacaacaacaccctgaattatttcagtaaaaagaaaccacttgttcctttgccacctcctgatcctacggcaacatccataatgagtgacgaatggctgagtaggtagagctttcatcggaagtaatttggataaataccgcccccgagtcattccatgtcatttggaaggaaacaatgtcggtattctttatagtccaactgtcggggctaatctcgttt

SEQ ID NO: 72486 - DNA, 1363 bp, Oryza sativa
aaacaaaacacatccgaatcccgcagcaaaacaaaactgcatttcggaatgtttccaaaacaaaacacatccgaatcccgcagcaaaacaaaactgcaaaaggaggctgcatctgcgcaagggtccctacgtggcgaggcaagtgagcgcgcgtgtttcccctcttctctccaccacacatgtttcaagtagcaaggagggcatcctcctttttaaggaggtccccctctcctagaataagcaaggtggtactaaactccacatgcatgccatcccatgaggtgggcttttgagattttccaaagaattaatcttcgaatgggccttagcccatctattaattccaacactgtatccggttttgcagtcaagatatccgaatgtaactaagactcatacttgaggtatctatagtggacattttcctttttttatctatcaggacacccaacgacccaaagcccatgcctaatttgttctgtggatagcggcctattcctaaattaacttgccagttggaatcaggcctgataggtggcccacgtctggtgacaatcaagtaaggcccattgaagagtgaaaccggagttgtcgctgatatgggccatgcctcacgggccatagcccataggcaaggagatccagttgcgtctcacacgattcacaaacatccagagcctagtgacgtgttgctagatgcaaatgccacaacagcatatgcatcagttcagttggcctcgtgcgtttttgtggcgcgtcgagacaaaacgttgagttgccgagaaggcagataaaacaagattatgttggtgccagccatgcatatgctggagcaatatgcagagtttgctaccgccaaaacacaaaaccctctttcatatgctcctactccagtatggatacaaaagaacatcgggaaatgtcattcgtgtacgggctctcatctgatcaaactcgttgcgatcgccaaaaaatctctctgactaagctgggaaactaaacagtttttatttaaaaaaattgacaaagtagattaatactatgtaatatattattttacaaatatacatattaaaattcgacttctacaacttataataaaaataataatttttatatatacgtatactagtgatttatttatacatattaatctactgtgtatattttttaatattttttataattatatagttaatacggaagaaacgggtgaatgtctattcgatatattagaatccaccttggactaatctggtatgtagctcgcctggccaccaacccgaatttactctcgctgaaaccatatgtatgcatcatccaatccagacgtcacatatcgaccaacaaactttgcaaaatt

SEQ ID NO: 72487 - DNA, 6852 bp, Oryza sativa
atgatggttacaacctatgcgaaatgaccaaactacccggaaccgccattaggatgtgatcagggccgtccacacaaaatttggcgatcaacggccaccaaaagggttcgaccgaactaggggacggctccgttcggcccatttttcatcgtggacactaattttaaggccctcagcccaatggcatgatagttgggcccatttggagttatttaattgacttatagggcctccaatccgtgtaaatgtgtcatgaatgcgcggaggtgcactttggcgcttgacggatgtgttttcttctcaaaatacctgcatacacatatttcaccaacactagtggaaataattagtaataatacctaccactaagttggataccatgttttatttcattatatgcaggtattgacggtcagatattataatttaaggaccgtcaacactctaacacgtgaaaaaacaggattcttctatttttatattattctgggtaagataaactactccctccgtcccaaaatatattctttttagcatagtgccaagtcaaatattcgtaactttgactattaataataaaaatataaaaaagatcaattatgtaaaattgatgttactagatttatcattaaaaaaactatcgcaatatgaaaatctttttatttaaaacatattacttttatagatatcattggttaaagtagcatctcaatgaccatgtcgaagtccaaaagtgcttatattttgggacggggggaaaagatagtagtatttaggagtactactgtactcaaagcaagacctgacaattgaggaaaaccaactatgtcacttactgaatgggagtccaaacaaaaaaaaaaaacattttctctctctcttttgttaaccaaaagttgcacatatgataaatgaaagtctagaagccttttactcttttttttagacgaaaacttatatttctggaaaatgagtctattatctgaaacaacctaaatatttcattggcatatagattctgtttttttttcttttttcacatcatcgctctgttttacattttcctggtatatgcttagaattcacaatctactagccaagtctcctcttctgaagattaacaaacaagcaatcatgatgcaggactcaatcagctgataatttctgaaacaaagatggacttgaactgctttctacaaattttctgaacatgaatttgattacataaatatgcttgcaatggataatctgaagaataagattagactgattgcagtgccaatgtgctaatggccttttgcaatcatcacccctaagagcaggtacaatagtgctattaagccggctacaaaacttattaatcagcttaatctgagattaatgaaagaaaatcacggggaaaggaacaagcaggcgcttgttttggcgccggcgcttgcacagcacccgaaactgtacgctcacatgcagccaaaaagacgataaaaaatacatttatgtgggtcccacatggaaccatgtaactatttaatgtatatatgtatgctttaaccaatgcagcttatagctaacttgtagttagtttgttgtatgagttgtctctttaagttagctctattttaacatgacaaaattttggagcttgctgctagctatactattgaccttgctctgagacaagactaccaatattgctaagttacagactgacagacagaataggtggtgtgcaggatcctgtgggctgtgagcctgtgaccatgcattccaagctgccagatcatgatactaattggatgaactacagttattacattcaagaatcaagatggaagttcctgttccttttcagaatacatcgctccatgtcgtctgaagaagccgatgttgttcagtcttataatatgaatatgccttcaggtagtacaccaaagaaacaagattacgctagtcaaatgcctatattagtgaatgcagagtactctgctttcttcttctttttctatcaaaactctgattctgacagatgaagtctattgtctgaaagactgaaacaaccaaaatactccaacagcagtgatcacaattcacaatgtgtccttttgcacaacggtttccattcttttggatgtcacttttcctgaagactaaacaaacaaaagcatccatgaagcaggactcaaaacaaactgaatattgtaaaattggggaacactactctactcaagcaagcactgaagtctgaaagtgcccaaacaaaaaagatctaaaactttctctcttttttgttaaacaaaagctctagatatgataaatgagctataaaatttttttactccatcttttcacagaaaaactcagattctgacaaatgagcctattgcctgaaacaaccaaaatactccattggcatagacgactctgtgtttgatattcctggtagcttatgtactcaagacacaatccataattccaaatactacaaaactattcccttttcctgaagattaacaaacaagcagtaatgaagcaggactcacaaagctgaaaaaaatatgatatttttattgaacaaagagggccttgaattgctttgtacaaattgaataggatttacataattatgcttacaaatgaataatcagaataataagattacactaattgcaatgccaatttgcaaatgcaatcatcagtcctaacacatctaactgttctaagttacaggcggactgtcaaactgaaactgacactctctgtcttcttctcccagagctatccaaacagaggcacgaagccagggaactctgctttcttgggctcctcggcgaaccacctgtgctccagcgcctccaccgccgtcatcctcttctctgggtcgaaagccagcagcccggacaggacctcgcgcgccgccggcgacagctccggcaggacatcatagaagagctcgttgagctggtcatccaggttggtggacaggtcggcgagcagctcctcctcagtcatgtcgcctccgaagagcggcgcgccggtgaggagctcgcccatgatgcatcctaacgcccacatgtccaccgcggggccgtagcaccggttgccggccagctgctccggcgaggtgtacggcagcgtgccggggcggcacaggtcgtacggcttcccggcgggcttcatcagcgtggcggccccgaaatcacagatcttgagctgcccggagaagctgacaaggatgttctccggcttgatgtcccgatggatgacgcgcgaggcgtgcatcttcttggcggcgtcgacgagcggccgcatcatggcgcggacgatgtcctccgggtgggccctggggaactcatcccggaggctgcttccgacgaactcgaggacgaggaagaggtcacctgtcttggcgtcggcgacgacgtccttgatctggacgatgttggggtggccgcggcaggcgtgctggcaggcggcctccaccctgagcgcgtcgaagtcgggggcgaagcggccgccctcgtccgccccgatgaggcgcttgagcgcgacgaccttgccggtgcggcgatcccgcgccctgagcaccacgccgaacgcgccctggccgaccacgtcgaggcgctcgtagtcatcggcgctcccgaagttgtaccgccgccgcttcggcccgctcgccggggaggatccgcagcaggcacggggctccagatcgtagggcgccgcgcgcttgcggctcgccaccgccgaggacgccatgggcgggggaggaggagaaggaagcggatgggagaagaggatttggatttgggaggagcaggcgcgttggttggcggcggatttggagaattggcgcttggcggtggtcggtggatttatttgggggattggtgagtccgactccgactcgttctggtagataggctgcgtcggacggtcacgatcgcaccaacatgatcggtgattctagaattctggagtgtttttttagataatgtttttattttcctttttgttgcgaacgattattatacacaacctatgcggcacatgtagcggtttaggagatgtgttcatcttgcttttaatctgcttcacacattctgttagatccatgggcatgcatatgctattatttgcaaaattatgatttaaaaaagtctttatgtggttcatttataaacaaattaatcctaacaaaagataactttaaaaaaaattggagaggaaacaagcaatattctttttttactatgcatgatattactaagcatcttttcttggagaatttaactatttacaacttttaggtttggcaattataatttttttccctcctaagaggtggtctgttaactattcgccacttttgcccacatggcatgtcagcgtggcaaactcaagtgaaaaatggtgtgggactcactcatcaatctcttcctccacttcatctctctcctcgggttcgcgtcccgcgcccatggtggctgccgccgtcctgagcccatcccgacgcgcccatggccgtcgctattatcctgagtccatcccgacgtgcccgagaaacccagcacacgccgaggccgctactatcctggcgagccccaggatcgagaggatcatatgctatccctcggcgctcctgcgcctatcgctgtcgcctccaccgtctccacgccatccgcgagctctgcgccgtatttggtggtggtgtaggagctctaggactgcttggtgcgccgacgccgacactgacaccgacgccgaggttgaggttgaggttgagcgcgccgtgctgctatcgctgctaccgaacatcacggcctcggctgccacagcagctgaaccgatgggcgtgacagggacgcgcgtggcgccgggccagcgggttggcgtcgtggatgttggcatcgcaggcagcacatagcaccgcggcgttgaccttccaggtgacggcggcgggcgccaacttgcacaccttgcacatccatacccactcgtgcgccctccgcgtgtggtacaccccgctgtagccatgccagtgcatggctgctggccacgccttgcatgccccgcatcctcgccagcccacgcctaggctctacgccgtgttcgacgtcatcgcgctcaccgtcatcgtggtgggctctcctggcgctcgcgccacccgttctccgcatacatgcactcgtccgaaccggatttccccagcatcacctccgtcgtcgccaactccaaatggtggcgccgccaaccctccaccaccaccgtagcggcggcggaggccaaggacggtgacacgggcccgatgaacgcccacgcccagcccactacctagctccgttcacaatgtcggctcggctgtgaggcggcgccgccgagagatatgaagggaagggaaagactgacaagtgggtcccacactatttttcaccccaagtttgccacgttggcatgtcacgtgggcaaaagtggtaaatagttaagaaaccacctcttaagaggggcaaaaaaaaagtgcaaatctgtaaagggcatttggataattgccaaaatctaaaagtggcaaatagttaaattcccctctttcaccaatattatgatttcatgtcaagatctatataatggttatttccttagttaatgatttatagtcgaatggaaccaatgagaaatttgactagaattaaagcattaagatgtgaagttatatttaatccacgttattataatttcatgttaattataatttttttgttccttagttattttctacccaatggggtataattaaggaattaattttaagattattcataattatttatgaccaatggtgctttgactatgaaattctaagtttattttgcatacgattgattaagccaaggtaaactaattatatgcaattatcaatgtttattatttaagatcaatttcaatactgagtaaattatttctagattaatggagccaacaagaagtttatctagaaagaaagatgatctcattaagattgttatttccttaattatttctgcccaacggtgttgtaattatggaaaaaaaatctaaacatcgtcaatcattattttctttgtcattttttgcctaacggtgatgtgacttagaatcttctatatgccgaagtttcgccccaaccttacggagaagtatgatggcagcatcaatccctccgagtttctccagatctataccacgatcatcgtggcggagcggggggggggggggggaccaccgagtcatggcgaattatttccccatggctcttaagggtcaggcgcgcggctggctgatgacccagcccctcaactccatccactcctgggaggacctgtgccagcagttcattacgaacttccaaggcacgtacccccgcccaggagaggaggcggacctgcatgctttgcagcggaaggacgatgagtccctctgctcgtatatacagcgcttctgccaggtccgcaacactattccgtgcattctggcacgcggtcgtttatacgttttggaatggcgtgcggcacaaccacatgctggagaaaattgccttcaaggagcccaagaccaccgccgagcacttcgagctggcagacaaggtggctcggaaggaggcgtgggcctggaactcccccggcactggcgcggcgggtgcggctgtccccgagcccgctccccgctctaagcggcaagataggagggggaaaaggaagccggcccgctccgatgacgagggccacgtccttgcggccgatgggccctcacgggccccgcgcaaggaaaaagccaccggcggcaggccgagctccaccgctccatccgggaaggtcggtc

SEQ ID NO: 72488 - DNA, 1601 bp, Oryza sativa
ctccaacatcgcatcagcgcgttccacgccgtcccctcctccgctcagccgctgctgcctgccatcatcgtttcctcgtcaccgttcgtcctcgccgatcgacgtcccgtcggtcgcccggctcgtagtctcgcggcgccgcctccgtcatcatcatcgctgcggcgtgttccacgccgtcctcgtccccgtgcagccgctgccggctgtcctcgtcgcctccttgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtccttgtcctttcggtgtcgcccgtgctcgttgtgcggttgtcggccccggtacccgtgtaccggtgtcggtggtcgttcacgcgtgcgggtggtgaccgtgtagtgtccgtgttagtgcgcccgctcggtagccgcgtggtttccacgtgtgcaggccgtgtggtgcttagtggagtccgtttgtcggccactcgcctcggttgacacacggggtctgcttccgtcgacccggggaccatctctgtgtactcggtctaccgcggtcctttaggttgacatgtggggtccgcatgtcaacagcgcagccttcctgtctcttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaaccctgtgctttctttttatgtattgttattgcttctttataggcttgtagctttgcttgtgtgcttcgcgtagctttcgtcgttccggaggttcccaaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagaccttattattgctattgttattattaccttgttcaccctagaataaacaaaaccccaactagtggacactctatttatggttccactagtatgaacttaggtagatgctgtcacgaccggaaataacccaacgggctttcctgacgtgcgtgcattaatccttgtcccaggaggcaaggtacaccaaaagttgatacaaatcagagtttaacaagcggcagcgtaaatagttaacttattacatgggcagcgaaggcccagcacacacagagacaaacgagaaac

SEQ ID NO: 72489 - DNA, 2523 bp, Oryza sativa
cggcggccggggaagccaggctggccgcctcgccgtcgccgccgcagaggaagaggtgcacgtcggccatgcacaccctgccatccacttcccccttcgtcccgtcccacacggcgacggcagcgtccggaccccggccgccgccggcctcgatctcggcgatggcatcggcgacggtggaggacggcggcagccacctcaccggcggcttgccgatgcagagatccgatacatcgtgagattgcagcaccatgcaacgatacacacgtacagcgacggctgctgctagtctctccaggatcttggaggaggaatcgagggttttagtcaaaaaagcgtagggaaaatcaaaagcgcaagaatcatctgtagctggtgaggactggagtctgagatatgcgagcggcgctaaatatatacaaggcgtcgtggcgacatcatcatcgagttaaatctctaccagcgttttcttcgcccaaacggttcagtagtagaaaacaaccgtttatctcataaatgattgaattgtttggatttatttatactaccaccaatattaaaaagtattattataaaataagtatagagggatataattgtcttgtcatagtgaataaactttatttttttctctctttttcggcttttgtatgaaatacgaattgtgctagcacacaatggatgatcataatcaatttaacccggaaaaaatataaatgcaaaataactcctaattattttattagtaaataactattttattcttaataatattggtagcataatagtaataagtggagtgcacccgctcgttttcggggatttcgttgattgagccgatcaacagaagcggttatgtatgcttaaacggtcgagacgtcggcgtcattcgtagacacgtctgttgcgttgttaagctgaagaagtagctagcctacttggacgtggcaacgatacgcatcgcccggttcccttgtgatcggtgagaaacagtaatgacgtgctagcgtgagaccgataataattagtttgtttaattacgactattaattaattaattaattagcctttttttgcgaggaattaattagtacgactaagcttaatcgatctgctgtttataactttacatcatcgtcagcatgtcaaaacagtatagttgggattgcacgtggcaagtgcatgaatttgaataataaacttcataatccatatgcttcacatacatatatacgtggtgggtgcttactactttagttgcttaccttgccagtgcgtccaacgaaagacaaattgggctagctgtgtattttttgtagtctgtacaattggattgaaacgtctaaaggtttcgtatcagcttcaggacagtaccaacccataacactagacatgatttctataaactccacatcattaagaaaatagtactagacactactctttcaatgcaaacaccactattccataacttcaatttaatgctacttatctcacatgatgtattggatattgtgtaggaaccatgtctcatgcaagacatggtttccttctctttcctcatttattcacttgtcacatcattttttttctaggtggcaactcatttaatgctatggacaccattctagtcattgggttgggaatgccctcataagttaatgggctaaatgatatagattagaagtctcaccaattctaattatttgatattagatcattctataatatttgcgtcttttttttttacaatttggttgtaggaatatacagattgcatatgacagcatgtttataataagcatgtttataatagtatacttaaccattttatattttagctaacatgtataataaattaaatataagattagctttgttttttctcctatttctttctcacactatatatgaatttaactgatcaccagctagagggcgtggttgtcatatactccctccgtttctaaatatttgacgttgttgacttttttaaatatgtttgaccgttcgttttattaaaaaaatttaagaaattattaattctttcctatcatttgattcattgttaaatatacttatatgtatacatacaattttatatatttcacaaaagtttttaaataaaacgaacaatcaaatatgtgctaaaaattcaacggtatcaaatatttagggtttgttcactttgctaccatttcaaccttatcaagttttggcattgccaaattttggtaaggttaccaaaattttagcaaggttgctaaattttggtaagactttatatgtacttactaaactttgacaataaattaaatgtagctattttttataactttatctaaaaagataaggttaaaaatggtagtaaaatgaacgatccttagaaacggaggtagtacaatctgtattatactcccttcggtttcattttaattgacgctttggacaatgacacgctctacaagatatacatttgaccttaattttctattataatatatacaataaataaatgcatgt

SEQ ID NO: 72490 - DNA, 2569 bp, Oryza sativa
tgaaagttcatctattgtttaggtgtggaaaaggagtgaagtgaagtttgaaaaaagttgaaagtttaaaaaaagagttgaaagtttgaaaaaaaagttagaagtttatgtgtgtaggaaagtttttgatgtgatgaaaagttagaagtttgtagttggtggagaggaactaaacatggccatagtacccgtttttcgattcgaaatgtgcgagtattcattggtagtgaaacggatgttcacctccaagtccagtgaccaactacctgaaaaggaccgtcactaaactagctggcccaaattcgatcgagcaggttcagttctcaccttgagtgacctttatgcctactcatcataattaaagaagacaaatgtactttaatcgacccggtaacaaacagcaataaaaagggtcgccacactctcgatcattctcttctttcttttccacgagtcgtgtcccctcaaaatggacgctagctagctagtagtagtactcatcacaattcagagtctagaaagcaaaccagtagggtttgttatcgaaattaaccttattaaaatttagtagtgtgaagggcttgcaaagttggtaatactaaaatttggtaaagtgataatggtaagagtttgtttagtttgttaccctactaaattttggtaataccaaaaaattggtagggttgagagtctttgagataactgtggatcctgcacgcaaaacaaacattgatcaatgctaactgacaccagagtgggtgaagaatgcaacaagttttgggccgcaactggctgctggccactttttgggccagaacgttagccagtcacttcaggcccattttatctgggctgaaactgtacagagacgaaaatgcggcccattatatacgtgccggataaacaggctataaatggaaggaaggcccatggaatataattgcatgggcctagaggaaccgggagttcgcaccaccactgcactcttcctttttctatctcttcatcactgcaaaagataacacaaaatcacccatcgacaaaaataaaaaatgctttacttcaattcaggtactctaacagatggacttactacgctttatttagtttgaaaactggggacttacaaagttacaccggccggtgaatggggatgacgtaacagctgttttgcaaccactcaatctaatcattcgaattaataatagcgaaatctttcgctaatacatgcactaatcatgaatggagaggaggctacacgacgacaagtaggatatttttttataatccggcagtttgcgctctcaaacaagttcataaccaccgattacgagagtgacaaatgaccgtaacaccgcaccaaccttcttctcgccgtccaagttcaaccgctctgtgcacctggaccatacggagtagtagaaatttggaatagactacaaacaattttttccaactacggcatgtggtgcacaaagtcgtattcttattaattaattataggtaggagccttggtattcaatcaagacgaaagaaatgtccacaaataggtatgttttgcagatgatttctcaagtgtacatcaacagaagttgaacataaatggattgatgcctgaatggtttttcaaacgtatcctctatttgaactagattctctgtttttttttctattattactatatatatcgtctggtgtactactactaaccaaaaacggtatataagaaaccaagtcataaattatggaccaaacttttctgtttgtgttttctgcggtttaaaagttagtgttgaataaaaaaaatcctaaatttaactcaaaaccaaagttttataatttaaattttaacaacggcttataaactgtgaggcaaatgattggaagcttttacctccctgttttcaataaggatttggaaaaacctttttaaaaaccacatctagaagaagggatatttaaaaacaatcacaaaaaagttcttaatcgttaaatcgaactatatgaggagcaggagttatacaaaaatctaaatttacttgtaccatgccacttcagcgtttgtaagatttttttttcttgaagaaaattgtacgaatcgacttttccactttcaaattcactgttcaagccgccgtgcaaaattcgtcaacacccttttttttctccaaattttctccgtctcattccctaaacccccactccccccggtcgtgggtgtatagaccaagctcacgtggccgcctcgagcgtccaaccgtgggccccacgaggtcactccacttttccccaccgccatccactcccacctcgcgcctcaacccccaccgacaggtgggccccaccttaacccgaccccacctgtcattcgaaggggtaaccacacacctacgtcgccctccacgcttgggccccacctgtcagtcagttggagctttttatctctctctctctcctgggacgcgtgcccctctctccctcctcccgctccgcgcacgcaacgaatagaagcagaagcagaagcgaagccaagaacaccgcgaagtggaagacgacgaagcgggcggc

SEQ ID NO: 72491 - DNA, 16438 bp, Oryza sativa
agagagggaaaaacaggggaaacggaagaggaaatcgcggggaatgattcccccctcattatggcgcgcggggacggcggaatccggcggaatccgcggcggcggcggcgctagggcacgggcgaacgccggaaacgccgggaagaaagccgatgacaggtgggccccacccgtcagcgaggggggcgggcgggcccgcctgtcagcggcgctcgcgcggggaggagccgatgggccgcgggggagaggagagagagggagagaagtgggccgagccggcccaagaaaggaagggggggaaagaagacttcttttagggtttttctttttataaacctttttaactttgttcatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcaaggatgtattttagagtcgatttgggacgcgacaatcaccgacgacgttatcatcgccgcattcaccaaagggattcgccacgaagaattggtcggcaagttcgggcgtaaacctcccacgacagtcaaacttatgtttgaaaaagccaacgagtacgccaaagccgaagacgccgtcaccgcatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaactcccaatgcccgcaccatcctaactccaaccacgtggccaaagattatttcgtctacaagcaattcgcggagcaatacaccaagactacacggaagaactccgacgaagaacaaagcacgtcgaggaagaaggacgacggcgacaccccggtaggatttcaagaccaccgcaaggagctcaaccatatcttcggcggccccctggcttatgagtctaaaaggaagcaaaagttgaccaaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggatgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaagaagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgcgtggaaatcatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatactgacctcaacaagtcttgccctaaagatccttttgggttgcctcgcattgaccaggtagtcgactcgaccgccggctatgagcttctcagttttttggattgctactcggggtatcatcagatccgactgaaggaatccgactgcttgaagacttcattcatcacgccctttggagcatactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcaggatgaaattaaaccctgaaaagtgcaccttcggagtaccgtcagggaagctgcttggttttatggtgtctcataggggtatccaagccaacccggagaaagttactgctatcctcaacatgaaaccgccaagtacccagaaagatgttcagaagctgactggatgcatggcggcgctcagtcgatttgtttcaagacttggcgagcgggggatgcccttctttaagctactgaagaaaacagatgatttccaatggggacccgaagcacagaaggccttcgaagattttaagaaactcctcaccgagccaccggtcttagcctcaccacacccgcaggagccgttgttgctgtatgtatcagccacctcccaggttgtgagcacagtcttggtcgttgagcgtgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacggattgctaagtgggctttggagttgatgtctttggacatatcattcaagcccggaattcaatcaagtcccaagcgttagctgattttgtcgccgaatggaccgagtgccaggaggatacccccgcggagaagatggagcactggaccatgcatttcgacggatcaaaaagactttcgggcactggagcaggagtggttctaatttccccaactggagaaagattaagctatgtgctttggatacatttttcggcgtcccacaacgtcgccgagtatgaggcgctccttcatggactgcgaattgcgatctccctagggataaagcgtctaatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggttgcagccgactggcgagagcccctcatacgattcttgacttctcaagaactcccccaagacaaagatgaagctgagcggatttcaagacgaagcaaactttatgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccagttttttgccagacaaattcatctaccagctcaagagttgcagaccatcccactgtcttggccgtttgtggtttgggggctcgacatggttggcccgtttaaaaaggcagtcggcggttacacgcacctctttgtggccattgacaaattctccaagtggattgaagctaaaccggttgtcacaatcacagcagataacgctcgagacttcttcatcaacattgtgcatagatttggagtgcccaatcggatcatcactgataatggcagacaattcactggcggagtttttaaagacttttgtgaagactttggaattaagatttgctatgcctcagtggcacatcccatgagcaatggacaggtggagcgagccaatggcatgatacttcaagggattaaagcgcgagtttttgaccggctaaaaccctatgccggcaaatgggtggaacagctaccatcagtactttggtctttgcgtactacacccagtcgggccacaggccagtcaccttttttccttgtctatggggcagaagcaatgttgccgagtgaagttgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttatcataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcatcgtttctacgcttaagcttatcactgtacttccctatcttgactgtcaacatcaagttttcttcttgaagttgtctgtcgggggctatcatcataataacggagtgtgattttttatcaattcaatttgcttccttggtctatcattgccttgtttgatttttctacttagtctgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaaggtcggtgttgcgaaattgatctacgacgtcacttgcgatcttgtcagccgcattttgagcattgctgataagatcaagagcagcctctacgcttgtcccgtctgcaaagccatcaatggcgtcaatttcaatcctcgggtacaaggatttggtcatcgccaatgccgtgctagctcccatactttcagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcctcttgatcttaccaaccaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcgagctccttggcctcgtgtagctggtccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttatgagttctcgtcccaccatttgagcaagataggaggacgagagtcatcagccgcctttatgcgaggaatttcttcttcgtcatcgcctggtggtcctgatgtatttccaagatattagacgaataagctgaagttatttaaatcggcatcacttgagaagatgagttacttgagggtgttcctagctgagcgtggggtgatccttgttctttatctggagacccaatcatcgagtcgttaccagcctctggtccttgagaagttgtcgtctgcgtttcaacttcgggagtttcttgatctggacctacatccgactggtttccagtcgggggctcttgggttgttgtagtttcagttgctgccgactggtttccagtcggaggctggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctggaagatgttctaatctttggccttggacgactagccagttttttcctgggagtggtatgctttgggagtttattgggcgagcctttgtccccagatttgttgccgtcgtcgccttcgtcgtcattaagcaccagctttctcttgcgagaacctgtctgcccagtcggattggaggtttgaggttgcggatctgatctgattgtcggccctccacctccctgaacggtgtgctggcgaggagaccggcgctgagtgattggggggtcagacttcatcaatacatattcctgaatgagatgcctccacggttagttaactcaacatgaagacaagattatgttttggtcatgggttgaagatttcggatacgtacctgcggaggcggattgaatgcgttatatggcacaactggcagctgatgtgagtagctgacgacaatagcatttgagaagattttacacattctctccttcatgattttaaaatccagagaatctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcagctccaaggcttgggctgcttcatccccaatcggaagagagttccaggtatcttggtacaccggaggaagacaagagtactcgggaagagcaggctcaggattctgaatataaaaccagtttgcatgccaccctttgtttgaggtcttaaagggcatagagaagtacttctggctcagagtccccctcagctgaaatccggcccctccgactacacatggcttactcttgtttagttggggcttgagaaagaagattcggcgaaacagagcgaagtggggcttaattcccaagaaggcttcacaaacatggacgaaattggcgatgtgaactatggaatttgggtttaggtgatgcaagctgattccatagaagcttaatatcccgcggaaaaattttgaggtcagaagagcgaagccgccatagaagaaatgggagaagaccacagcctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttccaaatgcgctgatttgattcgagggatggctagggagaggtgagggattgaggcggtagatcacgggaaggattttgatgaacttttcgaaggtggattcgagtggaatggtgaaccctagtttgccggcgcagctctgtactgtagcagggagtggggaaaatggcgagagttccggcggggaagatgaagtgtcgcttggatctcgggatttcttgttaagggtatcggaggtgcgaatgggcttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttggaatgacttgtttttaccatagtcatttccttggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagagtgttaaccactcggattccttttaattatggctaaaaagcagtcggctaagaatgcttctttaggcgccgtgtatgcttttgtcatatgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgtgaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaatgagaaggcatgaacctgtataaatcctttgtctccaaacccattcacttctccagcttgatagccaccccttttattattgccgaaatctagtttcgacactaagctttataaaaaaaatattgaccataatatactaccgtcctaattgattcgtcccgacctttggaaaaaaaaacaaaattcattgaaagatccttttgaaactctagtatttagaagaataaatgcatgaaaatccagaaggtaataaagcgcttatcattcaatatatacggtcccaaatgatcaaacggaccgatgagcagcactatcatggggtcggatggcttgggttactagagtacatctgtcctctcaggctctcactaacaaaccctctcctccataatgtggttgtgggtgttggatctattcttgtgccaaatctaagcaccccgatgctcaaaattgtaaaaaaaaaaaagtaaaatgttgaatgtgtgcttttaaaagacgttattgtacttattcatacccgtcacgcaagttcatgtacctaagtatagttattttttctctttctcacgatatttgtgaaacgtgcgctgcgttgtggtaggtgttgaaaggccaataattgtggccttttacagttatagagatatttttccatatgattatccaaaatccccacgcatttttgtagatgtttcttcattttcttctaatttcctgatatctgataattcaaaacatttgactcgataaaatcgacacattgcgcaaacacccttgatatataattttttttcccgatcggtcaccgtttccaatcctattggtctcgccgttcgaattgaaatttcgattagtaaatttttgtttgatttttgtcagtaccctagacgcagttacgttacgtaccgcggtaatcatccatacaaatggggtggcgagtggcaataacctccaagatgagaattgcaaaccctggcacgatcgatacatcgataacctgagccatctacttattcttgatcgaatgattcaaatcgacagaggtcgacggccgcggcggcggcggcggccaaaagggcgtcgcctcatgcatgcgctgtgcctgctgcaggtcgatgagagaacgcatgcgcgcggcgagctcggcctcgcgcgcgcggagcagctcgttctcggcgtccacggcggcgcaccggcccacgggctcgcgcgcggacacctccacggcgccgttctcggaccgcagcgcggccgcctgcgccgccagccgccgctggctgcgcgcgcgcgaccgcgagcgctgctcggagtttgagtactcctcccgcttccgcttcccctcctccatcacccagccacctccgatccgtcagacaaaataccgctccaaaacgataagtattatcaattcggagagaacgtaagtaattaattacttggttacttgattgatttgctccggggacaactcttaattaacaagagtaattaacgacttgaaaactcttgcagggtttggttgatgagtagaagatgtagaaccagtagaggaaggaagacgactgcacgagagcaaagctagctaagcagtgcggcgctgccactgcaagagagcgaccaaaccttagtgagtgaggggcgaaatttatagcagaggttttgcttaggggttaagtataatcctactttagtggggtacttgcaattggtggatagtggatgggaaagaagacgaaataaagaaaagaggagaaaggaaaaaaaggtgaatcaaacgaaaacggacgtgatagatcgtttagcgagaactagctaaaccgcataccaaaacggtgcaatggtatataaatatcagaaaaattgctagttcaaaattcgtttttttttaatctggagttcaaatatatgtttagattattaagctcacgaacgtgtgacaaatctatctatctattactacctcacgaatctggaagcatgaagagcaatctgtagagaaattttgaattgtttcccgtagcgtatcactatgcccaacgtattcggccgctctaagagcaagtttaataagtttaatagtatagcccattattagctccaattcacctatagcaaatctaatagccaattcatacaactagtcgccaacccgttgcacgggctattactacctgatgcaataaatattaaaattgtgatcatggaattggatgttttgtaattattaatttagtttttttaattatgttaatcaagtactaaaggtctgatgtcatattcattaattttgaattctaaaattattaaattctataaaaattagaactaaacaatccttggtacttctagtttgatgttttatttaacacaaattcttctagtttgatgttttatttaacacaaattctttggtacatatctacagtcattatattggtatgagttacatatatacataattaataattaataaagttgttttacaaccttattgtgtcaagagcaacactcttacaattatatatatagtttattaaaaatgttattgtgataggcaataagttttaattatttaactgtacgaactgcagtgatctgaaacataccggatagggggtatgttttgctactcattctattgaaaaaaaatcctaattcattctgttgcaaaaaagcaccagtgcatttaataaaaaaggtatgttttagttttgcttctctagtcttgatgttctgaactttgatatcgtttgaaaagctcagtttttttgtcattgttaactggatgatattctactacggatgaaaattgtgcaatgtagatcagtactgatcttttgtactattaatggcctgaacttattgacctgaattttttttatattatgtatcaatttatcatggtgccgaaccgtgaagtgcatgggttattatatagaaaaggctatatgtactaactttttctattcttactaacactgatgtgtcatgctatgtcatgctatgagtgcatctagattttttgtaacttccatctacttaaatcaaacggttgagatgattgttagtaaaagtttagtaagaaaaatttagtacgtgtagcattgctcttattttatatatatatatatatatatatatatatatatatatattctgggacttcgaggttctcaatttaacaattcaaaatttgaatattgtaactgctagtttgtcctattgttatactcatgatttttaaaaagatgaattaataagtatttgtaccaaattgtattaggtctggagtctgaatttcttttcatgattcagtaattccaaatgttgcacaaagattctagttttaattttaattattaatgatttaatcattttgaaattcataattaataattagcgtggtgcactcactttggagtccggattatatcttttcatgatttaacaattctgaaactattgccgttgtctgcctgcacttgattaatctccacatattacattgttgttagtgtaaaataactcctgagtgttgctctttacttacattacaactaaaagtgaatagccgatgttggtatatttgctgtagtattaattagcgtggaaagaatgaggctgattgaaacatagctttaggagatacaatcaagcagtacatagagtcatcaaaacgtaaagattagaaaaaaaaaacattagatcgtgcttacttcgtacttgaaggtctggccctttggcattagatcgtgctgctcaataatcgtctactgatggttgatggctgtgccgctgcggtatgtgcaaaccaggccaacatgcatgagccatgcaacaccaaaacaggttagattagatgcatagacgaacgtcatgctgtggcatctccgccgaagagcgttatcaatccagatcgatactctgcatgttaaccacttttcagatcaggaacatgtaaagaaccaactaattaaaaattaaaagtaccaattgaagctttgactgactccagaaactggtcggataggtcccgatcgagatcgtgatgtcatgtgcgtcctatctttgcctctctttttgcttgattgcgctttgaagcggttctcgacacggagcgttaccgagcaacaggcgaactccaaggaggtcgacgcctcaacatcgacgacatggccgcggcccggcccaacgctcgtcccgtcgtggcatgaatcgaggaacacatgaaaatcgagagagtatatacgtacatatagatgagaacctatcatatctaaacaaggatcgggatcaggtgcagtccctatagagactgcaactttggcagtagccaatctgaaccgttcaaaaaaaatcagacggctggctcacaccactgcaccagctagcacccaaaaggtcatcttcttccttgagcggtagagctctctttcttctccatgtcaatggaagtgctcggtgcttcttcttacttcatgacaagttgacaactacgggaccttcgtacaaaccattgttgtgacagtgtttaaccggtcaagcagattctatttttcgtgcttcatcatgatgttcttctgtgaactcccataaagtgataatctgcactgtcactgtcaaacgccaaggcagtaattaacctgcgagcagaccaagccaacctcgcatcctcctcgttcgatcctacacctagctaccagtccaaatcaccgccaaaccacgagcatcaggcaagtaacaaagctaagcagcacaattcctggccttgaacccttctcacccgctgatacctccgtcttgttggtgaccacgctctggtgccgcctccaccgctccactcttgaagcccaccggagatggagaggactaaagggttgttgattcgtagacgtcggatgcttcgtggatggtcagatcaggtgctactgctaaagttgcagtaacaatagcaatttcacctgatccgaatccctaaaaaaagagatgagatcgtatcacataattgatattggtattcagattgattgggccttcgaaattggcccattaggtgagatcttttatctacggtcatcataatgagattaatctaatcaacggtcagatttttctggttaacgtgagagctcctaaaaagtgcccaattagtataggtatagatagatagatagatagatagatagttacttacttactatactattaatatatggtcccacctgcgatacacacactgcatcttgtagtccgtgttgtagttggctatagatctgtagaccgctgctcttctctttcatctttcatatcattaaaatatgtttataattggctaatagtctactattgtatctgctctaatcatgctgctctcatcgtccgttcctcagtggcggccaccacaggcaggtgcccaggctccaccgcattaaccaatgtattatcacttaataattgtctaatttatttacttctttttgtggaggctacgacaccagcagccgtcaagggaacttgtagatccgctactggccgtcgtgctgttcgccctttcgacatcgacgtgcgtgttgttcgtccattaattatcaacacaagcgatgcatccacgcaccttttgaatagtggagatagggatatagatgtgtgtgtgtcccattttagatgtttaagctcttcttgattcataggagggcttcaacctctcgttagatgggtggctattaataacctctgtcaatctaaacaatagtatcattaatgtagatgggtgtctttccgtaagttgttccttcacccttgcaaaagaaataaaacgtctgtttagtggagtttaaaattctgagaagcagctggttggtagccagcttctcagaatctggaaagctgggtttcctagcttctggcttctagtttattttctgaattctacaactacagtttctcaggatctgaatcaaaagctagactgtttgggggagcttttgattctgggagaagctgcagcagttagaagctctcctagacaggcccaaaggctcctaactggttaaatgtcccaaacaaaacacccaatcctagagatatttctgaacatatagatttttttctaagatgaagagagtacatatagattttagaacttattttattatttttgttataacttgtaaatgtcaaatttgatacattctctgtcaaaaaaatccaattctaaagatgaatctcgataaatatgtgtccagatttatctctagaatctaaataaatgagtatatctgtagttgaatttgttgtttttttaaacttgtagaagtcaaattttaacatgtaatatgcagagtgatgaaatacatattgatcatttgatctacattattttttaaaaaaacataaccatttattagttagtatgtaataaatgagtggaccactcgttgataattaaaacaggctccccaaacacaagtggaacacaagggtgagtgattttagatatggatcatatgtactagtaatcttcaagcagtgttatggtcaccttcaagcttatgatagatgaaactgtttttttaggggctattgcttatttgaccccgttttggatcctaactaccaatttgaccctacttttcaaagtttgcttatttgaccctccttttcaaaaacgaagctcccgtttgaccctgtttccactagtccgttaagtttttatttaaaataaaaaaagaaatgcaactattattcataatacccataataaccttaggaaaccctatccatccaccctcaaccctatccacatttctctctctacacaca

SEQ ID NO: 72492 - DNA, 5854 bp, Oryza sativa
tcgggcgccgcgcgcttgcggctcgccaccgcgggcgccatgggtggagccggcatgatggggagaagcataggagagctgatgggagaagaggatttgggtgggaagatttggaaagggagcgtggatggcggcggagaggaggcctcgctggatgacttgattttatagggcatcggtcgatcggacggctcgaaggcgctctccgacttggaagtgggctgcatcggacggtggccgagtgcactccgactccaacttcggcgacagatggatggagtaagcgttaagtttacgcgggtcgatttggaaatgggaaatcttttcagcgcgcaaacccctggcgtagtacaattaaaagggttggaatccaaatacatttgcacttaataaagacagcttgtaccaaaacgaagtggagaccaacatagattcgttgtattaggatgtgtcacatccagtacaaagttgctatattttgggacggagagagtattttttttcatacactctcgagggacccattcatctcaggaggcggacagtggtcgagacaaagtgagcagtggcgtcgcacgcagatagagcgaagggagcagaggcggaggcggcggaaacgcacggaggtgcagcagcggtagcgcacgtcgagattggcgacggcggtgcgcgacgagaccggagggagcataggcaaaggcagcggcggcacacaaaggtggcggcggtgataacgcatgccgaaatgggcgacggcggtgtgcggaaggagcagggtccacggcggtgcgtggcgggcacagtgcgcaaaggtagcattgcgaatggcaacagcagcgcatgacgagatcggcgatggcggtgcttggaggtagcaggtgcggcggcaatgaccgccaactgcgcatcaagccaggatagtggcacaaggaaatcgcaggcacaatgacgatgatggcatgacagtggcgatgacagcgatggcatggtaggtgggatcccgcatcgagctcgacatccacctttggctccttctatcaagatctagccgggtcctcatggtgcgtaggccaggtgacaaggtcagtgggcggctgtaggcggagggcgagcaaggggcggtttggcagcgacattggatttttcccgccaagcatccccatcttggagctctatatgtgtttttcttcactgtatgtagtcttggatgaacaaaaatgagacaacatgttgtcaaaattttacaaaaaaaagcccgtttaattttgtcaaaatcttgctaaatttgtcaaaatggagtcaaatctatcaaacctatctctaatatgtcatgcttgattcattacaaatatataaaaagttttgaataaacaaaatatttttatacaacaaggtcaaatgaacaagggcaaaaaaggataatttggcccttagttaactccgttttcttgccattatggaatagggtcagccactctgattttaaaacgaggggtcaaataaacaaaataaaaatattagcagataacaaaatcaaatcggttgccccaaaatcaaagccaccaactgtttccttctggtatagaagtatattgccactcaatttttatagatttgtattgcaatttactagagatgttatttttccagtaactactgaaagtctgaaactacttcatattttctttaaggcaaaatatgcttcaagacatcgcatggagtgaattttaggggaaaccactttataaatatggtaatttgcatgcagacaccgtgccaattattttagtgtattcgtgctgacgtcgtgcacttttttaccagtgtgaacaaaatgcccctatcacgttgtgtcctcaagttgcgatgaggtcatcaccaggggggatgggaagccgacggatggattgtggaagccggcggtggcaagggggggagggaaagccgatgaagggcttgctcgctgccaccgagttctccacatgccgtcggggtcgccgagggacgtgtgctttgctacatccctccacgcaccgctacagtccacgtgcagttggggttgtcgaggccacacaccgtcgtagctcccatgttagccccgggtttcgattcatctttccaaccaaaccagagccaacacagtcttaaggttcgtgcaattttttccaagttcaagattccaagacccccataatcctttggcttgcaaacatagttccaatttagaaggcagcttcccgcacagacgttgtccgagtcatcttctttctagaggaaagctcgtctaaaatgatcaatccgcttataaagccattcattctatggtagaactgtaaggtggtagataggtgttgccgacaaggtcgatttgacgaggacctccgggctagccgatgtgaaaaatctgcccttccaactcggtattctcaatcttatcttatccactaacggttgtagatcaactttcatcattttatggtgtgaagcagcaaactgagatatttgcgagggaatgactttttatttactggaaagaacagcaggatgccatcgaggtctaaaatatctcccgatcttcgttttgtccatgcttgtctgcagaacattagaccactgattgggctagccaagtagggtcgtgggggagatgggccgaaaggggtacgaatcgattcggtaaggaataagttcaccggaggtccctcaacttaatagcgagatttttttacgtcccttaactacaaaatcagaaatcttcacccctaaataataaaaaaccatccaatttagatcctatggcagtatacatgtctgtcagtaaaataaaaaaaatatatggatcccacatgtaaatgaaaatagatagaaaatgtggggaccacttctcttcttctctcttttctctttttttcttctcttcagctcctctccagggaggctgccgccggcggcagatgggggcgaggcgagcctggccgagctctgccgccgccgccgcactgacgcacacgtgctcgtccgctgtcgcttcctctgcccccttcgcccccgctcccgacggcgaagaggtcccctgccccctgtgaccccgctcccgacggcgaagaggccttggtggctacggcttcactagccgccatccccatccccatccccatccccatcgtccaggaaccacgcgctgcagaagacggacacgacgagaaagctgtgcgcgagtgcgacgcggagcttgcggccgtcgacgggatcctccggggcggcgggcagcgaagggcggatggggcaggagtgggcgcaggtggaggtgtgccgggtcgaggacggcggctggagatggtgatgggcggcggcatcggcttgcccttggcgggcctataggaaccgaacggcctcggggtcgggaagaggacggcggaggtggtgaggcgcgggagcttcgcgtcggcttcaacttccacaagtcctcgtcgtctctcgccgccctcctcgccggcggaagctcgccaaccacgcgctcgtcctcagtgccaccttcctctcaagcttcaccgccgtgatgaggtgctcctccgctccgacgacaacggggagctcgcccacgccatgggcgtcgagctcaacgtttgctcccgccgctgccgccgcctcgtcgccgactgacctcctcgtcgcctgcctcgccgccgccgccgcctcctccccatccgccggccgctctacagaacaaaagtgagagagagaagggagaggatgcacaagacagatgacgtggggctgatacgtggcccctttttttttttctgactaggatgccacgacagtaaaaccgggcatctatactgtcatgagacctaaattagacggtttggtatagtttaggggtgaagatttctgattttacggttaagggacgtcaaaaaatctcgctgttaagttgagggacctcgggtgaacttattccattcggtaaatagttaaatatctcacaattggtatgggagatgaaaaattactttttttttcttcacgggaaaatcaattgttcttctttctcagggcgtagacgtgattggatatttccaagcctaatcggactcaaaagtctgaattggactctttttattattgttttgaatttcttttatatagtactttcttgtggccagtgcacgttttgcgtggcccaaattaaggcttacggctgactgtgtgtcgattgaatctccaatcccgtcgccactcgcccccacctccttcgccgccgccccgccgccgccgaaccgcaacgcggcgaatctgctcccctccatcttcggcggaagtcccagtagatcgaggtatgatcctcctccgtcccctaccatgttcgttatggcgtccgactcgctgatacgcgtcgattcctcgccggaggaggcggctgctgtttagggttagggttccggcaggctctaggggcggaggagccggtgcaacgcccacctgctaggccgccagaaaagataatactaataatttcggccatgctctgttagtttatgaatccatacagctaggtctcctgccattgccaatcttgctgggctgaagctttgaaatttacatgtggtataatagtattctgttgggtagtataatttaataaaagtgtcatccaccatgactgaacgctactccatgtttcaacctcttgttatgtttacagtgcaggttcctctgtttagttttatgttcatggttaaaccagtatcagcactttatttttaccaaatattattctgatagtgttgtatacttgtattcatgattaaacaagtgtcaggcttttctttttaccaaaacacatggaatacaagttgatgtgttgtgttcatggttgaacaagtgttagtactttccttctaccaaaacatatgacatgcgagttgttctgcaagcagaataacgatagtcaagtacaaagtacctgagcagtacaactgaactaaaaaaatacatatttttgttcaatctctatgcacaaggttggagcctgtcagatcgctgtcaattgcatacagttttaggcttttattggagctatgcaggttctttgagtgcagagtagtaaaattatttcttcttctgaaaaccgttagttaattgttatagcatgcttcgtgttcatctggcattttaaattctgaacacatgtgatgcttttaggaagaggtcagtagagcgtgagcaaatattgtgtacagcggttggttcatataacttaatttcatgcacgtacagtattcttctatggatagaactgatgccataccatagatactccttttctttttgcaggatctatcataacacacttgcagacatgccttggctgtgaagatcatacactaagatgcttgcagacagaggctataccctagaccctctacagctgctgtaccagatcagcagtgctagtgctaccaacgatcagactagaagcgcgacgcagttggtgcctcctgcactgacggttggaaaagcaaactccaagtctcgcacatcccgttcggtgatgtgggtactggcgatctacttaccctccatgtcatcgccggttccacgtacttggcatatgacctctacatccgccctttcgatggtgctagctacccatggtgtctgttggctgtcatgtgttggctgtcatgttatggggagtctacatggcgctggtcgctgtggtaagacaatacatggacctgttcttgccaagtgctcccgctgccgtgcggcacacactcgtcgacgttggctggctttgggtcggcgtacctgtgtttttcgtagactatattctgatgaactactg

SEQ ID NO: 72493 - DNA, 2159 bp, Oryza sativa
cttgtgtgcgtgtatagctggtttttgtatgtttttttagggaggtttatgcatgtacactcctacagaaagtgctatagatgtcggttgtaaatatcagtttttccaaccgacacctataggccggcagtgatgtgaagagatataggtgtcggtttagaaaccggcacctttgacgatccacgaatcctgatgcatcgagtcaactccatcgaaatcatcacgaaaatcatccaaacacaataacaaaaatcgattcccctaccttcccatcgttgatctagctgcccccaccatcatggcagccagcggcggagaggaggcgccttccctcttgctggcactgccactgccttccctctcgccggatctagtggaggggagcccaacgccaccactcgtgggtagtttgccgtcggtcgcgggagcccgctgaatctagcgaaggggagggtgggccgctgccgtcgtcgggcggcggccgtgagagagactaagaaagagacgcttgagagagaagcgtgggacaaaggagaagacactagagaaaagcgtgggtatatgtgccggtttatttttaaaaaccgacacatataatcagtcctttaattaaccggtaactataatattataggtatcggttcttttaaaaacctgcatctatagtatggttttttctctagaaccagcacttatagtgtttaaaggtgtcggttctatattttttttatcacaggggtacggcaaaaggtcgataggtgttggactaaaatgaatcgacacctatgaacatttctctatgagttttttttatgtagtagaggtatttttgtcattgccttttgtctttaactggtttaataattacaaccttttgttacattaaaaaacattaaacatactttctctctgtttcaaaataaattaatatgatatttgatacatttttactataaatctagcatcaagtattatattaatttatattggagcggtggtggtaccaaggtatcttacaacacacaccacaagagatgacaagatcagtcatatcgcagatcagattgcagcagtcttctcccaccttgttttgatcgcacgaaaaaaatggaaactatacggttcacactttcttgtctcaagaatatactgattgcaaacctatatctatactagcaaaatacccatacgttatcacgaaaaaaataaaaatacgataaacactagattattagggtctaattttcctaattcaggactgggtaaattatgcaatcctagttagcaaaatacccaagtgttacagcgagacgaaaaattttggcgtgtcatatcggatatatggacacacatttgaagtattaaacgtagattaataacaaaataaattacagattccgtctgtaaattgcgagacaaatttagagcctccccattccgctcgtcagcctccccacctccttcctctctgtgtgtgtgctcgccggcctccttgcccgatggatgctgcccccgctcttctccctctctacgtgtgctcgtcggtgggtgcgcgtcgtacgctgctttcgagccgaggaacacgagcgtcgctgtggagaaaatagagaagaaggcacatggaacttggtgatatggcaattgtacagtgttttgggggctgttacatccaatcgatgctatagcatctgccaacttattacattcacgaggacattagctaactcaaaaagaaataaaagccgaggttataatcttcttcgcttctaggacaagaacccccatcgctgcatattgtagattcccttccttcagggcttgaaccagcatcagtaaatcagactctagatggatatatgccatacccccgtgagatatcgcttctactgccttcaccgcggccaaaacttcagcgtggaaggcatcctgcaaccgtgatgagtttccggcacccgcctggatcacatgcgcgtccgcatctctgataacataatcccagcccccgtcagctcatttggtctaaagatccatcaatattcagtttcaggacatcctcctctggtctttcctattttctcaacaccctcgccggcccaatgtttactgcttcactgacatcatatggaactcgtcagattgcttcgtgatcatgaaagcca

SEQ ID NO: 72494 - DNA, 1605 bp, Oryza sativa
tttttttcgtgaacacgcaaaaaagattacacgtagtatattagaataaaaaaattgtagttacacaacacaatcagtcagaccgacttatgccagagaacggctaaacacaaactctagaaagtagaaagagcgagccacgctacattctcaacaaatctccagaaacagcaacactagctaaaaaccacgtatatccctacacacttccacagctaatatgcaactgcatctgcaagtgtaattaagtatgtaaccgagtaattaactgacctggtgcggcggcgaggcgtcggaatcggccgggcgcttgttggaggcggtggcggcggcggcggagagcacgagtgacggggaggaggcaaccgcaggagccatttggtcggttgcagcagcagaagggcatgccgcgcgcggtcagactgctggccttaataacctcgcgctatctacaatctctgccgcttaatctgcagtttctgtgggcgcgtgatctcgatcgtctctctcgggagaaggaagaagctaaagctagcaagcagccggctatttgtagcaagatcctagtacgagacgacgacgaggaggctggggtatacgtagacagagacgtagcagtcagtccgacctggagggcggcaaagcaattatgcctgagcagttggtgatgtgttggttttcgtcgtggaccggctaggctaggcgagcgagcttggcatagctgctatatatagacggaggcgcgaggaaggaaggaatggaaggtggcgggcggccgccggtggagcccgcgcctgacgcagcgagatatactctccttgtgcgttaagctttcctcaacttgtaccacctcgctaagctagctagccctgtacacacggttcgcgatgcgtgcctcttgcctctggccacacgagcagagcaacgcaccgcaccagacgtacatgcgttcagggatgaaaacggtcggaaggatagcatttctactcaacaattgactgagtatgtttagtttgtgaaaagaaaatttttaggtatcacatcagatatttgaccggatgttggaaggatttttcggacacgaatgaaaaaattaatttcagaactcgcttgaaaaccgcaagacgaatcttttgagcctaattaatccgtcattagtatatgtgggttactgtagcacttacagctaatcatggacttattagactcaaaagattcgtctcgcgatttttctcctaattgtgcaattagttttttcatttatccatatttaatgttttatgcatgtgtccaaagattcgatgtgatgtttttagaaaaaaaaattggagaactaaacggggcctgagtgcgtagcactctttttttctactaatatattggcatgcaattcttttgcgcgttcgaaaaaaaactcaacaattctcggtcagttgaaaattttcatatccgatttagctatgggaccaactatacatttgtcgacaaattttctactaaaaatttgacagatgtaattatagtacaatcgtaatgtaattacactgtaacttgtatgtaattacactgtaacttgtatgtaactacagtgtaacttgtatgtaa

SEQ ID NO: 72495 - DNA, 1129 bp, Oryza sativa
tccccaacaccaccactgctaccaccatttcgtgcctctgtggttgagatgcaatcagtagcgttttagaacttcctcaatttaaataactcaaaggcaggggccgcctaactcaatacttgtgcgattagtggaaccttttagatgtctgtggaacaacttttctcgtaattgtgagaattattatcatcagggtgtagttgtgtatgcatcaagttccactgttgttggagcgttgattgttagtactattgctgttcttgtcttccagtggtaggtgtgagttatccatgaactttttattcacctgtcagcctttattctttacctaaatgtttttcaaataaattctagtgtaccaaaaatgttgtggttaagaaaataccaacgaaatctatgttgtgatgtcatatagttcaatcactctcataacctttctcttatgcatgtccctgtgatgtaacatttcctgagttatgtataataatagaaaacaatatcgtaaagagcacactatatgtttagtgttgtatatgttcttgttttcctgatgcaatgttgtcatatgttgggcaagcttatcctgcccatctttctgtccaacttcttcaagtctgaagatattcttttttggggcccatttgtttttattcaacaaaatagttgcacacgtcttttgtgctgcagcatttcattttatatgttctcttctgtcagaacttggatgaggtgcaatcgtacattctggttaagagaacttcagaaaacactccaacagctcttgttgctgatactgaagagtttcttcgcctggtatgtttatgtgttttttctcccgtaaaatagacttctttatgcactgcagttaatgctgactgtagaaaattagaaagtaaaatgctgcaacataattcattatgtatggtacaattgcatatttcttttggaggctttttatctaatttcttttcatactacctgttaggagtgctgagagccatctatgtattggttatactttagcaaccaatagttaaaattttgaatacacttatgaatagattcttacttcatcaaataatttgaatctgagatctcaagaaagaaatgtgccaagttaaattaaact

SEQ ID NO: 72496 - DNA, 18254 bp, Oryza sativa
  unsure (1)..(18254): unsure at all n locations
gcctgctcgccctctcgccgatccgtggagaggagaagagaagagaagagaagagaagaaaagagagaagagaggagaggaggagaggagaagagaagaagagagatctgccgggtgggtcccacatgcaatagggtcaaatgagtaagggcaaaagagatattttgtgcttcagttaacaccgttagatgcccttaacagaacagggtcttacgggggcttcgtttttaaaaaggagggtcaaataagcaaactgtgaaaagtagggtcaaattggtagttagggttcaaaacggggtcaaataagcaattgtcccttttttttataggtttgttataaattaagacgggcgccattcgtaataccaacttaataactcgaataaatcaattaccatccacagaacactaagagataaaaaaaatcacaaatctgcttacagaaatctacaatacgcgcgactccaaccaagaaccaaaaaaggatcttgatcgatcggcgaagatggaccattcgatcctgcgtgctagacgagctaatcattagccgggctagacaagctcagagcaagtataatagtaaactataagccgactaaatgctgtgatggaggagagaagagaggagagggaggagaagcggactgtaaacttacagctggcttggacataagaaccaagagcaagtataatagtaggctataaaccgactaaatgctgaagtggaggagagaagagaggagagggaggagaagcggactgtaaacttacagccggcttagacataagaaccaagaaattctgtgagagacacaagtggatcctatattaattgtaaagagctaactattatatgggtgggctgagagaagacttaaaagaactttatagttaacaagtcgtctgtattattagccttgctctcagagataaaaaacaaacacagaaccaagacctaattaactcaggatggttgttcgccacagtagcacgcaggccgacaggacggcaaagacggaacgcgggaccaccacgttgggcccaaacgagtagaatacaaaggaaaaagtacactggaggtccctgaacttgtcaccgagataaaaaaaaaacgtccttgaaccgtaataccagacacccgaggtcccctaactttacaaaaccggacacctgaggtccctcggcggtttttaactcggttttatccgacgtgacggctgagtcagcgtgggacccatgtgggccccacatgtcagccgggcacgttagcctcatccctctcccccctcttctctcccttcctcctcctctccctctcactcttgtctctgttggcgggggagcaaggtggcagcggcggcggcggcggcctcccccgccctcttcgctctgggctgaggctgccgtgagtcaaatcggcggaaacccaaatcggaggtggcagcgacgcgtcggggaggagctcgtggtggcagtgcccgaggacggcaaggtgggcggtgatgtgcgcctggtcgcggcggagcgggcggcggaacaccgcggcggagtggccgcggagggagcagcggaacgacaaggaagaactcgccgcggtgggaggaggagaagttggcggtggcggcggcgagctcgtggaaggcgcgcgagaaggagaaggcatcagaatcggcggcggcggggaggcacgtgagaaagcgagcgtagatggcggcggcggtggagggattggaagccggtggtcaccaaaagagcaccggcgaggcgggagtaagctggggagaagaacaacggcggccgcggaacagtagaaggcgcgcggcgtccggcaagggaagagcgtatggggagtgtcggtgctcggccggcagggaagatgccgcttcctgctcccgcatcaccgcgccgccttgtcttcttcccacgggccgccgccgcggatggggagtggcagcgctcggcctcgtcgtcgtcggcggctccgggcagggatacgacgctcggcttcatcggcggcggcgcctccaaggggatggggccgccaccgccgccatgctccccatcatggatagggcggcttttcttgcctcgcccgccgagctccgggcagccaccgcctttcaccgccggcgtcctcctcttccttcgccgccgcatcgacagcgtgccccgctgctccctcccggccgcctccgcggcgtcgtccctgcgagtgcgagcaaagagcgagaggaaggaaagagaaatagagaaagagaaagggggaagagagaggctgacgtggccggctgacatgtggggcccacgtgggtcccatgctgactcagccgccacgtcgaacaaaaccgggttgaaaaccgccgagggacctccggtgtccggttttgtaaagttaggggacctaggatgtctggtattacggttcaaggatgttttcgtatctcggtgacaagttcagggacctctagtgtactttttccgaatacaaagggacatttaaacggttgttgcttgggtttagtcccataccggggagccaagccggcacgctgctcctcaattggtggccacggcgccatccaggcgtgccaaagtggaggcacacgaagagcacgagtgagctcgtgtgctagttggcagcacggcgtgcgtggtatatgtgcacgtagcaatccctaaaacaacttacttatgaattgatttgatgaattccctctaagccctgaggagcatccgccatactagcagcccaagcgcgtgacacatgcgctatgcaatcgtttttttcctctctttttaaattactttattgaaaaaaaaaactagaaacatactacacggttcagcatacagtttattgaactgaaacgacctttcatattctttgcataacatcttctattataataggctagatgagagatattttgcatatttttgacaaatatgcactagttctgatgatagttaatctcttctattatgataggctagatgagagatattttgaaaaatatgcactagttctgatgatagttaatatctcacatccttagccaatatgtctgccatcttgttaatttatctgggaatccatttgtcctgcatcaaattgtccggaatatttgtttgaatttgactaaggaaaagcctcagacgtgtcctggctcctggctcatcttcaaattcaaatttgtttgaatttgactaagatattttgtgtttgcaatcgtctcgttgccggtgaggaaaatggtacatgcaaagtccaaaaattttgctacctccatcgccatttgaagagccatcaattctccctgcaaagatgatcgagctaccaaaatagtagcctttagaaaaagtgcattatgagtgcttggtatgtggaagaaaactccaattccagcatggccatccacccaggctgcatcaacataacacctattacccctcggaatatctggtattcttatgtgagtagtaacttcgtcatgttcgtcttgattttcctgctgagatgagaatttggcataagtcttccccattgcttcagctgcaaaacaaacatcagtaggttctctatgtttattctgaaattttaagttattcctagattttcataattgccacaaaaatagatatattagcctcagaaattctccaagttagtttactgaaaggacaagcaaaaagaagatgataatcagactccagctgcccacatcggccaaagttgagcgaaatatctctcattctgcaatttagcctctgggaggaagagcctctctgagtaatctccaagcaaaagtcttcactcttggaggaatcagtttatttttccaaatttgattcatgaggggaagggtttgggtgtttacctgttgaacattttgattatcccttttaattacctgcgacatttcactatcattttttttaagaaatgaaaattacccgtgacatagtagatgctatgatacgaaggaggtaatgcatcttcttactgccaatgtgaccgcctatatcttggcagttccagctcagcatcgttacggcgctcgtggcgccttaagagctaacaccgatggcccatgaataacgcaatcatcttcctccatccctttctccccacctccagcaacagatagagcttgatggacaatttgcaaaacttccctccggtccaaccccattcccaccaaaaccagaagcaccatcctccactcttccgaaggcagtaaatgcagaagcagagctagaatcctgacaccaacacccatcaaccataccgagaacttgagggggtgtttagatcccaccacaaaaattttcaccctgtcacattgaatgtttgagcacctacatgaagtattaaatataggctaacaaaataactaattgcatatattgcgactaatttacgagacgaatcttttaactctaattgctccatgatttgacaatgtggtgctacagtaaacatttgctaatgatggattaattaggcttaataaatttatctcgcggtttactgacggattctgtaattagtttttttattaatgcccaaacaccctatacaacaccctataaaatatccgatgtgacacgctaaaactttacgcccctttatctaaacaccccctaaatgggattttagactcatgtgatgggatgattctcctatgcagtattctcctcttacggggttcaccgacatgtgggctcgttggttgtggggcccacatgctagcccctcaaagtcagagagcaatattgcaaaggatttgtttcccttcactactacagaaatgcatttcagtgccggttgggagaccccctttgatgtcggttatcccaactggcactatgttagcggcactgattagggagccggcaccaatcccattttgaaaactggcacctttgagacctctgcgaacccaaaaaaaaaaaaggctcgatgcatcggctcgaatcgagccgatgttccccgtcacccctagacccgtcaccccgagaccatcaatccaaaacaaaatcacaagaagtttcacattgtcaccatcgatgcatccaagcatatccctcaaagcaaatcacaaaagtttcacgcaaatcacagatgaaagaatcacaaatcaattcatccaacacatatctctcaaagcaaatcacataagtttcacacaaatcacagataaaagaatcacaaatcacatatccctcaacaatttcatagaaacaatcaccattgccgctacgtcgccggatccattgcgggagccgccgctccgcccgccgatgccgacgctggatgcagcttcgcccgccgtcaccaccccggccactgccgaggccagatccatcatggggccaccaccgcttcgcccgccgatgccgaccctggccgccgacaccgccaccattgctttgcccgccgtcgccaccctggccaccgccgaggccggatccgtcgtggggccgccactgctccgcctgccgtcgccaccccggccgcctcacccactgccgcatccgccgagggagaagccaccgacgacgatgccgtatgcagggagaaggaggagggggcaagagagagaaaaactgagaaagagagatcgagaagccactagtgacgcccttatccttatctcgtcctggtggggcccgccggctcggctcgatttgggtatcggttttttaaaaaaaccgacacctataatattttataggtgtcgatttaaaaaaaaggcacaaaatataataggtgtcggtttttatttggaaccgacacctataattgcttaaaggtgtccattttttacgatttcaacccgcggaggtgggaaaaggcctataggtgccagttttagcactaccggcacctatagtggcgacacctatttgatgttttatgttttgtagtagtgcttgtgatgaaatatatcatgtcaacttggtaatgcacactagccatgtgcatgacaaatgggctatgcaatatttttcttctttacgagtataccttttacactgccttcatcgtgtttctcaatttcttctccctaagcaacgcaatttcttctccctaagcaacatctcgtttgggaaatgcaacactaaaaaggcagaaaggtgcatcttatctttcttcttgatccacccccaagaggccaaaacaacaagatgccttgagcccttattgacatgcatgatgcatctagcttagagggaaagaaaacataatatgttcataaccagaacagagtctgcagttctggagcaagagcaatttgttgatcatcaccagcagacatagatgtgtcgtcagccatgtgaaacaagcaactggagcaagagcaatttgttgatcatcaccagcagcacctgaagggtgagaattcaccaggattcaaggataattatttcagcatcatgtttgtggctaacattttataatataggatgcaaacttttctgccccattgatatcagccaaaaatcggacacagatcatgagtgttatagcatcagaatgctgcttgtgaatgccattttttcaatggttgtggttgtcaagttgtcaaccatgactgcttccaagttatcaccaagcaaacataaagaaaatatgcataaactaggtaattgctactcaagatatctacagtttcccggtaaaaagataaagtaaacatattaccatatcgtagaaagggtataaggtcccattctgtgaggtgcaaaaggcctttttgtgtgcgttttgattaagtttagctactagtgctcaaagcctcaacaacaaaataagttgctacaacataaagacatttccaaaagtagcaggacccataactgaatgaggcagccacgttatgcaaatttgcaatgtcgagcattactatagtttagatacccacttcactgttatctcctttcaagagatggtgatgatttctataaaaattctgcaagagggactgcaatttaaagaatggtacatttgaaactacagttagcaatcattaaatttctgaaatgatttactacgtttaaagtttaaactggtggacacgaaacattgtgttgaggccaaaacaataaaacaagaataaggcggagaaaacataagtcgaggttaaaaggaacataaacggatgaaacacatcaaaactgatcaatgtgatatcattcggattctagaatcaatgaagccagacatctgactagggttaacattctatcagcactaagaaatctgaagaacagcaataatgcatgcctatgacaagtgagagatacaacttacaggtgataccttaacttaacagaaaagaaatggaaagtgccatgatatggtcccaagcaagtcagagatcatgcgcgttatgagacaattatggtgctgataggttgaagatgtttgagggtagaacataatagtatcactgattgactgtcccactgatgttcatactgcctttttatattaaattggtgcatacttagagttgtttccatcacttggtacatcaacagaattgcttgctttgtgactgaatgatggcagcagttatatgaatgatgcttgaactccattatgcatgatagtatcagtgacacattaacaacttggaaagaaaagaataaatgcccttcaaggacaataaacaatggtgtaacattaaacagtaaaaggttacctgagtgacaatattttctctaggaagcatgttcgataacaagcattaacaggaagcaagatggagagaattacagatgaggagaagaactagcacaccgataacaaacctaattctcaaccaatcagaacccagatgtgaactcgatggatagtaagaacagaaacagcaacttattcacatgccaattgcacaactatgacagtaaatggctgtgctattagctatttaatttatatgaatttatataacatagttatattcatgtgccaatatcaaccttagcagatggaggagacatgatgtcagtttttactacttttttaatctatgatcacacactctactcttaagttctttctgcttattctctatgaattaaatccttgaaatcaggccaaaacacttgcccagaagtggggacaatacttttctttaatggtaattgatactccctccatccacaaaagttacacctattacttttgtcaccaagactaagaagatattaaatcatcttgcatgttacaaaatcaaggagtgaatgcaagcatgcaaccaatgagtatttagatgactccttggattctaatcaaacatttaatttatctttcatttcagtcttggatgcataaagactacaaatatgaacaacttgtttggaaaaactcaaatgtgaaatatgcctaacttttgtggatggaaggagtatcaattataattgtgaagtgaaatgtggtgcattagaaaaggaagagaatttccagtttctggggaaaatcaccgaatatgtggttttggagctaaaactatcaggtactccagtcaattcacttaattgtattggtatgattatagaacttcatcactgaaagttatctaacatacttcctactgacaaatctcacagaatttgatctacctaagattcttcaggctcaaagaatactttcagagaggaggccagaacactatcacagtatagcagctatgagccatgagagcagcccaaccactggacattgttccaaatgttttgcaagatgcttctgcattgagcttgtaggggagcaacaataagcaaatattttgcaaccaaatttgaaactgcaactagtttatggttaatctatcgcgaagactgatctttggttgttgctatacaaaagtaactacgtataagactccttgttttttttcaacgacattgcttggcttgtaatcaaatcttgccatccacaacaagtctccaagaagttgaccatgctagaactactgcaaactcgagattcccaaaaacattacgttgtttgaaattctgcaaggtttaagagtcctcagaaggactttatccttcaaataaaatgctcatcagataattgtcacattggagcctaaaggcgagatttgcagttgaatttatggagcaggttcgacactccattagaactatagttaactaacccaaattctcaaatgttgtttttattttatcatctgatttctattcaatttctgaaacaactgtaagctggacttattaactattctttttggagtttgtagtctcagtgttcttaacttgtaccttgtaccagttcaatgctttgcatcagagataaatctatcttttagagggtcattttccagctaaagaaatcgaactatttcagacattctgggacactgagagtcatgaaacaaatagaatcaagtactattcaagccaaaacactctcatggttgcgtaacagctaacattaaataattgacaaccataacaatcaacataattgccacaaaattgtgaaaaggcatgagtttcaaccttgaccaaggatccagcaaccttgcaatacacattttattatttgtacaagcatatcaaggtcaaaccagcaacattctgtagaacaaagcatggtagtactaaaacacaaggaatggggacatggaggcaccttggcaaacaacctcatcatcacaacacatgggccatggcagcctcacttggcggttgctgctccaagctccgcatcgatggctctgcgcgcggcgtcgaggtcctcgtcgaggaagatgtcccaatggccgtcccagcggatgaagaactcggtgtcctcgaagtacttgacgcggtgcacgtcgccggccggcgtgaagaggaagtcgccgtcgaccaggtcgtagctctccttcttggtgaggttccagaccttcttcttgccgctgatcaccaccaggtcgtgcccgaacgtgtggtggtgcgccggctccacgctcccggccttgaaccggacgtacgccgacgtggggctctcccgcacgatccgcatctcgccgccgggcatgatccccaccggctcgaactccatccccttcctcaggcagcagatggcgcaggcggagtcagggacggaggcggaggagatgtcggggatggcgcccatctcggcgggcgcggagtcgaagaagcgctggatgtcgtcgggccagggggcgtcgccggagcccgggcacggggcgcggaacggggtggcgagccaggcgtcggcgatggcggcggcggcgtcgggcggggtggccaggccggagagcgcgaggacgttgcaagcgttgatggagcgggtgttggcggcgtcgccggcggtggcgcagtgagtggcgtagacgccggggtacttgttggcgaagatggcgacgccggcgcccgtgccgcagaccacgacgccgcgggcctcgagggcggggtcggaggaggaggtgggggtggcgatgacgctgcgggcgacggcggcggcggcggcgtagtacttgtcgacgccgaggtcgacgacgtcggcgacggaagggtgggcgcggaggtgcgcgacgacggcgtccttgagcggctggccgaaggcgtcggcgggcgcgaagatcttgaagcgccggtctgcggcggcggtggccatgggggatggggcggtggatgtctcggttgcggggggcgccgggggctggatggatctgagggcgaggcgaggggagggagcagagcagtggccacaagtacgacagcagcagtgagtgagttgagtgaagtgagagaggcgaccgcggtgaggaggacgaccacgaccagggcggcggattatacagatattttatctgttcttctttggttgcgtcgagtgacacgttggtaaaggcctaaagagccaaattaagttataaggaaataggaggatcatttgtttggaggttgtaattttgataacttaggttttactacctctgtcctaaaataagtgtagccgtggtaatccgtatctagcatttgaccgtccgttttatttaaaaaatttatgaattttttttaaaaaaaactagtcacacgtaaagtattattaatattttatcatctactaacaataaaagtactaataataataaaaattaaaataaaacttagacatgagcagtacaaaactgcacttattttgggacggatagagtatttagcatagctctgaatcttaatctataatactccctcccgtaaaaaaataaaacaatatgtccaggattaggttgtttttggatggatggagtagatttgatgtttgtatattaaattgattttattggaatgatttttacatgattgtagttctaaatctagggatccgatgttcggatgacgagaagaaatttgggattacacctttagatatggatttaactctaataccacttgcaaatgacatataaaatggcacctcatctccactataatgtcatttcttgcctttgtataaaataagaatgaatttgctttttcttttttatcatgagaatgaaacacctttggttgagttgattcaacaggtcaggtcttctcactcttacaatatccgtcactaaccaatggcatcaaccatcgtgctccacctccacccactcaaaatccattgtcaccatcctcccggggaaacctagcttgatcctacatattctctagactacctccttgatattctttatttgtcgtctaacagctgtcaaatactataacttttgataaggggggtgtgtcgctgatgcttgcgctcggaactcacataacaatacatagtcttagccaaaacaaaacagccaaatacttgggtgctaattataccactcgagccattggtttcggcaacaattttcatttcccacttcctattcttagctatcacaataaacaaatagtgtatatatggcagccgtatagctagggatgtttctattgtaccttgatactcatactactttatattttcatagttgaaatcaattttgattattagctgagacttatttgacttgggctcaatccattgcaagaaattacagtgatctccactttccctttgccgttgtgacttgttagcatagagttggcctaaatatatatcgtattatcatgacaccaaatcatcatccatccaacttatgagaggaaagagtatagggcctattcggctgccagcgcttgtgttgtgcggctgcaactagctgccgtgtagctaaagaaaatacaagccgaatatattgatcatctttttggtgaagactggacttaaaaacttttgacttgtgattattatttattattgtatttaaaattacaaagctctagaacattgtagaactaatacgttctctaatgtaacctgaacggaatcattggcttaagaaaatgacgatgccagttgacgcttgagcccaaagtgagctctcttccacagcacaaaagtgcacacctcagacgagactggtggtggggtcaggtgggttactcgtcgccttcagcccctggcatgtggatccgtacgtgagggtgggccccacacgtcagcgaggcagacaaaagacaagggacgaagtcaacgaatcccatttctcgagtcgttggccggcttcttggcacgccgccctggcccgttcacaggcacagcccatacgatttcccttctgaatccgactgatcgcctcctcccgcaccgacgtgttcgattcgtcttcccgcggcggcggcggcggcggcggcggcgaggaagatgggggtggaggtgccnnncgangagtccaaccggtgcgtgcgcgggtgcttgccgaacgcccgcatcccgctccacctcccgccctcctccttctccctcctctcccccatcgccaaaggtaactaaatcctctctctctctctctacgctctactagttctgacgaggaaaatggaatgtgccgcgcgcagggtcggagagcacggtgtacgaggcgcggctgggcggcgagcgcgtcgcggccaagaagcccgtgctgtccacctccgacgacctcgacaagttccactaccagctgcagctgctctggtgggtactccccatgtttgttccgttgcctgtcgagtttctctcactgttgtcgtttgggttgctgatgctcgagatggaagttagcgctcataaccgatggaatagctagcattttatagcttggcagagacttgtgatcataaatttatcggtgagtcaggatgaccacctgaccagtgcttgtgttccattattgcttgatcgttaggcggtaatcttttggtgcaaacagagtgttaattacgaacccttatgcaatagtatatggtagctttaagctgttgcaaatattgattgatttcatgatgaaaagcagggagtttagtttcttggatacttgctgacacttgtaattatgacatgtaacgcttgtaaaacttgcaaactatcatttcagctttcaactcttggcttgaaaatggttgtttatatcctgaataagtgaaaacatacttcttcaagaattgctcttgacaggttcattaaataaaatgggtctatgtctgtgcagtgaactggatcacccagggttggcgagactggtcgcagcacatgcacgtcctccgaattacttgatgttctttgatttctttgaacctccaaaccttgcggacaagatacatgttgaggagtggaacccttctgtgcagcaagtggtcaccattgccactgatctaggtcccaatttattgcaatcaagtttccttttactctttgagagattgaatcgtgtcatgtgtatgtttcttttctatattagaataagacataaaacatggctgccttcaaaccgggaatgctgtgttttaggacccatcttgatatgtttgattcaatcgtgagttggcagttccccacttgtttcaagcaattaagcaactttttaactcctgtatcacttctgagcttgacgcgatgatttcttgtcatcgtatcatacgtattctggactctattaacatgtgagttctggcctacatgaacattttctatttctcaatataactttaatattatctactgcgtttagtgacttcttttagaaactagtgagggtgtaacttggttatgttcttttgtgctagcaattttaagtaaggtaattaagatcaggatcctacgcagaattgctttcatatgctctagatcactattttatatggctaggatcaggattgcaatggtcatgtagtattttcaatgcagatatattctgaaaacccttgttcttgatcttagagtaaataatggcacgataaatgtttccgacacatttgcagcatttctgttgaaaataccgaatttttccctatcatttttgtcctttcacatgtagcgatttttgaacgatttttcatttcctttttattaatataccactgtatttctctgctaaccttttgtggtacggtgcttattatgtaaccgaatgcacaaatgtaaaattaattcatggatagctaatttcccccctgaatgttaggtgaaataaaaacaaaaatattcctcctgaaatatagataagaggatgatagtaagatcttcttaaagtccatgaaccaagtatgaacaattagttcttactaattcagaatgagaaatatgtcattgtgtttagtttgttattctaattcgaagtttcttgctggctctaacttgaattgaacatctgttgttgataaagcgcaaattaacatttattttcaatgtatattgcagcaaaggctctccaatacctaaacatccttggcatagtacacagagatataaagcctgcaaacattttggtaattttgtcttctatattgaatgatttaagttctacacataatgcatttctacatacattaacaaagtctaataattgtgtacagatagataaggacttccatccacatttagcagattttggcttagccatgtaccagaaggacatcaagcatgtttcagttgaaaactggagatcatctggcaagcctactggtggtttccataaaaagaacatggttgggacattaatatacatggcaccagaaattttgagaaaggacatacatacagagaaatcagatgtatatagctttgcaatatctatcaagtaagccatttctctcttggtattaactgcagtttggcctcatatacttcaaatgtgtactccattgcctgagaaaatacgtttgtgttttcttggtggtatgcatgacatattgcctctgtttctgttaagtaccatataaccagtccacgcacatatgtagatggttgcttggaggtaaattgccttttctgtgttggaggatttggtgtttcccatatagacttgcattacatatacacttctgctaggtgatgtattctatttttttttgtgcggggagatatattccatgttgaacaaatgttggacatggaaacctacacgaatgttctctcatatctgtaactaagggccatgatcacaaaatgtgatattcctatcattttgttctctgttgttgaatactagttcatataaatcacgttttattttggttgtgtggcttgcagtgatattagcactgtattaagataagcaaccaatcaaccaatttttattgtgttatgatcatgtcttgttaagtcctgcaagaaaatatatacaagtttaacttttaaattttaataaatgctttgacatggtgactgattgactatatctagctgcatatctagtcgtgcaacctggttttggtgacaacacagtatactcatctgcatacacatgctgcttctgttgaactgtgaacattacggatttcacttccactgataataacatgactttaaaagggacgagggacacatttggctaaattatactaattgtatactttggccagctgatgtgaaatgctcatttgaaacaaagctgcatggttccaaatgttacttgcacactctgtcccactctttctcaggctttttcttaccctgtgtacataaaataaattcaaaacaaatgaaaatactcaactagcttaggttttcatgtattaacagtttcatttttttttcatcaatttacagtgagctacttacgggtgtggtgccttatacagacctacgagcagaagcacaggtacgtattttttgttctttatctttgtctctttcacattttcactccaacagcacaggttgttgtgtatggtttctaaattatataacatcattttgttaaaaattctaattggacatgcatctagccatccccacacttgaataccatttatttcatgctgccctaatggaaaaggtacattaagtgctttgacattctaccccatttagaaatttgggttgtttgctataatctttagttcctgttgactatttctgttatatccaaatacttgaaattatagcatcatttatcttcatatatgattggttgtacaatcatgcatgtgcgcctctagccctgtattagctttaattacgtatataatgccattgctgaagcaaacatgtgagatacactattttctacaattgggaactcattgatttttctctaggcacacaccgttcttgaaatgacttacaccgaacaacaacttacagcagcaattgtttctcaaggattgcgcccagctcttgcccttcctgagtctggtgctccacctagcctcttgtcacttatccagcgatgctgggactctgatcctcaacagagaccatcatttaaagatataactgaagagttaaaaataattgaaaagcatatagctgtaaattcttgctcactagcatctcctgcaaacaagagtcaaaatggcaacacagaagttcaccactatcaagaagcattgagctggtgaaccaaggggagttgtttgcaaaaggaaacaaattggacagtacagttgaccattggtctgatattttcgatcagtcctctaagtactgtccaacattaagttggggatcttttgcaacatgtggtcgaagagaaacaatggaagatacccattttatgcttccccacatgagcgaagaaaaggatctgcatgcatttggcatttttgatggtcacagaggtctacaactcaacaattgacaatgttctttactaacttttgcattaccatatcttacaccacaatttctacaggttcagcagctgctgagttctcagttcgagcagtccctggttttctcaaacagtttaattccaatacaaggtatggaatgaatgcaaacaatctgatgacatttttcatgcctgaagtctcaatctgacttctgttttctcgtagcccaactgatgcccttacagaagcatttgtaaggactgacatagcatttcgagaggaattaattcttcaccagaagtcaaaaaggataacccagaaaaattggcatcctggttgcacggcagtgacagcactgatagtgagaaacaagctttttgtagcgaatgctggtgattgccgggcaattctgaaccgtgctggtgaaccatttcctatgaccagggtccgcataatatttcttctttattttgcacgcttcttgaaatttaagcattataacataagatatgttttcattctgccttggtaggatcatgttgctagttgtccaaaggaaagagaacggattgtaaaggaaggaactgaagtcaaatggcaaatagatacatggcgtgttggtgcagctgctcttcaggtgctagcttttgctctttatggcatgtgctcgcatgagtatcattcactatggtagccatgattagctgtagatgcatgatataatcattaattttgataacaatagaaaaaaaaaatgctcacataacattatacgccctctatccatgagttttttttcagttggttttagaactgttgaagtgatattatgctgtttctgcaaatggggttgtcagctacgtaaacagcaagcaatattcctttctgtactatgaataatacaatacggaaatgcctattggaactcagccaaggtatatgctagcacacagtgtccaaagaagggcatggatttcaagcttaccttgctgaggtccaaccacagatacatacgctactctgcccaagattctacttgggttaattggtttgggaatattatt

SEQ ID NO: 72497 - DNA, 1863 bp, Oryza sativa
  unsure (1)..(1863): unsure at all n locations
actatgaaatataaaaatgctgggaaatataaaggcactttcttcaaaatagacatgcttttgtttaacaaatggcacttgtggtctacttggttttaaagtgcacatctcaagctgtcttttttctccatatgcagatgattgttctgattcaattgatgccgttagagaagaggcctcagttttagttagggaagaggtggaacagagactactatccattgttcgagattcccttgcatctgcattctctgtcaaaggggtatgttatattacagccctagcgctaattttatgaaaatgtggccattgcatgtcaatgtaccaaattatcattcttgtattattcagtcacgacaacttttatggttcactgtccatctttaaatttcaattcctgcttcctagttggctgtattgcctccacatgtgtatgcccttcctaaagaagtaacttgatatgatgattgattcaacttcagtactctgtcttaatttctaatatattaggaaatgaatgtcgtctacagcctgagattctaggtggtacattgcgatatgtatatgctttattttacatgatgaaatgaatttttgaagggagttgactaaagtaatcacttgattagaaagaaatagatattctgcagaagaacataatcttgtaggaaaggaataaaacaattaatgaaggaattgttatacacaagcgaaatctcattttatttttctctgctctattagagaatggactaattttgcttctctactgaacccctgataggtaaagcttagaccagctcaaaacggtcccaaaacaacaaaaactttttataaaataagcataatcattgctagctactaaagaaaagcgggctatgcctaggttaaatgggtcctaaggatatataatgaaaaactaggttgggatggttactgaggaaagcccatgtgcttgccttaagtctgctgattttattcgtaatagaacatagatgacaaataagtatgttgtactcagtcaagcttttgaaccttccatttgctgcaaaacaaatttatgttcatggtaattctgtagggcagagcaaaactagtgtgtcattttccctagaatcaacttgaactgcactgcgcatattttagcatcttgttaaatattgatttacaagatgaatgcatttcctgtaaactgtagcagttcattgatagtattaaccgtgccctagctacctgcttgtntcaaatatgtttatgagcaataaatctgcttgaaggtcataatgttgagtacacagacaagtacatgcaattgccttatactctttttggcgttgccgttgtggttttgtgtcctctgcacacactgatatactcatcattttgcagggagctgaattgacgatttcttggctggaagaaacactgattgaaattaacctgatttttgacatcttgtttctttttttctatgataacctttcaaggtgtaatggtggactgtggataatgttgcgttccatttttaaggtacatccttttggtgtctattcattctgtgggaatctgagatctcttcacttgatatttcaatatttatttcttgagcacttatccttttaggacatgctatctggttcttatgatgttggaaaatttgctgtatctgttgaagcaaaaaattcgtttcattatgctaaagctcagctgctgtttattctcattcaaaccttggactttgaaagtctactccggatggttcgtgatgaagttccttttaggtatttatgactaacttggctttttcatttatgtatgggagcatgccatattagtatcttattaatatgtcagtgtaacttc

SEQ ID NO: 72498 - DNA, 2131 bp, Oryza sativa
tttgtttgtagatggccggcagcatcactgtcacgaccggaaataacccaacgggcgttcctgacgtgcgtgcattaatccttgtcccaggaggtaaggtacaccaaaagttgatacaattcagagttcaacaagcggaagcgtaaatagttaacttattacatgggcagcgaaggcccagcacacacaaagacaaacgagaaacagcgaaagactagggcgacgaccacaggcgcttgacggcaggcacgagctagacaccaaagccttcatctccaaggaactcctcttctggggttgggaaaaattgagcaagactgagtacaaccaccgtactcaacaagacaaacccgcaagtgcagaataaatgcaagggagtacaagggaattatactataaagggttagggttgcagtaaacagcatttaaagacatttagttgctcaaagctatttggtaaacatgattctagagctataccatattattaaacaaggccgtgaacccacacgaacctgccttaacccaaggcctatgatgattcagaccgaactggcaacccgacccagggtcccagctcgtcccaagccaacccaggccaaccattccaccttttagttgttaagaaggttttaagaattaaaacactaacttggatacattgctcggcttgcccataaccgagggcgcggctattcgaatagattatactctgatcagaggtgtacatgtttacccacaagacacatcttcctcacgtgcaaccacgtgccacataccaccacggtatacaaacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccgcagctcgtgtagccttcatttgccctggagatgtccatcgacccccgacttcttccatctccatccgtgtacttttgtttataaccagactgactcacaaactaagccttacccactagacatgtggaagtacggtagtgctttgcaacagaggcccgaagaccggtccttatatggccgaggtgctactatcaaaaccatgcaccccgagcccagcccaaaaccattttggggattttgaatagaaggagcggtgtgaatccaattccacaatatccagaccattccaaggtatccaggtgatatgaatatttcccaaagtctaaagttgaaaaaccacctaatgttacctaattaagttgcgaagcatctacctaaaattaaactagtggtgccatgagtaggggtccactagttgaggttttgtttattctagggtgaacaaggtaataataacaataacaataataataaggtcgtaacaaaggtaaataggcatggctaaataaaacagtgttaacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaaggcttttactctaaagaactccatataacagtagaaacaaagcacaaaaatgggttcttgacttcttaaggaaaaattagagacttgaacggtccaattccgagttcaaatggacaagttatggccatttgaagtttatatgctctttaaatggatatttgggaaaagtttatatgcccttttagccatgccttgtttataagggggtgattatgatccaggaaggtgcgctgcagtggattgtgttgtataaggggtattgtcacaactcctttccgagataccgtggttgtattgaggcacatggtgacatgatgtggggttgtgtcttgtgggtacagtggtacacctctgatcagagtaaaactattcgaatagccgtgcccgcggttatgagcgggtctaacaatgtctttcgtgattagtttcacacttgtcaccatagtaaatgatgctataattggtaataatttgat

SEQ ID NO: 72499 - DNA, 5224 bp, Oryza sativa
aactacagtgtaacttgtatgtaagtttcacgtaattgtgaatcgttagatctgttacaagatttgttctagtgaggaagaaaaaaatcacagcacacacatatgtgaaaggatttgttcccacgacctctattttactgaaataacatgttatcgagagattcttcgaagttacattataggtacagtgtaattacactacgattgtactgtaattacatgcaagttacactacaattgtactgtaattacatctgacaaatattagggggagaaatttgatgataaatatctagcaaaatcgtttagctattggttagcgcaatacgacactaaaaaaaactggagaaaaaaacagaatttacacatagctagaacaaaacgataaagaaaacgttacagtactacttttaacttaacgagatacacgattggtggggattttgatcgtctatcattttcacccgagcaatctacatgtactactaggtaccaacaaaccagtctaccagcatgcatgcatgctcctagtgtacgaagtacgtggaccgtggacgtactgctcctgcctctagtagtcatgcagaatacagtgtaaatcgtacagtgatcttggccactgggattggctggcgtggatccatcccggctggatgaccagccagctcgatcggtcagcagcacactatacggtgggcacgcccgtgtcacgcattcctgcgtctgcgtgcgtggcagccagccaggttcgctcatctcctactacggccctgttcgaatctccaactaaagctggataaatttttagataaaagtaatacttttcaaactgctaaacggtgcgtttcgtgtaaaaactttttacatgaaagttgttctaaaatattagattaaaccattttttaagtttataataattacaacttaattaatcacacattattatcatctcgttttatataaaaacacttaatttacatcttaatcctcatgttcggcaggttctagcgctcgctcgatcgatcgatcgatctctcggcgcaatggatggatggatggggacgcgggcggaggaggaggacgggtgtgcgtggctgggttggcgggcggtggagttggggaaaaaggacggatgcgggtgtggggtcttggtcggtggcggcttttccacgggacgggccccgcctccgcgaaatattgcgctgtcaccgtcgccccccgccttgcattgcttctcctactctcgaatcgaatcgaatgcgttgctcgctcgctcgcttctctgcagtgcagtgcagtgcagcgcgtcggctgctggccccagctcgggctgcccgctgctcgccgcgcggggcacacgcgcaccgcgacctgtcggccgacgcagccacggtgcgtgcatacgtgcagtgcatctcgtcggatcggcgcatgcatccgtggtttggtttgtcatcagcgcgctgccgccctgtagctcgtgaaaagcagtaaattggaatctgaattctctgcggctgggatttctgaccgggtgggttgatcaattatcggcaaccatgaagcgactaaacttggaaaataattaacctgtcaacaccccgtcaactgatatgagtctactttgatacttcggccgccgtatgtagcccatagtaaattactagaggatgttagtttcaaattagaatcttattttttttttggcttggtttgtttactgagagcgcggtttctccatacgagcccgaacaattggactgatatataattgtgttttttatcctgtgattgccatcgcctattgtgaatgctgcttattcgtgtgaacgtaacgatgtcgttatgcgagagacacgcatcacgctctcccttgtatgacgctcggcccgcgaaacaaggtggtgcgtgagcgtgcgcgtgcggctgatattttttatttaagttcttatgacttaattcattacatactgaaggctcttcaaacatacttcctccgttttacaatctaagtcattccagtatttttagattcattaacatcaatataaatatgaaaaatactaaaataatttacattgtgtaacggatgaagcaacttactctctccgtccaaaaaaagacaaactctggtttccgtgcccaacgtttgaccgtccgtcttatttgaaaaaattataaaaaaaattaaaaagacaagtcacgcataaaatattaatcatgttttatcatttaacaagaataaaaatacgaattataaaaaaattttatataagacggacagtcaaagttgaacatggaaacccagggtttgccttttcttgggacggagggagtatatcttttatattttttgaaaaataaatataataaatggttaaacatttataaaaaatttaacaacgatatatacaatatatttaaaatagaaagataaatatatatatttagaatagaaagatagtacttgtgtcaatacagaacatagacggcacgcactagctttcggtggatatagagtacgcacaacgtgctctgcctggctgccttgtctgtcgtttgccgatgcctgaccaccataccatgcccgcgcgtgcgccttgactcgagcgccgtggagccttccaattctactggccacgaatgcacatagtccgatcccaattacatcagttaggattagcacatgtcatgcacacaccaacccaacaatgttcagaacttgctcgatcatctagcttttattcctcgatcgctagctaaaagttcacaagttgctgggaacggaattgtattctagtagcttcgagcattgctgacccccgagaagtcagtcagagcttaatcatagatcatcagctagcaattagtaatatgctcctacgggagattgaacagcgttttttttggtagcacctgtcactcttacacacaatatactccaataattaacacttgggtgttgcttcagaaaccatcaacatttttaaaatccggtgtcctaccgaccaatgttaccggcgacggcgacgcccagctgatggatcgatcggaatcgcggccgcatgctagctacagtagctaccagctcgatcgatcagctgtaatatattctgaattaataattatcatatgaacaactcgcaagcttctgcatctgcatgcgtctagttaaacattttaagctgaaccctggtctattgttcgtggacacacgcatcctacctctctcgaccaagcacgcctcttcgcccatcatctcaatttaattagcgctacaatacattactatagtacacaggatctcgcatgtatatgattagttggatcaggtcattttggtcaaacgataaggacgagtgtgctggtcgatgtccatcatcagcagataatcacattagtatgagcgtacgacggtctataatatcatatagtaaattatgtcatgcttgctaagattgatgtgaatgaaaaatgtcatatactgatgtaggtaagttggactttccagcgagatcctgatggagaaggaagctaaaataggcaccgtctgattaggacgataacgaccagagggcaactcgtcatgcatcttggttgaatctctgggttgaatggcctcatgggcaattgggctttatttgttgtgggtaattagcccaggtttttgtggcctgcatgaggaagtgatggggcccatagcaatgggcctcctggaaatgaaacgtattgggcttaattagaagatttgcttcattttgttcattttgtctctcaggtgttcattttgttcgccgagagacagcttctggatcgaatagccttatcatttttgcttatgcttatatttgtaagctaaaatttaaatttaaatttttaatttgatatgattttatgatttttcatcgtatttttattttatggcgtttgcttttaaattgctatagacacatgtataaatttttacttataatatatactatttggttgttaataaactatgcggataagcataaccaaaaagacaatgcactattccgcacaaccgcatcaagtacttgctaggccttgcatgattgagttggtcgcagctgcagcgcaacacaaatgcaacagcgataaccatcagcaaaaactctcttgtgtttgcagttgtgaccaagtaagctgagcatgcccttaacttcacctagaaaaaagtatacttggcttaactgctagtaagacatttcagaactgagactggtgtacgcatttcatgcaagccattaccactttacctgacattttggacagagattagaaatagtttcgtactacctgcaagttgcaacttgaaaagtgaaatttgttccttgctaatatattgacgtgtaattcttttatgcgttagcgtaaaaagttgaaatttgggtcaagttactggtcagattaaccagtaactggttaaagttgaaagatggtcttttagtaatggagggagtactacactatcctcagctgatttaaatcttattccgtcggtggtgatttcgtcaatctcccaacttagtttttcaatatatttataggatagagtgtgcatatgtgtgtttatagggatgagtctacgcgccttatgaacacctacttttgtactgtatttgtcaatgaaaagaaaatcttaccaatgctgcgatgctgacaccaagaagaggcgatgaaaagtgcaacggatatcgtgccacgtcggttgccaagtcagcacagacccaatgggcctttcctacgtgtctcggccacagccagtcgtttaccgcacgttcacatgggcacgaactcgcgtcatcttcccacgcaaaacgacagatctgccctatctggtcccacccatcagtggcccacacctcccatgctgcattatttgcgactcccatcccgtcctccacgcccaaacaccgcacacgggtcgcgatagccacgacccaatcacacaacgccacgtcaccatatgttacgggcagccatgcgcagaagatcccgcgacgtcgctgtcccccgtgtcggttacgaaaaaatatcccaccacgtgtcgctttcacaggacaatatctcgaaggaaaaaaatcgtagcggaaaatccgaggcacgagctgcgattggctgggaggcgtccagcgtggtggggggcccacccccttatccttagcccgtggcgctcctcgctcctcgggtccgtgtataa

SEQ ID NO: 72500 - DNA, 40169 bp, Oryza sativa
  unsure (1)..(40169): unsure at all n locations
ccgcgtgggnnnnnnnnnnnnnnnnnnnnnnnnnnnnnnnncataaaaatgtgatttcttactgcagattctagctattcacgatctcctagcaggaagaggtacatatttcatttcatcatatgagcatgatcttttgaagttaaattctaaatatgctgtgagtgcatgttaaagccctgatcaaagttcaatttatggtgtctttgcttatctttatcatcgatttattagtatattgccttgtcgtgtttctattggtcttgcattttagtttttcatcattgttaatcaccatttgatatgcttgagttaagatccacacaagctacaattttagttctgtagttttatattaatggtgctgtaaactatcatcaacatatttgttccattataatgctaaaattatcttgctcagaatggtaaggttttgtattcttcctgcagattgtacctggtgatacttactatctatcactcaaattatttgttttgttttcatagtcataagcatgttttcctaaaggtcatgcaagcacttgtataagctgtattttgcgatcaaagtagaacttgatatttgaacactggcatttccgttggaattgtggttgggtttactagatttattctagatgccttgaacatgttgagtcgtgctgaactggtaatttacttttccacaatctatcctttatttccagtgagaggaggcatgaaaagaagactgacgatggagaaaccaactcatctaggagtttaagtctctctgataacaacgatgaaaagaaaaaggacaaattctcaagtggtgatgagaaagaagaccacgaaaagcaggtatgagaaaaatgtaatcaaattcatggcttatacaagcacatttggcacaatcttcattgcataattatgaatattgtgcagctgaaacaaatacggctggatatggaggctttgcgtgacgataaaactcagatggaggtcagtttctatttgtctcgctatatttgttacaatatggcacatgctaccatgttaacattttgactgccactttttattcactcataaaaaggagttggtggttgtgatgataggttccaccatcccatgccattttaaaagatcttttgtggatgaatctaccttagtgtgtgtgtgtgaattgtaggatcttttgtaaaggattacatcttctgcacatgtagacatgcataagatgatcgattgacgcaagtcatatattctattttaaatttgttactaatttgtcatatgtagacatgtatttttataaaaaagttcaaaactaatggcttatttatctgtggtatgctgcaatgaatgagcttatgagcactatgctagtaatgtgtaaattgagaaatggtaatgcatggatttcatcaagtgttcaaagcgtaggtgacttttcactagtccagtactgctgtgccaactatcaactaatagtgtttgcatgtagaacttagtatgtgggtattgtttatcatctttaatttcagacatattctccattctgttcatgtttggcacagagattgcacatcttccaatcatttaatagtagtcatgcttgacgaattggttggcagtgcgtctttccatgaataaccccaagagtaccctctagtcttgtgtccactttggaccttcattgacttattgtacttgagtttatttatttttgtcttcctgtcatgttatattttccgactgagctttggagcgggtcagcactcagcaggcacattattatatggtgcttgcgctcttgtttcaaatgctttctattttatggctgtgctaatatttcaaattttcaatggtgctgcaagaatttgatttcacattgtttttagcatctcgtgaacacagtacttgctaactactactttagaaaagactcctgcttttttttttgtttcatggaatgatattacaaaacatcctacttggccatgtctctcttttagacttttagaaaaagtcaagctcttagaaatgttacataaataaatgtacactaatttataaatggttccttataatttgaaaaaagtttgcattaaagacaccatttaataatattcctacttcatcactgttatgagcatgggccaggccgatgcagcagtttaggcacgataaattaggaataagtcatataatggtaggagattatctagttaggaaagagatgaagtttattatctagttgggattgatttctatgatactatagactatccttggatgtcaagcctgtcctccctatatataaagggaccccatgtactctatcattaatcaatcaatgaatctctaaagttagccctaatcctcagagcctcttttagctgagcagggagaagccttgccgctgctattagtgagcgagtgccctatcactgggtcttcggacccttaccctagctactccataacagtcactacccattgcttgtacttagttccattcacgtctataatgttagatcatgctgaatctttgctccaaactcttaactctagtcaacgcacttacctatttgtaggtcattttggatgagaagatagatgaagtgcgcaagatctctagcaaagttaatgatcttgaggtgcagcttagaagggagaaagatgaatgccataggtacttaagcaatgtttccacatgacaatggcacattatcttgacagtattatccaatagttctatattgtttttctatacctttgtaggatgacctcaaagatgaagaagtttattaaagctcatgctcggtttttgaaggcacaagaagaagtgaaaaggtgctttatgttttcatcatgtttggccttgtaatgctagtacacaccagattactcctttttgcataactatcaatcaataagtgttcaccaattggagttatgcaggtcacaagctcgtttcgagaggcttggtgatttgcttgcttcagatattttgaagcgtggtgctaatgaagaggggtccagtgtcaatgaagacctaaacgaaaggagtcctaatactgcagcaactaaaaagagatcaatcccatactcaacaagtgaagaagcgaaagctggtatgtagcttagtttctcgggacactctgattgccaggttgtgatttgtacaatatggatcttggtgttatgcagcatccaactttccccttctgttaaactgatatatgtacctctttatggagtaaccagtcgatcctagtatgaagtagttcaaatgttcctttatttaatattaagcattaaaattgatgtgcttagttttcttacagtagcactgaaggatgcctagtttcttttataattggattttaattctttctgcaaattgctgaagaagtgtcttaattatgtacttaaacctaattgcttgtctcctcagtgaagaagagaagagagcgagactctgatacaatgactaggtcagataaatataggtcagatgttacagattttgataaaacaagtaaggggactgaggcaaccaagtctttatatttgaagaagaaattatgggaagatgaaaaaagtaagctaggagccaacattttcacagaaaaggtgcaccatttctcccgcccgctctcaattttatgatgaactacatatcatacttagtacactcagtccagtgctttgtttaaacattatcacatattgctagcctatgcatttgattgcactgtatatatctctactagtgtaaaagcagagttgtccttccttcccctcttcccacctaccgcgtacagcgagagagtgaaaaaccgaaaggccaaacttattacttgtctaaacaaaaagcctagttgatatttggaaagttcggtcattgccagaccttgtattgaaactgataggcttccttgatcatcaggtcctaaagcccttcttggctatgttggcatctgtatttatctttgtttgattgtgcttatcacaggcaaatattttgttaacttgcaggtcaaaggttctcccgtcagacatgttttgccctccactggcatggctgctcatgctattgatgatctcaacgaagctattgaactggaggacagacatgaatccatagacgcattactagaaaatgatgctgatgacaaaactagatcacctgctattcccctgcagccaccaccagtggtacagaatgcttatgagcaggtgattaaattttcacctttccaaaaaaaaatattggacctgcttacatgcacggtcagcggcatggaactggacagtgcattttgtttataaaaaatcgttgtactaaaaaagctccttttttttccctgtgcatttgctaatttgctgaaaaagcaaactcataatttgtttcatcttttcccagtatgagggtgatgacgaggaagtcgatgtggaataagtggatggcctcgtttctagacaagaggcctctgatgaagcaatggcgagattagcatcttccccagctccttataattagtactattagcatcttggtgtacaaagtgctatctatttgacattgggaattcagcttatatttatcaagaatccttttgtagtaacatccttggcgctgagacagccttagtcaactatgtggagcagccgtataaatactccatagagtgtctggtttggctaagctaatgacgtatggtatgtgcgctccttctgccctggggattgcgacgccagatgtgtctaccttctttatcgctgcattcagttaagaagaagaaatgccaaagatgaacatttcatggtcatctggctagtcgagctgagcgtgtaaactgggtaaagcaagatatcctgaattgaattcctgatgcctttgtacagcctccccaagacccgaaaaagctagggtttgctgcttgcctggtgctgcggagcgggcatgagcgccagctttctccctcgctgttaagggtgtaataaggggttaatttgtgaacccgcttataaatcaaaatcttctcatggctggtcgtcctcgctctcctgtcgtcggcttctcctccatcgccgatgatcatcactctatcatcagctctatcgtcaattcgtctcctgtgtttcggcctggccagattaacctaagcagaaagagcagtagttttatcagttggttatattgacccaagccagaaatagcagtagttttatcggttggttttataagtcgtaacaatatgtatctcacgacttaaaaaaataatatataaaaatatcatgttggaaatatcctaaaattaactttataatttaaaatcgactcaaatatctaaattttaagtttatcatacccgggaggttatcctcgtcgagagaaaccgacccggttgattttcctgtgtctatatatatcgaccgagttgaagcctcaagaggaggaaaggatcgaccccgacccgacccgaagttccgaccccaaccagagagaggcgcgcgcgtgcgggtgcggtgcggtgcggatcggatcggattgggccgagttcccgaccccacaccacacaccccctcctctccccgtccgagagggctccggcctctcctccctcccgcgatccccttcccctccgcctctagccgccgcgccgcgcctcgccgcgcctccagccatcgccgtcgaccgcgcgcgcgcgcgagaggttcgtctccgtcctcctccatcccatctctctccccttccatggatatttccttcctcttctctcgggtttcttctcttctacttgatgagattttgtatgcatgtatgtatgtgtgtgcgtggggggattggattgattggatttggagcgcgccttagaaattcgaggggtttcctgcgctctgtttgctttgctccctagatttgccactccgatttcaaactcttcgagtaccaaccaacccttgcggtatttttgctcttcgaatgaggttatgagatctcatgagccacttagttttcagacatgcagatgcgcgcatgtcgcctccatgttgccggcgtaccatctgttttttttttcttctgttatttttttcgtttcataagattaccatgtgctagtaattactgtgagtgattttatcagagacccactaattttttatgccttaatttgttttctctcattttttgcagagcggctgtacgcgattcacatgtgcggtaatttacctgcctactgccgccaaccagaagtggaatataccctatcctaattttctttcttcggatgaaaggtctgccagtctgcgtcagctatggcacagagttcgtcccggcttcaccgcctgctcacattgctagacagtatcctttctgcaagactatggttcgctatgcttgcagttttacagatgatcacacgctatgctaggttatactctgtaccgattctctgataaactaagcaaattgcctcatgaaatgtgcaaattagctgggctaaaacgtacagtctatgcttttgcagtcgaacatatatcatttgatatcccctttggtttatctatctattgtgcaaagtttcctttaacacaactagctggttccacgcaagcgacaaggttcgctgctgcacggcaaattggagaaattgccaagtcccacccccaggagctaaatgtcttactcaaaaaggtataccaacaattccaccacctgctagttttgtggatccttctacctgaaaatgtttgcttaatataatatgtgtaagctatgatgtgtgatgtgcgaaatgcccaacttttagtttcttcaattcatgcttcgcttgcttggtagcacaaaaatgaaccctgcagttttatgttatgctgaattttcagtggtgttgaagttatagattttccttttctcggacatgcaggatatctgcattatcattatattaagaaggaaaagggtaaaagaaccctgattacaaaacacccacacaccccagctctcaggctacatgcctgtccgtgctaacaaggaccacacgcagaaaagaaaacagcgaccaaaactgcccctcttcaacctgaaactaaacacgaggctgtagacagttaagaaggatagccctctagcctcagccaaacaccaaaaccgcccctcctcttcagcaagcaggatggcactagccaagtttggagcagcactattgagggcacatcggtttcgatgcttncaaagcgtccaagcaccaagaatgactagagaattaaggccctgttgcactggaccgttgtttgcctcgttggtcctgttccaccaaaataccctgaccaaagcgctgtcggagtgagaaccaaaatttcctcgcgaagacacaactagtgagtagatagatgattatttcatcagctnggtcgcaatgagggcgttgaagttatagattaaatatcaaactttgagggatatatgattttgtgtgatgtctgttgtaagatgcaatgccctcccatgcattgattgatggatgtttgttctatgagaagtaactattactgccttcattatctattatatcaaggtagtaacatgctcatccactggagaacaagcttgttttctttttacacatgttctgcggagaatggctggctgatatttatgcttttatgttatggttttaggtttctccatatttacgtagtaagaattgggacacaagggtcgcagcagcccatgcgattggtgccatagcagagaacgtcaaacacacatcggtgaaagacttgttcgcatctgcagaagcagaaaaacatgcttctgggttgtctggaattggtgatgttgggtcaacgttgcggcatgctgatactactgcaacatctgagcttgcttttggaaggtttgttgagaattctttgaaactttcctagtgcttagtagaccttcccgctcttcttttttgcctaattggaaatggacaaactaattccgtttaacttctttttacagcttcgatataaacagggtgttggaatttggatctcctttattggcatcaggtggacaggtgtattttcttcttaccattattttgccttgtcatatttaatgaatacaattaaaatactgtggtttttttttcagggcaatgttattttcagattcaatccatttttttcttttctgatagtgtcatgcatccatctattgtttgtttttctttgccatatgtcaacttcttgagggctttctatttttcttactaggaacatagtgaatcgaaagcacttgacacttagaagtaaaatagatcaagcctcttccattgcactgaattttcgtttttgacataaaactgcattgaatattgtaatgtataggttacttactttgctgctaactcgaggaaaagaattttagtggataatgtttaaatctaggaacatattctgaagctcctcaatataattatttctcaaattctggagatacacacaaaataacctcgaatttctttgtctataccaagatttttttaaaatttttgttttaaggtgtacttggcaattccattccatttcttatttgtttatggtttcatggtatgcaacatgtgaaagctaatggggattattgcttttgtgcttgctactaggaatatgacattgcaaatgataacggcaaaaatccagcagagcgtttagctcgccaaaagcaaaatctccggcgtcgtttaggttatacttctctcttacatcttattgttgctactttttaattttcactttatggcactcaccgcaccactgccacaaggttctttctatagtgaagactgcacctgtattctgcaaagtatcgttgtactctgatatatctttgaactttttgttgttgtgttggatttctcattcctttcatgtttctgttctagtgcaggtctggatgtatgtgagcagttcatggatttcaatgatgttatcaaagacgaggaccttcttgcccaaaagaattattggggtgcaaatatgcaaaacaatggattctattcatttaatactggtcagaatattcagcacttggttgcatctatggttcccaggtatcccaaacattccaattttcgctccaggcgattaagcgccagggagctcaatatgctgaagcgtaaagcaaaaagcaatgcaaaagatcatacaaaggctgtacccgaggatgatgacgttgtgccaaaaagttctggaccgtctaacggggcctcttctgatcaagttggttcacacaacacatgttctgtcaattgtactatatttttctaagattttagtatcctcccgcacaattttttatttttctggggtcatttatgagatggtcattaattccacattcttaaattatcgggagccttggtagaggttgtaaaactttgtttctgattgttctcaattgctagcacaaactatcatgtctgaatatgtggcgcagtgcaagtaagttaagtgcatttgtgggtgtgtgttcttccatgcatcatgcatgtgtggtttgttgacttgttattgttggcattcctgtttggcaatttacgcagttgcactggagcattctgttgggatggctttgtcttcaatctgtgatgatctaatcaccccacttacattttttcaggatacagttgatgcaatcacagatgaggacaatctggagtacagtgagaatgggagatggccttttcaacagtttgtagatcaacttattcatgacatgtttgaccctagtaagttcattatctgtcttgtctctgaaatttgtcccattcttatctcgcttacaatctttttactgagtgttgtattgtagtttgggaagttcgccatggcaccattatggctttgagggaaattttgacgcatcaaggtgcttgtgctggagtatattttcctgatctgaactcacctttcgctgaccttgatgataaaaacaatttggactccctgaaaagagcacatggtattgatcttaatgaagacattgattcgggacagctcgagccagttttgaaaagacaaaagaaagaggagtctaatccagaggttatggacattcagttggataaggagccaagtaacggtgattattccaaaacagaggcaagtctgagtactgagcctactgtatctagtggtgaaccaaatcttgctcatgcaaaggttgaatcacccttccaggttgatggttcagctaacccatctaaggtggatccatattgtacaccacctcacgaaacactcaactccatgcccaaactgagttctacccatctccctgaaaattcaaaatttataaagctgatgaaactagcgaactactcagcggtaaaaaattgggaatttcttcaagactgtgcaattcgtttcctttgtgtactttcattggaccggtatgtatctctggacttatatactttttgtgtgtatttggttgtcttggctattagtcttattatttttttttgcctttgttcttcctgtagctttggtgattatgtatctgatcaagtggttgctcctgttcgtgaaacttgtgctcaagctcttggtgcagttctgaagtacatgcatccgactctagtatgccatacactgaatattttgctgcaaatgcaggtgtgtcctgtagtaattatttgtcttgctgttgtcaacttcaaaacagtacattctctgttgtcatcatcatcaccatttccgtccttttctttgttctttcagcgcaggcaggagtgggaagttcgtcatgggagtctccttggaattaagtatttagttgctgttcgtcaggtgattgctaatgagaaaaactataacctaataggctaattcaatcgtctttgtgcatatatgaccagaggggcagtagtagttggcttgctaccaagtcaagttttgcttttcatatctctacactagaggaacttaggagttctgagaaacatcctcttctgtttactaatatttgtttttgacgcctaatttatgtgtaaaattgctataatattgtttccttccccaccaggaaatgcttaaagacttgcttaattatgttcttcatgcctgtaaagctggtctggaggatccagatgatgatgtccgggctgtggctgcagaggctctgatcccagctgctgcttctttagttagactaaatgatcaaatgctacattcaattgtgatgttgctttgggatatattgcttgaccttgatgatctaagcccttctacaagcaggtatgttcaatcatgctttcctcatttagtaaacacattgtttgcgtaatgttgaacactgagcccatgttatacattatatggtccatctacttccgatttctaatcttattttgaatccagtcacctgttcccagataaggaatttaaaatgttggatagttgttcgttgctcttttattccgtttaaagttgactgtactcatgccacaataaatattctgtatttctcatgtccaaatttcatttttgtttcagtgtgatgaatttgttagctgagatatattctcaaccagagatggttccaaagatgcttggcacaacagccataggtggagacaacgaatttgatctaaacagtgtaactctggttgccggtgaagaaaaaatgggttctaatgataatccttatgtcttagccgctctgacaccccgattgtggccttttatgagacatagtattacatcagtccggcgttctgctgtacgaacattggtaagaattacatggaatttgagatccactgtagtttgattgtgctgcagtatcaggtgcccattcgagttgagtatgagttatataaatgagaaacagaattgtaatgaaaaatatctgcaataatttaccgggtgaaatagcagttttgagccatcttgtgtatgttttctacattgttttgccaagaaaaaccaacctatccttgggattttgccaatctggagttggatattccactctgttcccatgtgcaattggtttttgctgtaagcttctgaatgccatttgttatgctttcctagttaaaaaccgtgaagttcaaactttttgtaggagaggcttctcgaggttgggaacaccaggaattcagctaaactatggcttgcatctatattaggtgatgcgctgcaagttgtcttccagaatcttcttttggagtcaaatgatgagattattcgatcttctgaaagggcttggaaacttttacttcaggttactgatgttctggctttccgggtgttgtgaatttactcaattcatagaaatttaatgatcatgtctattacaggattatagtaacaaacaaaaatatttctatgcttgtagtgccctacggaggaccttgagtctgctgcaagttcatattttagtaattgggtgcaacttgccactactccatatggcacagcattggattctgcaaaaatgtttttgccagttgcacttccacgaggaagtcgttcaagagctgctgcaaagatcaaatctgcaaggttagaacatgaaaatacgagaatgatatcttttggttctaccggagagaacacttcacaggaaaagcattctgaagcttccttgagtgtttcaaaaataattgtggggtctgattcggacaaatctgttactcatacgcgagtgctgacgtcaatggcccttggtctgtttgcctctaagttgccagaggggtcgtggcaagttgttcttggtccactagcaagcgatctcatgtctctctcaggagtccagagacaggtaagaaaaaaccttatgttttagtgcataaaagcattcaattcaactacttgttttgcactcataattttctatcgctccaggtggcttctatggttattgtttcttggtttaaagacctcagaaaaagtgatcctgctgcggtgggtacattgctagctttcttatcctccctgaaagggtggatgttggacttactggcttgctctgacccttcatttcctacaaaagattctccgcttccatatgctgagcttgcaagaacatacaggaagatgcgcaatgaagccaataatttgttccagtcaatagaatcttgtgctcttcttaaagagtatacaagcaacttaaactttgaagctgacatgctgagtgttgatgatgctattaacttcacttcaaagcttttgttaccatctgaacctgattttagtttggacagtgataaaattgtcttgaacaatatagagtcagcaaaacaaggtctattgtctacgtcaggctacttgaaatgtgttcaggtatgtgaaatttctaattagggtgtcttcagatttatattaatgtgttagaattacttgttgcatctgtctagttctgattttttttatcctttttattagcaatatcataaaataggtttccttgtttgatgatgttctgcagaataatttgcatgtgacagtttcctctttagtggcctctgctgtagtctggatggcagggctgcctagtaagttgaacccagtcattttgcctttaatggctgctgtaaaaagggaacaggtacgacatagtattcttatgctcttaaattttgtcttagatgtaagctcaaatggttccatatcatttaggaggaaatacttcaggacaaagctgcagatgcacttgctgagctcatttttagttgtgttggccgcaaacctggcccaaacgacaaactaacaaagaacctctgcacgttaacatgcactgatgcaagtgagacacctcaagctgcagttataaactcaattcaggttattgaggaccaaaacttgctgtcgattggtaagcgttttagcaatcacaaatccaggggccagatgacttccggtggtgaatcgaagtcggagggttttataagccggcgtggatcggagttggcttttaagcatctttgtgagaaatttggagcatccttatttgaaaagcttcccaagttatgggattgccttacggagtttcttaaacccgtcaagactggagatgatcttatgaaagaagatccaagtattgcgcagttaggaagatcttgtgaggacaaggaaccgcagtcccttataaataatatccaggtttgttttataaattaatttgaattcaattggttcccttttgttttggcataaaactgctacatgatgttggattagaccatcatgtcatatcaatatgaatcaatatatctttggttacttgctactatttagtataaactggtttggttccattttcatctcttgccatatttctaatgccatttctgctcctcctcacaggttgttcgttcggttacacctcatttggctgagcccttgaggcctcaattgctaagtctccttccctgtattcttggttgtgtgcgccatcctcatgtcgctgtcaggttagctgctgcaaggtgcatcacatcaatggcaaaatcattgactgctaatgtaatggtaattgtgatagaaaatgtcataccgatgttgtcagattcatcttctgtctgtgcaaggcaaggagctgggatgcttttgagccttcttgttcagggtttggctgtggagttggttccttatgctcctttccttgttgttcctcttctaaggtgtatgagtgatcctgatggttctgttagacagactgtaactcacagttttgctgctctggttcctttgttgccattagcaaaaggttctttgttaccggatggactgagtgaacgcttatctagcagtgcagaagatgcgcagtttctagagcagctcctcgacaactcccaaattgatgattacaagctcagcattgatctcagtgttgaactgcgaaggtctgtaactatcttaaaagctcctttattggaatgtggcttgacgacgttattctacttagtttgagatagtgtattgagtgctattgtggataccatacataataatacttgttataatgattattatttgatgttcttttaacaaaatgttgtggatcgctacaggtaccagcaagaaggaattaactggctagcattccttagacggttcaagttacatggaattttatgtgatgacatgggtcttggcaaaacactccaggcgtctgctattgtagcagctgatattgctgagtcacgtgcacggaatgatgagcaagatccgaaatctttgattatctgcccttctacattagtagcacactgggaatatgaaatagagaagtacatagacagctctatcatgaaacctcttcagtacatcggttcatcacaagataggattatcctccgttctcagtttgataagttcaacgtaatcataacgtcatatgatattatacgcaaggatattgattttcttgagaatgtcttttggaactattgtgtgctggatgaggggcacataataaagaactcaagatctaaaataacatctgctgtgaaacaattgaaagcacaacaccgtcttatcctcagcggtactccaattcaggtaaaatttcattcatgaatcttgttggtatgcttttcgtctagctgttgcggttcgctttacattgcactttttatttcattgttcatgttctttgtagataattccatcgatccagtactgaaattggtattactatttatttgacacattccactataattgcagaataatgtattggagctctggtctctatttgactttcttatgcctggatttcttgggacagaaaaacaggtaaatgtgctatgaattcaactttacttacagaactgaaagctaagaatttggtcgttgacatgaaccatgccttttttgttcaagaacttagtttagtttttaacatgttcctgatttactcttacgctagcttccaagcttattagttagttcaggaataatatatggatctatggacttgctagttagttccaagcttattattagttagtttagtttttttgttattcactgtggacttgctcagagcgacaggtgatatatggatctgccttatctgggccgttacactttcttacatatgatgcttgcaaatgatatctatgtttagttgtgttataggtgctaggctgcttgataaatcattagtagtttgatgacatgcatctgtagaaaaagacattggtgactatattgtattaatgtaagtggacatatatggctgtgttcggatgagggggttcccaaccccctctccctcgcattccgtgcgcacgcttttcaaactactaaacggtgtgttttttgcgaaaagtttatatacgaaagttgtttaaaaaaaatcaaattgatccatttttgaaaaaaaatagctaatacttaattaatcacgtgctaatggactgctctgttttccgtgcggggagatgggttcccaaccccacattacaaacacacccatagaatgttttaaccaaccaaagatgaaattgtttctgctttcatgaaggggtggatttttactagtcctgactcttgataattaccttggtctattctgatatgaagtatttgtgctgaaattaaatacaatgttaattatgcagttccaagctacatatggaaaaccattgctagcagcaaaagatccaaaatgttcagcaaaggatgctgaagctggcattcttgctatggaggcactgcataaacaggtttttatcttctgtagtagacttgaagtctttaaaaataactgggggttttgagtcttgtgacctttgttgacaagtaaaagtcattttgctatactaggtcatgccgtttctacttagaagaacaaaggatgaagttttatctgatcttcctgagaagattatccaggatagatattgcaatctcagtctattgcagctcaaactttatgacaaattctccaactccaatgccaaacaagagatttccactatagtaaaagaaaatgaattagatcaatccacttctcaaccaaaggcaactcgtcatgtgtttcaggtactgcagttagacaaacattttagctttctcattctgcatttcttatgtggtatcgtgtttgcgttttaattgaatatgcttttgtaatgcaggcactgcaatatctattaaaactttgtagccatcctttacttgtaactggggaaagcccacctgattatcttgtggaccttctaaaggaaatcggtatgggaactggtgatgagcttcatgacctacaccattcccctaaacttgttgctctccaagagatacttcaggagtgtggtatagggtcagaaatatcaagccctgatgcttctgcagctattgggcaacacagagttttgatttttgctcaacacaaggtactgagtctgttctcttattgagactatgtatccctgtttcttttggtatattttcatccttgtcatgtttataaacattcttttctccaggctttgcttgacattattgagaaggacctgtttcaatcccatatgagaaggtgagttttatatattgtgatgtacatcagcttcatgaagaattcatcatgccagtgtgttgtctgtgttgcaacagatttgaaaaaaatatatcatgagttctaaactgaaaaattatatatatatatttatatattttgaaaaatcatataatattcaatcaaacatcaatcaacaaaaaactcaatccatatgcacaaaagacatttatccggtcctagaagatacggtgagatcgcagtttcaccaccaccaccagtagcagattcttttatatagtagagattaatattagctgatgcaaattattttaagcatcttgctttatgttgttttatcttgtgttttattatgcttggatatttgtactttctagagtactgcagtgctgttttatctttgagtaactgtaaatataaggttgtcgttggcctagttgataactgactaaaaatacacacttctgtttctcagtttcctgcctgtgctcatctaatcagcaaacttttgatattcattcagcgttacatatttacggttggacggctctgttgaaccagagaagcgatttgaaattgtgaaggcattcaactcagatccaaccattgatgtgctcctattaacaactcatggtaggtttggagaatgccatatggatcagggatttactcctagatatatatactagaaaagctatatctgattctttcctgttgcagtcggtgggcttggattgaatttgacatctgctgacacattggtctttatggaacatgattggaacccaatgaaggatcttcaggtttgcttttgcatattttatcaacgataaggctaccattaaatttcctccaccattttcaagctatcctctgtgaaacaaacgaacaatactcccctcttacaggcaatggacagagcacaccgtctgggtcaaaggaaagtggtaaacgtgcaccgtctcatcatgcgcggtaccctggaagagaaggtgatgagtcttcaaaggttcaaggtgtcggtggccaatgcggtcatcaatgctgagaacgccagcctgaagacaatgaacactgaccaactgcttgatctgtttgcttcgacgcctgcttccagaaaagtaaatcccttgtgaccatatatctcgtatagaaaaaacttttgtaatttttattctttatttgggtttatgatcctttgtctatggccatacgcaggcgtctgtactcccaagcagttcgggtggtgatcagagtaaagattccaaggggaaatctggtgggaagggtttgaagtccattctgaatggtctggacgagctatgggatcagtctcagtatgcagacgagtacgatctcaaccagttcttggcgaagctcaacggctgaacacacgatcaccggtcctgtacagtgtaaagcgaattggggcgtgtgatgaacaggttggcagattttgttggcaaccacaggagtcagaaatttttttgttgtttcatacggaagaagggaaaaaaaaaggaagatcgcaagatctagagcaatgtggctaacatataggtgcttgagatggtgatctcaaatttttgtcttttgagcttttggttaggagggtttagagagagatagagctagtcttgagaggagttgtatatactatctgctcattataataattaatcaaaggctgcagctccttgtaaattttgccttgagttgcttactgtttctaccttttacttggcctagtaactgagctatccagtggtgtagtaagcctgcctactgggaacgcggatcatttttgtctcgctaacatgtgaaagtaatagtaagatcgggtaaaaacggaaaaggggtgatacattcttgcctatcaatccttgctcgtctgaatcccgttttggccgctaaggaagttcccaaaaatttttcctgttcattgtctgaatcccgttttggccgctaaggccgttttggacaaatgtatagagcacaaaatatatattaaaaaaactaattgtacagttatggagaaatcgtgagcttaatcagttcatgattagccataagtaatacagtaacccacatatactaatgacgggttaattacttaatttggctcaaaagattcgtctcgcggtttccaagcgagtcatgaaattatttttttcattcgtgtccgaaaaccccttccaatatttagtcaaacatctgatgtgatacctaatttttttttcgtgaactaaacggtccctaaaaggaagtcatctcagccaatgtgaaactgatgacctttcattcccttctattctttcatcgttgtaattgtgacatgttagactataactttcatcagttagaaattgatcccttggtctccctttattattattttttgttcgacccttgcttaggccatgtttagtttcaaaggttttcttcaaacttttaacttttccatcacatcagaactttcctacacacataaactttcaacttttccattacatcgttccaatttcaaccaaacttctaattttgatgtgaactaaacacaaccttagatgcatatcttttcaatgtcctttgtttctacatagcctacatagtaagggtagaagcggtgtggaaattttctaaccataccgatacagtttccctaaaatattacatagtcatgctgtagcagcactcggaatatatatgatctagttagactagttcttctctcaactttctcagtctcccctttatttttcacacgcacgtttcccaaactactaaacgatatgattatttttttttgaaaattttctataggaaatttgatttaaaaatcatattaatccatttttatttttaaacttaatacttaattaatcaagggggtcaatccactgtttcatttttcgcatagggaggagttcccaactactccctccgtccctaaatatttgacgccgttgattttttttaatatgtttgacggtttgtcttgtcaaaaaatttaagtaattattaattcttttcctatcatttgattcattgttaaatatactactattactcaagtttttgaataatattcacaaaagtttttgaataagacaaacggtcaaacatgtttaaaaaagtcaacggcatcaaatatttaggaactaaaagagtactacaaacgaacgaagcctaggcttctccatataaggctgtgtttagttcacagcaaaattaaaagtttggttaaaattgaaacgatatgacggaaaagttggaagtttgtgtgtgtaggaaagttttgatgtgatgaaaaagttggaagtttgaagaaaaactttggaactaaaccaggcctaaatgaacattcgatggctcctctagaaacattcttgatcttagcattcagtttggaagatgaaatggcattcacacgagcattgcagattttcatggtccatctggctagcagagaccagagcgtcgtctgcaaatgcatgatctgagcaaacctttgcagtctttgctgcgttgcgttgacggtcagtcaacccacacacacacgcatcatgcaacacattgacagattggccttaacttcactcggtaatttatttcatcgctgtaactatggcatgttagactacaactttcatccgttagagcaggtacaatagcaggctgtaaacatattttaataagataaaagatgagagagaatagcagtgggctatagatctatagccagctgcagcgtggactccaagacacaatgtgtgtatgacaggtggtaccatatattaatagtatagtaaacaactatcgtataaattacctattatattggctataaataaattaaagttagtagtgggttatactattaaacttgctcttagaaattgatcccctggcctccctttatattagttgcattcctttgaatgttccacacttgtttagcgaattaaatttaaaaatatactgttaatttatttttttttctcgaaattttcaggatatatttttttaacagaaatatatcgtcgttctgtcacaaacattacacgaacatgacgacgcgggcgagacggcgctacctcacacgatgaaatagctagaccgagcagtaccagcgagcgagaccgaatggctggccgattcaaactgtttaattatctgatattaattaatcgctaattagaatgattaatcacttgttattattaattaattgctaattgggtaagtctctaattatgcggcagctcactgggcaagccgttcgctctctgctcattcattgtgcgagattgcttggtctcgttgtttcgtcacgtgagaccgcgcgatacgctatggttgcgcacagtcaccgtgcaagaccgtccgcgtcatcacacctcacgttgtttgagatcgacagtttatttctattaaaaaaataaatcaacagtatatttttaaatcaaatctaattacttgtttagctgtatatcttttcaaaatcgattatccctacatagcatatgtagtaggggtaaaaacggtgtcgaaattttccaaccgtaccaataccatttctaagaaatattacatggggtgtgttatgttgggcttttcaacctgcttttacttttgcttttgcaaaagttaaaagccaactaaagggctcaaaaatcataagtacttttgctccaaagctgcttttagtgcagtacaaatctaaaagcacccctacccctgctttcattggcttttgagtaaaaaaaaattacccgcctctctcattataaagaaaacggttcgacaaaaataaaaattaattacacagattacgtgtaaattacaagacgaatcttttaagcttaattgcttcatgatttgacaatgtggtgctacagtaaacatttgctaatgatggattaattaggcttgataaattcgtctcgtagtttacatgcggattctgtaatttgtttggttattaaactatatttaatactttaaatgtgtatatgtatatttgatgtgacacagtaaaaaactttacccataaatctaaacacagtcttaatattctacgcgtgtcacagtgtgaaattttttgttatgaactaaacagtttggaagatgaaatggcattcgcacgagcgttgcagattttcatggtacatctggctagcagagaccagagcgtggtctgtaagccagacagcccatatgcatgatctgagcaaaccttgcagtcgttgctgcgttgcgttgacggtcagtcaacccacagacacacgcatcatgcaacgccattgtcagattggccttaacttcactcggtaaggcctggtttaggccatgtttagttccaaaaactttttttcaaaaacatcacatcgaatctttggacatatgtataataaaaaactaattgcacagttatggaggaaatcacgagacaaattttatgagcctaattagtccatgattagccataaatgctataataactcacatgtgctaatgatggattaattaggctcaaaagattcgtcatgcggtttccaggcgagttatgaaattagttttttcattcgtgtcccaaaaccccttccaacatctggtcaaacgtccgatgtgacaccaaaaaattttcttttcgcgaactaaacatacccttaagtttcccaaatttttttccaaaaaacatcacatcgaatctttggacacatgcatgaaacattaaatatagattaagaaaaactaattgcacagttagaggaaaatcgcgagacgaatcttttgagcttaattagttcataattagccataagtgctacagtaactcacatatgctaatgacagattaattaggctcaaaagatttgtctcgcggttttcaggctagttatgaaattcgttttttcattcgcgtccgaaaaccccttcccacatccgattaaatattcgatgtgatacccaaaaattttcttttcgcgaactaaacaggccctaactcgactcattcactcgcgaactaaataggccctaacttgactcattaaggctgtgtttagatccaaagtttagatccaaacttcagttcttttccatcacatcaacatgtcatacacacacaacttttcagtcacatcatcttcaatttcaaccaaaatccaaactttgccctgaactaaacacagcctcactcactctagtcccagtcaatctaggtggctagctgacagcaaaaaattttcgccatgtcacatcgaacgtttgaacatctgcatgaagtattaaatataggttaaaaaatcacatattgcgactaatttgtgagacgaatcttttaagcctaattgctccatgatttgataacgtggtgctacagtagacatttgctaatgatggattaattaggcttaataaattcgtctatctgtttactgacggattctgtaatttgtttacctgaatacctcatatgacaccccgccaaaactttaccccctcgatctaaacacccctgaatttgctatactagtatataatattctccagccggatccttcctctcggacgcagcaatggcaatgacgatgctcttcagtctgctgttttgcacagctaaggctactgatgattcaggagcagaaactgaagcagaagcactcctccgatggaagtccactttgatcgacgccaccaactcgttgtcgtcatggtcgattgccaactccacctgctcttggttcggtgtcacctgtgacgccgccggccatgtcactgagctcgaccttcttggtgccgacatcaatggtacgcttgacgctctctactctgctgcattcgaaaacctcaccaccatcgacctcagccacaataatcttgatggtgccattccagcaaatatttgtatgttgcgcaccctcaccattctggatttgagcagcaactatcttgttggtgttatcccgataaatatttccatgttgattgctctcaccgttctagatttgagcggcaataatcttgctggtgccatcccggcaaatatttccatgttgcacaccctcaccattctggatttgagcagcaactatcttgttggtgttatcccgataaatatttccatgttgattgctctcaccgttctagatttgagcggcaataatcttgctggtgccatcccggcaaatatttccatgttgcacaccctcacctttctggatttgagcagcaacaatcttactggtgcaattccctaccaactcagcaagctccctaggctcgcccacttaggtcttggagataaccacttgacaaatccagaatatgccatgttcttcacacccatgccttttttggaattcctatctctatcgagaccttttacagtgtttacattcctaaaatggcatagatctaacggttcacgatgaaaggtaccttatgaaaggtatcagaggtagaaaggtactaagtattaaaaggtaattgataacagggcaattatgtctaacaacgtatggacgtaccgaaaggtacggtgtaagtggatttgaaggtaccacaaggtaccacgtaagtagtttttaaaggtaacgtaaaatatgatttatgtggtggggacaaaaattacattctcttctattcggtttccaatcttcggtcgttctgtttgcgtcggtttccaaactttggtccgatttacgtggtacatatcatattcgcatgatcttgataattatttccagatagtcattaatttacatagcaatttggtgatccatcgtttgatgaatgtaatcaaagatcgaaaggacaacaaattgagaagatttacgcacctaacaagaacaaaacaagttcaatgaggaagatttgcgaaaaaaaactaaacaaatcgtctgacagatcgggaccgtgcggccgcttctagctccggcgaacatagacagtcttggaccacttcttcagggtcctcttcttccacggcccctccctccaaccaccgcctccggccacacgtccaccgccggccctcaattctcctcctttcaacttatcgaagaacacgtaaaccttacgtacgaacagaacgtatctaagaatgatgcaacgcaacatgctacaagctaattccttcgataccttctcatacctttttatatgtgtaaaagacacatttgtcattctaatatcatcatatttacattaatgccacctattacaatattttctttccataccttgcccctcgcagatcaacggctcacgtcgccccacctcctttacctcgcaaacatcgtaaaatccctcatctctatcttacaattatctcaacggtacttttccagaattcatcctcaatagcaatagtttgaggatggagcacctcgatttatcgtataatgccttctcatggtccataccagattcactaccaaatttgagggttctagaactgtcgaacaatggattccatgggaccataccacattcactctcaagactacaaaagctccaagacctatatctgtacagaaacaacctcaccggaggaatcccagaggagcttgggaacctaaccaatcttgaggccctgtacctgtccagaaaccggttagttggaagtttgcctccctcttttgccaggatgcaacaattatcattttttgcgatagacagtaactacatcaatggtagtatcccgttggagatattttcaaattgtacttggctcaactggtttgatgtttccaacaacatgttaactggaagcatcccaccactaatcagcaactggacaaatctacactacttggccctctttaacaacacatttaccggtgcaatcccatgggagataggaaacttagcacaagtatatttagaggtggacatgtcacaaaatctatttactggaaagataccattaaatatctgcaatgcaactttggaataccttgcgatcagtgacaaccatctagaaggcgagctccctggatgcctgtggggtttgaaaggtctcgtttacatggatttgtcaagaaacactttttctgggaaaattgcaccctcagacactcctaacaatgattccgacctactcgccctggacctgtcaaacaataacttttcgggttatttcccagtcgtactgaggaatctcagcagactagaatttttgaatcttggatataataggatttctggtgagattccttcgtggataggggaaagtttttctcatctgatgattctacagctaaggtcaaacatgttccatggaagtattccttggcagctatcacaactccccaaactacaattgcttgatctagctgaaaataattttacaggctccataccaggtagtttcgccaacttatcatgtttgcactcagaaactagatgtgtgtgtagcttaattggagtatacctcgatctagatagtagacactacattgatattgattggaagggaagggagcatccatttaaagacataagtctacttgcaacaggtattgatttatcaaacaattctctctctggtgagatcccttcagaattgacaaatcttagaggtattcagtccttaaatatttctagaaattttctacaaggaaatatcccaaatggaattggcaatctaacacatttagagtctcttgacctctcttggaataaactctcaggccatattcctcatagcatatcaaacttaatgagtctcgaatggcttaatctctcgaacaaccttctatcgggagagatacctacaggtaatcaactcagaacacttgatgacccatcgatttatgccaacaacctggggctttgtggatttcctttgaaaatttcatgctcaaaccattcaagttctacgactacactagaaggggcaaaagaacaccaccaagaactggaaactctatggctgtactgctcagtaactgcaggagctgtctttggtgtttggctgtggtttggagcactgtttttctgtaatgcctggaggcttgctttcttctgtcgcatcgatgccatgcagcagaaacttatgtaaaacatagctcatctgagtaatatgctctgcttctcattgagtccacctgagcgtgtgtattagtgtcacattatgtcagcactgcactaagatctaaggttcagtaggtattatccctttatttcagccatcgatgagatgtaatttgctgttgccagatttagcttgttgttgttgtcatgatgaactcttgttataagcttttagtgtaagtcgggtagcatccttggtcagaaaagaaaatttacatgttttgatgatgagaccaatttcctacatggttgtgtttgaagatgcaagtagcatgtaatcaaggaagttccaaataaagtagaatacatcatggctgtcttttgatgtatttgcaagctttgttattacctttggatgcatacagacttcatttgacgctaatttggagaattttgtcttattttctgttcaaactgtaagctgtatgtattctgttttttttttctcatcagctataaattactgcagtacacttctaagcaaaagaacacagctttgccggttgcagcaacaatactgaacacaacaagaacacgcgtggcaaaatttctattactagaatttcaccaaattccgacaaaaaaggtggagaaatcataagaacaaaatcacgctatccactgaaaatttccaggaagaattgcaaatcaactccccttgtgatcagtggccgctgttcacgacagcgcagttcctcctgatctccccctccgatccggtcttgacctgcaccgcgcccagcgtcgccatcgaccggccgaacacctggaagaacacctccggcgggctcgccacgacgccggcgatgtccgcccgccccgccacgtcggtggcgagcgcggcgttggaccggagcaggccgcggtgttagagtatatgatagttaaagttatattaggatatgattggtttgtttggattccttccatatctataatacttccttatttcttcctcctatatatattggatcccctgagactcaatacaatatgtcccacgttacgcagtatacctctcctatactatacaacatagtatcagagcgggtgatctaaggccaatgccgctcacgcttccgctcgtcccccccgaagggtttcgatctcccgggggcggccacccgtttcctttttttttcgctcgtcgagtcttcgcggcctgcctccccagaggagtcaatctccgggctgcggccgcggcctgtccgtcgtcatcttcgcgtcagcaggccctccgtcaccgtcccccgcgccctcagattcgtctacaccgccagcgtgtacgtcgccgggtcacccctccaccggcgcgctgctcccaacggcgccacccccgtgccggtggctcccgacgccaccagcctcctcgactccgccgcgaccacgtggtgaccaccgcgccaacggccgacctcagctccgccctgccggcatctggaggacgccagcagggcctgcgcctcaccattgccggccgccaccaagctccggctgcgtcggctcccggtccctgccggtcaagcacgccgccctccccgcgccacgtctccaggaacaaccggtctcctctcattcccttccaatggtctgtctgcacgtgtcacatgtgtgggtggataagttttggggggatagctggctactggtacggctgaggcaaaaggttagctggactttggcctatgtaccggaccatcgagcaacaggggatgctaccgtactgttgctgcttgtatttttttttcgcccacaagagacaattctttttagcctctaagagacaaaaagaagagcctaacaaggaccttgagataacagcccattcatagaacgggtttgcgtcgcccaccgcctcgtcgacatctacgcgtctccgatatcggtatcgactctgcttcgactttatcgttccgcctcgcgcatcttcggcttgatcacccgttcaagcgcccggctacaacgacttctacaaccgatcggcatcaagcacgcgtctacactatcaaacttcgggttgccgctgcatcgccctcttgggctgcagtgtcgccgcccatggtccacctccactggttgttggaacactgagaggcaacacctccactgcctcgcccgcgcggtattggcaacaccggcgcgcgtgttcgtcccgagttgtccccgggtctggcaaatccggcatgacgtctcgtctttcacggttcgactacatcggctcttcggcatcatcttcctcaacgactgccgcgattgtgtcaccgtcttcgtctcccgcgcatcctcgcgcaccttggtccacgatgcccctcccgtgcgtccacgaccactctacgacggcccatgcgcgctccgcggctcggctacctcgacatctatttttcgaccacagcactcttgccggtttcttctccagtctaagtgtccgcactgctcacgcttggactgcggggggatgttagaatatatggtagttagagttatattaggataggattggtttgtttggattccttccataagtgtaatccttccttatttctttcccatgtactcctgtatatatcggccctctgaggctcaatacaatatgtcccatgttacgcagtatacctttcctatactattcaacacgtggtgcctgagcaccgtgcggtagtagccgaggtcgaacgtcaggtggctgccggggtccatctccaccacgccgtcgccggctgtcctgcacttgcgctcacgcaggttggcggcgtccagcggcggcgggtcggtgctgttgctgttggcattgccagcgccgccgccgccatagaggcggtcggcgaaggatggtgtgcgcacctgcgcgatcggatgcaatttttcagaaatcattttacatccaagaattcattgtgataatgtcacacatgtgtcctcattcttgcacaaaaacaagcttgaatttttatgatgttggcttgctgtagatcgccattttcgggacatgaatcgagcatccaaacgattgggttgaaatgcaatttttttaatgaaaaaatcaacgtaatttttcccctgttgattgtcaacaaagaatctataaaattttctcaagacatgcatgagagagtctgcagctaatttcaaattttcggttgatttgatgctctaacatatgagattatataaagctaatttttgttcagtttattataccagtcataaatcataacagtataaaattgactatagtcaccaattatagtgaccctccccaactattgaaaccagggtaatttaactcacaatacagtattgatagtggtatttactaacgtgacttctacgtggcatcccaaacatcaaataaatttaaaaactaagtagggctcgcctgcaaccccccccctcccctcccctcccttctacccctctactaacctctgtccacctctctctccccatttcttcttcttggcctaacagcagcagggtgccgagacgacgacggggagcagcgggatgatggcgaggctctcctttctctcccaccccggtcccttctgtccaggcgctagtggaggagtggccggccgagtgagatgcggggtggcagtaggcagcgagcccgggtggtcctcatcatcctggccgggtcgcctgagttcgagttcttggatggtggggaagaacccctcctcgttccagtccctagaattcgagttcaagttctagatagtgggaaagaacactgcgagatgaccacagcatgcctgctgtcaccgtcgtgcgggtatcacggcccgattggctccgcaaagccattgcgtgggtgtcacgggagcacgaatgagccgctgtggcacgtcatcctctctcccctctccctcgtacatctccacctctttcctcatatatctccacctcttccctcactcttcttgtgggctctggcggtgtgacgaccagcaagaccatgggcagtgcctagcggaagatgaaccaaagatggcagcgaccatcgcaagtctcaacttaagagtgatgagcatgctctccctcctcccgaccacgcgccaaccatgacgctgccgccatcaccgccaccgcgccgcgccgtgctgctcgaccattatcctcctagttgtgcgtgcacccttatatctcccctcccttcccactcggggattctctctcactttcatctagtgcgtgacggagcgctggcggtacaccagtcccccagccccttctctagcgtcggtggcacactagtcccccaacctcctctttggcgccggtggctacctccggcccgggcccttgccactgctccctccctcgccactgccgatgggggggggaatggagatagatattagatagggagggggatagtgagtatgacaagtgggtgatatattttctttttaaaaaaaatattttttttaaaaaaaaatctctagtcacttacatatggaccttcaatttctactttgtgactatgctaccatatcaacacagagttgaccaagtcaacgagcaatgtcagcgaaaaccgttgagaaagtcaaattgtaccggtttaaataactagaggtccaaggtattcaagatcactaattagcgatcgatcgccccagacgatcatttttcttttcatcactttcccttttttacaccatatagtttttcttttggtaagtttatatacttaaagtttctacatctaaagtttacgcacctaaattttaaacacccaattcaaatttaaattcggatttaaatttgtagagcgaatatttataagtcaaaagtttatatagccgatttaaattcaaattcggattcaaataatttatatatagaatatttctatacataaagtttatgcgtgcaaagtttacggtataacctaaagtttatccgtttgtagagcgaatgtttataagtcaaaagtttatatacctgattcaaattcaaattcggattcaaatattatatatatagaatatttatatacataaagttttatgcgtgcaaagttttacggtataaagtctatgcacatgaatgagagtattagatgaaatttatgatgaaaggagggaagggagaggagtataaggggttgatctcccgcccatttggggctcggtattgaggttgtggagtacgattaagattggagccgtatttgagggagtcaatgtggacttattgcaagccagaaagccgacgtttccgcggagttctcaattgggcccacaacggcccatataacttggtccggaacgggattgcatggtaggagcggcccacgttgtgtgtgacgacgccgactccctcgacaggccgccgcagcgtggcttgccactacccccgcgcttcgctgtgtccgcttttccagcacagatcaaatggccgccacctccggcgagctcctcacccacgcaaccatggtgctctcgctctctccgattctccagcacaaaccgacggcgagcttgcctccttatcctccgatgtcggatttaagcaaaggcgagataaggatctgccatctccttataataaatagtactattagcatccatttgatattggcaattcggctttgtgtataacatcattggtgatgtggaatggtgacgctgtcagtcagtcagtcaaagtaatcaaccgcgtggggtgcttttatctcgtgaatctttcctttccaagatgggtggtgagctgcgcaatagattagagagttgggtgcccattatcattatattgtcattataaattcatccatcctgcaaagtttttcttgacgccgagcatgtcaatgggcaaaccaatcctcactcagtctcggtctcttcgcccgggtgaccgatagtggcatgttaatgcagctttagcttccaactttcagttagaaattgatcccacggcctcccttcaattttactttttttctttttgtttaacacttgtttagcttgcatatgttttttaaatatttcgtcagtacatagtcatcctgtagcaacacccagaatatgtgtacaaagtgctacctacggagtatttgacactgggaattcaacttattatcaacaattcttatctatactaacatccttggtgatgagacagtcaagtcatcaactatgtggactgtggagtgtctttattctgtgaattttcccccagccatataaacattccatggtctggtatgtccctcatggtccatctgtctagccgagcccggagctttactgaggccgtttttagttccttttttattttttttaaagtatacagacacacatttgaattattaaacatagactaataacaaaacaaattacagattccacctataaactgcgagacgaatctattaagcctaattaatccgtcattggaaaatgtttactgtagcaccacattatcaaatcatggcgtaattatgctcaaaagattcgtctcgcaatttacatgcaaaccgtgtaattagttttttttccacatttaatgcttcatgcatatgtccaaatatttaatgtggtgaaatttttgaaagtttgaaaggaactaaacacggcctgagtcatctgtacgcctgccagcccatatgcatgatctgagcaaccttgcaggctctgctgcgttgatggtcagtcaacttcactcaacaagtcactcactccagtcccagtcaatctaggtggcttacagtatttgaatgaatttgctatactattatataggagtattctccaaccgatccttcctctcggacgcagcaatggcaatggcaatgacgatgctctttagaatctgagtctttctgctgctgttttgcacagctaaggctactgatgattcaggagcagaaactgaagcagaagcactcctccgatggaagtccactttgatcgacgccaccaactcgttgtcgtcatggtcgattgccaactccacctgctcttggttcggtgtcacctgtgacgccgccggccatgtcactgagctcgaccttcttggtgccgacatcaatggtacgcttgacgctctctactctgctgcattcgaaaacctcaccaccatcgacctcagccacaataatcttgatggtgccattccagcaaatatttctatgttgcacaccctcaccgttctagatttgagcgtcaataatcttactggtacgatcccctaccaactcagcaagctccctagactcgcccacttaaatcttggagataaccacttgaccaatccggaatatgccatgttcttcacacccatgccctgtttggaattcctatctctatttcacaatcatctcaatggtacttttccagaattcatcctcaatagcactagtttgaggatggagcacctcgatttatcgggtaatgctttctcagggcccataccagattcactaccagagattgctccaaatttgaggcatctagatctgtcgtacaatggattccatgggtccataccacattcactctcaaggctgcaaaagctccgagaactatatctgcacagaaacaacctcacccgagcaatcccagaggagcttgggaacctaaccaatcttgaggagctggtcctgtcaagcaaccggttagttggaagtttgccaccatcttttgccaggatgcaacaattatcattttttgcgatagacaataactacatcaatggtagtatcccgttggagatgttttcaaactgcactcagctcatgatttttgatgtttccaacaacatgttaactggaagcatcccatcactgatcagcaactggacacacctacagtacttgttcctcttcaacaacacatttaccggtgcaatcccaagggagataggaaacttagcacaattactttcagtggacatgtcacaaaatctctttaccggaaagataccattaaatatctgcaatgcatctttgctataccttgtaatcagtcacaactatctggaaggtgagctccctgaatgcttgtggaatttgaaagatctcggatacatggatttgtcaagcaacgctttttctggagaagttacaacctcaagtaactatgaatcctccctaaaatcactgtacctgtcaaataataacttatcgggtcgttttccaacggtattgaagaacctcaaaaacctaactgtgttggatcttgtgcataataagatttctggtgtgattccttcatggattggggaaagcaatcctttgctgaggattctccgattacgatcaaacttgttccatggaagtattccttgtcaactgtcaaaactctcccaactccaactgcttgatctggctgaaaataattttacaggtcctgtaccaagtagtttcgccaacttatcctccatgcagcctgaaacaagagacaaattctcctccggtgaaacatattacattaacattatttggaagggaatggagtacacttttcaggaaagagatgattgtgttattggtattgatctttcaagcaattctctctctggtgagatcccttcagagttgacaaatcttagaggccttcagttcttaaatatgtcaagaaatgttctatatggtggcatcccaaatgacattggccatctacatgttgtagagtctcttgacctctcttgcaatagactcttgggtcctattcctcctagcatatcaaacttgacgggcctcagcaagcttaatctctcgaacaaccttctatcaggagagatacctataggtaatcaactccaaacactggatgacccatcgatttatgccaacaacctgaggctttgtggatttcctttgaaaattccatgctcaaaccattcaaattctacgagtacactagaaggggcaaaagaacatcaccaagaactggaaactctatggctgtactgctcagtaactgcaggagctgtctttggtgtttggctgtggtttggagcactgtttttctgtaatgcatggaggcttgctttcttcagtctcatcgatgccatgcagcagaaacttatgcaaacataactcatctgagtaatatgctctgcttctcaagttctcattgagtccacctgagcgtgtgtattagtgtcacattatgtcagcactgcaccaagatctaaggttcagtaggtattatccctttatttcagccatcgatgagatgtaattttctgttgccagatttggcttgttgttcttgtgatgatgaactcttgttactagcttttagtgtaagtcgggtagcatccttggtcagaaaaaaagaacatgttttggtgatgagaccaatttcctacatggttgtgtttgagatgaaagtagcatgtaagccaggaagttccaaataaagtagcatacatcatggctgtcttttgatgtatttgcaagctttgttattacctgtgcatgcatacagacttcatttgacgctaattcggagaattttgtcttattttctgttcatactgtaaactgtatgtattctgttttttttttctcatcagctataaattactacagcacacttcaaagcaaaagaacacagctttgccggttgcagcaacgacactgaacacaacaagaacacgcgcagcaaaatttctactagaatttcaccaaattcaaatgacaaaagtgaagaaatcgtaagaacaaaatcacgctatcccaggaagaattgcaaatcaactccccttttgatcagtggccgctgttcacgacagcgcagttcctcctgatctccccatcggagccggtcttgacctgcaccgcgcccagcgtcgccatcgaccggccgaacacctggaagaacacctccggcgggctcgccacggcgccggcgatgtcggcccgcgccgccgcgtcggtgactagcgcggcgtcggaccggagcaggccgcggtgcttgagcaccgcgcggtagtagccgagatcgaacgtcaggtggctgccggggtccatctccaccacgccgtcgccggccgtcctgcacttgcgctcacgcaggttggcggcgtaggcggcgtccagcggcggcgggtcggtgttgttgccgttggcattgccggcgccgccgccgccgttgtagaggcggtcggcgaaggacgagcagtgggcgatgccgatggtgtgcgcgcctgcgcgatcggatgcaatttttcagaaatcattttacacccaagaattcattgtgataatgtcacacatgtgtccttaactcctcattcttgcacaaaatcatgcttgaatttttatgatgttggcttgctgtagatcgccattttctggacatgaatcgagcatccaaattttcggttgatttgatgctaacttacgagattatataaatctatttatttcagtttatttacattggtcataaatcataactgtagaaattatgacattgctgaacaagttaagtcagttcaatggtagataaaattgactagtcatcaacacgaactgacagatagaaagcaactattattcgtgctccttttgcatgcagacatgcagatgcctagtcagcaaacaaaggattggaaattcagacacaaagctttcctctctgaaattaatcttacagcttctacattatgtctcccaccgacagtgcagattaattacatgctaatagtgtagtttggatctgattaactagagtaatctgtttagtttagctgataactgagattaattacatgctaacagtgtaatttggacctggttaactagagtaatccaagttgtttagtttgtgcagataagtggtactaagtatcctcggtttcataatataagttgtttcgaattttttttgtcaaatttcttgaaaatttgatcaaatctctacaattataaaaattaaagatatttccgcgatctgttatctgtgtttgagtcggttttaattttatattttgattttaatctataactctatctcttgtctactattataaaaattgaagatgtttttaccggtactttggtacgtcatctttgtatgagtcgatttttaagttcgtttgcttttggaaatacagatccgtatttgagtcaggttttaagttcgttcgcttttggaaatacagtcatataagaaatctcaataaaaaactcacatgctaacttggcatgattttctagaaaaatatatatccaagcgaattctcacggtgaatttcagagtgaacaataataagattaaaatagacttcacccattacaacgcacgggcattttttctagtttataaaaaaaatataacactcataacaccaaattaatttcattacatctaacatttaacatattttgataatttctttgttataggttaaaaatattgctatgtttttcaaacctaaataagtttggcttagaaaataatcaaaatgacttataatatgatgaaacgaggatagtaattaataatgtgaattaatgaattcgttcataatcgtcacgtacctgacagccagacaaggtcacgcacgctgaggcccttggtggcgaacaagccggcgagctccgggaagctcatcgccggcgaggggatctccgcgagcgcctcctgcatgctcgacaccgtgccatccctcctccccgtcggcacgcgccacgacggccctccctgcagagcatgttcagcatcgtcaggctccggccagtgcgcgcggcgcgcggcgaccgtggcgagcgctcgagagcttacgatggcggcgacggcgtcgcgggcggcgagcgcgagaacgtcggcgcagaagacgacgcccgggcaggccgcctccacgaggcccttgacgcggtcgatgaggtcgaaccctcgcagcgtctggttcggcgccgcgtccttctccgccgcgccgccattgccggtcgagttgaggaggatggacgcgtcgcagccctttttgacaaacgcacaacacattccatcaaacacattgcagacattgcacgcgcatcaatggcggccgcacggcgcggcgcggcgcacgtaccctgacgaagcagtcgtggtagtgcagccgaaggagcgcgacggcgacggtgggtacncggccgacgtgctgccggacgtactccccgacgatccgctccgccgcggggcagctctcgtcgtagaaccccatcctgagctgcgcgcgcgcgccgccgatcacgccggcgccgaggacgacgatgaccgccactccgagccggatcaccgccattggcacgccgcccgcgcgtcgcctcctcgtgctcgccattgccgcccactcgactactcaactcaacttaactcaactcaaaacttgtgaagtgaaccgcttatatacactagtatttatagtcctgagcttacttaacagacatttcttcagagagtgagattacttcaaacttagttcgaaatctattttttgagagaaaaatgcagtataaaaagctgatggactacttgcagacgaagccgaatccaccntgaaaattcaaagccgg

SEQ ID NO: 72501 - DNA, 2525 bp, Oryza sativa
attcctgcagcccattgttgaattctgtcaaaaatggatttatttgtgtgaagtttgtgcattttgaacaagtttttgattggattatgtgtgacgactgatcagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcgacgacctcaagaaatccgactacccgtcgcggcggctcatcatcctcggctccatcaccggcaacaccaacaccctcgccggcaacgtccctcccaaggccgggctaggcgacctccgggggctcgccggcgggctccgcgggcagaacgggtcggcgatgatcgacggcgcggagagcttcgacggcgcaaggcgtacaaggacagcaagatctgtaacatgctgacgatgcaggagttccaccggagattccacgaggagaccgggatcacgttcgcgtcgctgtacccggggtgcatcgcgacgacgggcttgttccgcgagcacatcccgctgttccggctgctgttcccgccgttccagcggttcgtgacgaaggggttcgtgtcggaggcggagtccgggaagcggctggcgcaggtggtgggcgacccgagcctgaccaagtccggcgtgtactggagctggaacaaggactcggcgtcgttcgagaaccagctctcgcaggaggccagcgacccggagaaggccaggaagctctgggacctcagcgagaagctcgtcggcctcgtctgagtttattatttacccattcgtttcaactgttaatttcttcggggtttagggggtttcagctttcagtgagagaggcctgtcaagtgatgtacaattagtaatttttttttacccgacaaatcatgcaataaaaccacaggcttacattatcgatttgtccacctaaattaagtaattaaccacttgtttaggggagccaaaataaaccttaccaaattttggcaatttgataatattgtcaagttttgacatgatttattttatatttaccaaagtttggttaaaaaactaaatgaatgcgtatctttgttaactttacttaagaaaatagtatggtttgaaatgacattaatacgatccttaattaatccatacgaaaattagaaacaggatggtgggctccaggccggatgcaaggcccagtacccaatccaaccggcccgtttcttcatttaaatgggccgaccagcactggcccattaagccacttctcacgccatgagcgctgtcacaccgtattcgtcgccggaagtcgtcgacgtcgaggggacgaggagcccaccggcgagcggtggcgccacgggggaggaaggcggcgagctgggcgtcggcgagaactcgaggagaccgacgagaggccagtccaccaccgcgcagccacacaggcacggggaagagtggcgcgcgcggccgccggagaaggctatggcgtggatctggatgctcatggcggcgggggccgtgctcctgtgggcggtttctctggggcgggtgctctcctcctcctcgccggcgtgtctgcctgccaactccaccttcctctcccctcctcgcggcgacaggatgagccggaatgtcctcctcgttctcgcccaccccgacgacgaatccatgtactgcttcttcctcctcatgtctcttatcgtttgcgagcctcgctgtgtaaatcgtggggctacagttccagtaaccgctaacaatgaagcttaataggctaactcctgtgcacggtacctgctcgatgaaattcctgaacaagtgaacagtttttttttttttgagctaagggagcattctccctccatttccatttaacagaaatgaaacaaagttcttacaaaagcaggatgattacagaaatgaaactaagtgaacagctgaactttttattattttgtggaactgtttaggggaaatcttgtttatagtatttgttttggttgattctgattgattgtcatgttgctgatacaggttttttgctccgactattcttttcctcaagtcaaaaggtcacagcattcatatcttgtg

SEQ ID NO: 72502 - DNA, 3482 bp, Oryza sativa
gcttcgagctttactgttctgaacaactttaaaaataaaaaatatagtgaagaaacaggagcatcaagtgcgcctatctgtattatatgccatttaaaactgtattagttaatctgttccaaatctcagtgcggtgttgctgcaaacaggtacccaggttgagtacatcatatgattgtgcaagtgaaatgcctttttcgtcctgattttctagacctcaaaatatggaaattttgcattttgttcattccgattcccctatttactcctgcaatatttgttgtcattttagattgttgccttcgattcccgaggagtatcaggccatccaaatcattgcgatgttcatcatggaatctggttagttcaactttgttgtttagcatttttagaataacaactgtttgagtttgatgccctcttgtaagaaaaattttctggtactgatgtattttatattgttagcttgtccgcacaagcttctataatatctacatagttgttaagttacatatcttgtcaagtcacaacatgttctgccgaaagaaagtgtattacctaacttcaacataactgtggcctcccctttcccatcaccacacccctttgtaagggttctctctttctctcccatgatctcatccctttcatgcatatataatataagttgttttggggtcacactttaattgaacagtttggctaattcatgtatgtcatgactatggcctgtagctcttggttggtgatgtgcacttattccatctatttaatgccggatttgcttacatttctttcacttatgacagtctagattacacatatgtagcatatttctgcagggtgtttctagcatttttctttggagtcttaataaatctatttttctatgaacagcaagcttctgcgtgacaacgggcaaggacacattgaagcatgggagcttgtaaaattcttccctgatatcctagctttattttcttcacgttgccatatactctacttattccagagtctaaaagagcctgtgcattgctttcttgaatttatgaattgcgtgcttaaatgcattgatatcatcattttcgttggaagtaaagacagaaaacaataacactacacatgccttctctgcatagatttgaattgcttgatgtgtctatctcatttgatggctaatttctatgatttttattggcactaggctagttaacctctaaacaattccctgtgaatacattaatttgaagaagctaacctggattatgcctgtttatttggataggtaagcttgaacatttttcgcaagtacagtggtccagttgacatttggctatcttccaccctctcctcaagctcaaaacaaccaacttatactcttgttaataatagcccttccagaagctttgaggcaatggcttcacacaaaagccagtgggtttggtaagttgaaaattttgttttcactacttaaatgttgtctacttctaggaagtactatatatattgtgtggttcaaaattatcacttaaaaagaagtttctaccttgcaatatagacgtagtacctcataagaatcatccctttgacacccaaaaaaagtcatggccaacatatacaatctcaattgtttctttgactactgtaagactggttgtttgtatttttgagaactcattgttagacttgttttttgtgtgatactgcatgatgggaaagaaatgaagcatttaaggggctcaaaattctcaaaacttgtgtgttttacaatatattcaggaaactgacattttgcttgtgtttataggttcaggagattgtttgtcctattctcaagctacacatacataaatgtgctccaaaaaatttgaagtttgttgtcgtgccaaagcaagcaccttccggctcagattgtcaaatgcctgtacatgcagagtgccagagtgtaagcgggaagcttctctgaagaaagacaacaatgttgacattggatcaggaattcgaaagatactgaaatgtgatgatgaaatgcaacagtttaggaacctttgtgattatatgccctttatacttgtgttgtaggccatcgattgtgttcatagagttagattggacctctgtatcctcagctagtttctcttgcttgaagagttattgccgttgttggacgatcaatctatattgcagtgttacacaaggtaactgatgaactgatattactatgctgtcgctcaagctgtattcaagccagacaattttgtcttctttttgagctttatggacttgattgctaactactacaattgtagattgagaatttgagttttgatcaagaagagcggtaccattttactcctgaaagatataagctactcctccgtagcattttttttcctgtgaaactaatgcctttgcaaacgagacctacctttttgtgccggcaggagtacacaatctcgggccctgtgatttagatgactgattggatttttgtcacagattatctacttacttaattatagagataaattaagacttctataacaagtggtctaagcaatgcatagaagatttttttttttgaagtgtgaagtaaataatctgtttcaataatccggtgagtaatacgtaatatcaaaagaacagaggccggcgtgcaaggttgttcagaaccatctgttcatccatgaagtgcaagtactgcccagcccaatgccccaagagcccacagtacccttgtcagaaatcacgagtagtacaagggcttgaacacaaaatgacccatttgaaaattcgacctcctccgctttggcgttgaacagcaaatcgcgtgtcaaaactcaaaagcggacagaattagaaacttataaaatctctctcgctgcctccacttcttcttcctcctcctcctcctcagatccagcaatccgcgataccaccattagtaccattcgaagcgccgccctctactcgccggagaggaggaagacggagcaaagggagcgcatcagataagcagaaggcatggggctccccggcgccgagccgccggcggccagcggcggcggcctccctggattcttcggcggcaagagcaagtacgtccgcatggacgacgtgctgccgcaggagcaggaggaggacggcgtcggcggcggaggcggaggcgtccgcgtccgccggagccacagcagcaggcgctacgtcttcgcctgctctgtcttcgcctccctcaactccgtcctcctcggctacggtaactaatctcctccgtttccacatgaatctctctcgcacgtatatgtgttcgtgttggctgaatcgatggagaatttcgatacgcgtgcttggatcttggcaagttcttggtgatcctgcacaaggagtaggaaatgttttggccaatcgcgttgactatttcttcttcattagtcttcggtctttgatggcgactctccagcttattccatgtctgttacctt

SEQ ID NO: 72503 - DNA, 17222 bp, Oryza sativa
ggtattcctgggaatacataggcatcactgtagctccgcccctggccgtgaaatcgggggagattttctttttggttttttgtcgaggataaatcctcgcgtttttctcttttaatttccctcgtgtcatgtatagtagtactccaccaggacgaacgatacgatagtagtagtacgattacgcgtatccggtcggtctcatccggagagcggatgcgtgggcggcgcccgggatgagagtcccgcgcacatgcgtactgtacatgtaactacgacttgttgtctgtctcctgctgctacgtgggtctcgtctctctctcccccgtcttgatgtggatctgccagctacttcttccgtggtttactgcttcctcttgtgctacttcttctcctccctcgaccttgtgcactggcgattggtgatggaaggcaagaaactatagcgcgtggtaaaccgtaaacactccataaaattcctgttttatggcaccattcaggcaatatttattcctttcatcctaaaacacggctatttaatattggcaaattttgttacaggacatcgcaattgtgtggttttagctcagagacaccgcgaaagtgaagacatcccatgatcgtggatatttgccgatagacaccgcgccgtctgccatgctgacgtgtcgacggaggccgtttttttgacgcggtcgaacgtaaatacccctgtgcaagagataataaggttacgtggagaccacttgacaatgtctccctcctcttctttttcttctctctcgatttcttctcctctcgatctctcctcctcatctctctccctctcgtttcccttaatccccacgtgcgtgcgcgcccgagcgggatgtggcaggcgcatgacggcgcggccagcgaccggccgcagtggctcgggccgaggcgacggtggcagcctgaaggcggcccggcggcgtcgggtggatggggaggcagcgtggcggacggcgacagcgtcgggcaacgccggcggcgaacgagccgccgagcaaggccatgggccacgccgccgtgacgaaggcggacacgggcggcacgtcgcggagtgcgcgccagacggtgctgttgcacttgaagcctgagccgaagctgatctgccagacgcggtggccgcggtagacgcgccccttggcctcggcgtaggcgagcttatatcaaagcgagctgctgctggtgttaattgcacattaggctcaacatcccgacctctctctttgatttcctgcatcaatcaagctaagcttggttaattaattaactcacagattattgtatatcactcattattgtttgttctagatcgatcacttttgtgcgtgcggttacctcgatggtggaagcaagagcaatggcagtaggcggcggcggcgtgagccagatgcagccgtcgtcttcgctccaccactcggctaccgcctgaggcagcagctccacttccgccggcaggcattgggtggatggggagaaaaggccggcgcagcgaggaggtgccggggcagcgccgggcagaggaggccgaggtggaggcgttgggtggtcccggaggcggcgcccgtgcgggccggcgctcgcagtgtggttgtggtctcgagcaagacgaagacggcggtggtcgcggtggcgattcgttcggccgagatggaggccggaggtgctgacagtcgtggtggcgaaatggcagtggcgcgggggtggtgctcgcgcgggagatgtggccgcgcgtggtggcagcggccgagcggacggcttggcgcggcggccgagagggaaaagtggtagctggccccggtggggagtggcctgacgggaggccttttttttctgacgtggcacaagggtatttacgtccgaccacgtcaaaaaaacagactcccgtccgccacgtcagcacgacaagtatcctttagacggcgcggtgttcatcggcaaatatccacgattataggatgtcttccgccaaaactttactttcgcggtgtccttgagctaaaaccacatgattgcgatgtcccgtagcaaaatttgcctttaatattaggctgagttctttttccaactttttttaactcatcttactcatgttccgtgtgcacgcttttcaaactagtaaataatgtgttttttataaaaagtttctatacaaaagttgcttaaaaaattatattaatcaatttttttaaacaaataactaatacttaattaatcactcgctaatagaccattacgtttttcgtgcactacaaatgtgtttccaaccagtggcggatccagaaaatcgattcgttggtgtcataacgtgtctatcggtgtcatagcatgctaattatgtttatatcatagtgttataacatatggataagtaatttcattatagattttgctgaaagtcgtcggtgtcgcctgacagcggccattctactgtagatctgcccctgtttcctaacctgggaaacgaacacaaccttaggcataatgtgtattactactacgaaaaggagtttggacaaaaactcttatgaaaaaaaatgaacatattcgactacttgatacagtcatagagcagtatagtcaggaaattcattgttattaaatacataagtcattctacatattaattagctgcattgaaaaaaagtaggaaaaagtacacgcaaggtccctcaacttgttagtgccacgccccgaactagtcccgaccggaactagcccgtgacgctccaaattaacctgttaatcgataccagtcccaggaaacagtgctggtatcacaggaagacagagtatcacagcaacagaggtctctttattatagagtaggagtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcgtcagcgggatccgcttcatcttctttagcaactgggggggaattatttatatagagcaagggtgagtacaggagtactcagcaagccatggaaaataagtgtttaatgcagacttcaaggaaaggctgttgtttttgcaattgattttatttaaactcttttctgaaacaactaagtgagtgcttctcaaacgacacggatgagacaatgcgtctcgttcggtcggagtatgtgcaatgtatcagtcttttgaatcgatctaggttggcacccggccaacaactttcaaacggccacccgggcctggctgatcccatcagccgcagattttccaaacatcaatcccaaaccacatccgcaaatttcacaaagcagtagtcaaacaaaactgcgctaggaatcacctcacatccgccatgaccgtgggcacggctgttcgaacagtttaataacctctgcagagggggtacactttacccagacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggataaaatttcaaggaaacggtccttaagtgcaagagcgggaaaccgtacacccggtacgttccctggtccgcggttttggagattcatttagttcgcaagcaccaacccaggtgtcgggttttccaagtcttttgtaaaacccaagttttacccaagatgtttctcagattttaagtttgaaggcgaccatcgatacccgtgcagagtgcacgaataccgaggcgcaactaggtgggtacaagggaacatggtataacaattacaaaggaaggatcagatgcaacaagttaggtgggtccgccaatctgccttgcagacgggacaagcagattaagtgcgatcctatcgatgcataatatttttcaagcaacataattaagttcaaatataggctcaagatgttcaaaggtggcttgcctcgctcgagatcttgagcttgatcttcgaaatcctcgcactgcgggtcttcgggctccgaaactacacgcgaaacgggacaactcagcaaacggcgaaaataaagccttattattgacctctaagcatgccattagatagatctcgagatttgaggaattttggaagttgaacggagtcaaacggacttacggttgggaagatattgaatttctaagattattggatttttggtcaaaaggaaaaggatttatttaaatcctttttgaaaaagaaaagaaaagaaaagaaggagggagggaaattagacttccctcgggcggctagggcgcggcccgagagaatggggcggctcggcgagaagtggcagcgagggcggagggcgctcggctcggcgcggctcacgcgcacgcgtgcgcagctcacgggcagagcggggggagagggagagagagagggagagagagagagagagccggggagggagggggagatgggccgagaggagttcggcctatcgaacccaagggaggcaaaatagacttttgcggagggatttgatttgggaaggatttggattcgggattgaactcgatgatagatcggggatttgagatctgagatggcacggacactagacaacaagcaaagaaacggatttcgcaaatagggtttttaagagatagtttttcccgctaggcgccacgacagaacgggcgctacagaccaccccccctaacaagaatctcgaccccgagattcagcacctatgggagtagctccgggaactcggtgcagagaagatcttctcgttcccaggttgcctcatcttcagaatgattgctccattggaccttgtagaacttgatagtcttccttcgggtctgacgttctgcctcttcaagaaccttgatcggcctttccttgtaggtcagattcttttccagctcgatattacccaggggaacttgttcttctggaactcgaagacatttctttaactgggatacgtggaacacgttgtgcacatctgcgagaccttcaggtaactcaagctgataagccacttcgccacgtctggcggttatgaggtaggggccgatgtagcggggtgctaacttgccggacatcccaaacctcctcataccacggagaggtgatacccgcaggtacacatgatctcctttttcgaactcaaggtcacgcctccgattgtcagcgtaattcttctgacggttctgcgctgtctttaaacgttctcggatcagcttaacttgttcttctgctgccttgagcatgtcaggaccgaataccagcgcttcgcccacctcagtccagcacaagggagtgcggcactttctaccgaacattgcctcattcggcgacacctgaatgctggcctgataactgttgttgtatgagaactcagcatacggcaaacaacgatcccaagtgccttcgaaatccagggcacacgcacgtagcatgtcttctaggatttggtttaccctttctgtctgaccatcggtctgcggatggtaagctgtactaaaatttagatcggttccgagagcttcatgcaactgcttctagaaccttgaggtgaactgagtgcctcggtctgacacaatcttcttgggacagccaaatctacatacgacatgggtcatgtagagttctgctagtttctttccatcaaaggtggttttcactggcacgaaatgagctgatttcgtgagtcgatccacgattacccagatggagtcgtacccgctaggattaaattttttatagcccgttcaataggattaaattcttctagtctttaataggattatcttaatttgtattaaattcttgctttaacacgtcgatcatattttgttgaaaatcatcatatttccatctttttatattatgtgttttctatgtaagtctaattatttaagatatctaatctcaaaaaaaatatttaagatatctaatatttttaaaatactgattatttagtctcatattcaacttaaacaagccatgatccatgtcgaaacaagatttcgacaataataaaagggggtggctatcaagctaggaaagtggatgggtttgtagacaaggaattttatacaggttcaggccttcttattcaagaagtaataccctactcctgtccggggatgattccgccgagtgtgttattgattgtatgattgggagaaaaaagaatcgtgccccaagaggcacacgtaccctccttatataggggaagggatccgtaatacaaggtacagtctatatcctaacggaatatgggattacagataaaatacaatcgtaaccgactaggatcccaggtactttcttgacatacaagtttagaatctaacccgagtcctcataaagatattctatctatatttggtactgtatatccagctggaatataaccgccatgtagatatgggataaccatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatctccacaggcgctcaactggggtataagccaggactccacctaagacatcttctccaaagcttctcttactgaagaggggaaagattgagcaagaatgagtacaaccacagtactcagcaagccacaccggcagatgcatgattaatgcaagggggtacaaggggtaataatataggggttaagttttgcagaaagcagcatttaaaagtcacttagttgcccaaagccattttataaagacgatcctagagctacacagtattattaatcaaggccgtgaaccctcacgaacctgccttaacccaaggcctacgatgattcagaccgaactggcaacccgaccctgggtcctagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcctgagcttaatccttatagtggccggggtgctacttcccacaactggcatgcacccaaaccccaccaaaaaacaggttttaggggctttgaaagaggaagagagggatatgtccaattccaccataagccaaccattccatagtgtccagatgatatgagaattcccaaagtctaaagttatataaccacctaatgttgcctaattaaccagcgaagcatctgtcgcgtcccaaatcgactctaaaatacatcctcgaaattgtgcaaagaataattaaaattcatgtgaaagcctccaacaattaaaatgtgcaaatgtaaaagtcaaatgaggcttggaggatttttgtatatttcctaaaagcctaaaatgcgtaaataaattttagtggaattttcagagcacaaataataattgaaaagaaataaacaaagttgaaaaggtttataaaaagaaaaaccctaaaagaagtcttctttccccccttttccttcttgggccggctcggcccacttctctccctccctctctctcttctcccctccggcccatcggctcctccccgagcgcgcgccgctgacaggcgggcccgcccgccaccctcgctgacgggtggggcccacctgtcatccccaaccccgcgccgcgcccgccgccgcccgtgccctagcgccgccgccgccgccgaatccgccgcatcccgccttccccgcgcgccataaagaggggcgaattactccccgtgattccctctcccgattccccctcttttccctctctctctccctcggattcgtccgatttgaatcccgaaatcctcgccggcgccatcaatggagcccgagaactccgcgcccgtttcctccctctccggccaccctctcctcctcccggtgctatttaaacgtcccccgtgctcttctcctccgtttccgccactcgccgctcactctccccgtcggaatcgagcccgcaccatcgcaccttctctccgccgtcgccgccgtgctccggttcgccaccgccgtcgctccggacttcctccccactcggcgtcacctccttcggcttcgccgcgttcccgtcgacctcgtccgcgcctccgtttcgctcgccgaccgccggagcaccgtcgtcctcgccgtcccgaaccgcgccgccgccttcttccgcttcgaccgccgttcccgtcgtcgccgtcgaccggggtgagccgaagaccgttcctttcgcttcccccttccctcctctctctcgggtgccgctccgccgcgccggtggtcgccggcggtgaccatcggggcgcgggcgtgtccccctcccgtcggccgtgccggcgaggctgccttcgggcgcgccctcgcggctgccaggtgggacccggccgtcagccgcccgcgccagcgggtgcagctgacgcgtgggacccacggcgccggccgccgccagccgcgtgctcccggtccaccgtggaccgagaggctgacgcgtgggccccactcccgtggacccggtccgcgcgccctctccctcggctgacgcaataaatgagttttttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagccttttcttttccgttggtcgtgtagacgctgcagcttcggaagatccgctcttcgtggaagtcgaagccgtcggttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactatggaattgttggattattgtggaattggcttcacaccgccccctctattcaaaatccccaaaagtggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattgaagatggatgaagtcgggggtcgatggacattctccagggcaaatgaaggctacacgagctgcggcccggtagtcgagatgtcatatggcagagggttggtgccctgctgctaggggctcagtctcgcctgcctgtcccgggggttccggccgtaggcgggattgggtcggtactcttgtctatggctaggatgggttggaaactatgtcacgtcttccgtccgtatatcgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctaagatcgtgtttataaaatagccctgagcaactaaatgtctttaaatgctgtttactgcaaccctaacccctctatgttataattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccgcccttgaccctaggacgagccgtagatcccaagccttagcaatattttcaaaaataaaaaaaaaatcctttgttatttgtgaaaactgtctagtctctctctgtcttgctgcttcacttatcatcaaaatctgacctttaaaatgttgtttctctttttgtttttgtttgtagatggccggcagcgtcacccgtcgtggtttggacatgactggcttcgttttggagctgcgaggcatgtgcgtggtcctggggtatccacacggagaggactaccaggccaggccgcttccggatcaggagggagatgacgcggagccccacgctgggtgggaggtcaccgcagtgatcctctctggctcccccgagcggacttcgctggcagtcaccgcgggtggagactccttccccgccgcttgccagaacgccgctctcctcgccatcggcacccttcaccagcgctacccggacgagttgcagcactcgccctaccgctaccaccctcgtcgcggaggagcccgcgactacgccaccttctgggatgctagctcggaggatgacgctaccatcgtgcacctggcacgcatggtggaggcgtacgacgcggctcgtatcgacttccatcagatggtacgccgcgggatggtcgagaacaacatgaagatcctggagctgcgtcaggagaacctgcagctcaagaaggacctcgacgcagtggaggcgcagctgcaccagctcaaggtcgcccagggagagatctgccgccccaagcgtcgccgtgtttgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcagtagacgagcagttagtaggcttgcgcgtgtgttctttctcgtttgtcttttttggagtcgtgtggggcatggttatgccggtgtgtggcacaactatgtcggagcctgtcttattttatttgcctaagcaacttgaacattaatgaaccaatttaatagcagtaataaatttaagaataatggtagtcgtgggtggttagttttaattgttagctctctctctgcttgctggctctgtgtggggttttcagatggtgacgaccaggagaaatgctgttaccggtgatggcaaccaacccgaaggcagcaaccccaaccaccagggcaacccacctccacctcctcctccgcctccaccaccaccaccagacaccaacgccattctcacccaaatcctcgcccagcaagccaacatgatgaatgctttcctccaccacctccaaaatccgccacaacagaatgctccaccaccacccccacaacactctaaactcgccgagttcctccgcatccgcccacctaccttctccagctccaacaaccccgtggatgctttggattggttgcatgccgtggggaaaaagctagacacggtgcagtgcagcgatgaggagaaagtcgtcttcgccgcccatcagctgcagggacctgcatctctatggtgggaccacttccaggctacgcagccagagggacagccgattacttgggctcgcttcaccgccgctttccggagaacccatgtgcccgctggagtcgtggctcttaagaaaagggaattccgagagttgaagcaaggcaaccgctccgtgatggagtatttgcatgagttcaacaacctggcccgttacgctccggaggatgtgcgggaagatgaggagaagcaagagaagttcttggcaggaatggaccctgagctgtccgtccgtctagtctctggggactatccggattttcaacgactggtggacaagagcatccgcttggaagccaagcacaaggagctggaatcgcacaagcgccgcttggcgaatttccgcaatcaacagggtgctaaccaaagggttcgctacaccaatccctatccagggggatcctcctcgcagcagcagcaacagcagcagcaacctcgcccagcgccccgacctcaattcgtggtgcgcgtcccacagccgcagcagcagcagaatcagcaagggactcgtgcgccccgtcctcctacgccaactgtgcagcccgttcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggaaaaatcagttgggggtagaaaggcttagaaaccctctgctcatcaccacccctggaggggttatgacagcaaagttttatagccctgccgtccctatagaaattcaggggattccttttccctcggatctgattctgctagacaccaagaacttggatgtgattcttgggatgaattggttggcacaattccaaggagtagtggattgcgcgagacgcactgttactctgtaccgagggccggaacaaccggttgttttctttgcacccccaacctctgttagaagttcagaacttcatcagatagaactgtcagaaattcccatcgtcagagagttcggagacgtgtttccggaagaactacctggtatgccgcccaagcgagagattgagttccgaatagatcttgctccaggaactactcctctgcacaagcgaccctaccgtatggcagcaaatgaactagccgaagtaaagaaacagttggaagagttgaaagaaaaggggtacatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatttgttcgatcagcttaaaggtgccactgtattctccaagattgatctccgttccggatatcaccaattacgtattcgtgaagaagatattccgaagaccgcattcaccacgcgatacgggctgtatgaattcacggtgatgtcgttcggtttgaccaatgcacctgccttcttcatgaacttaatgaataaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacagttacccaagtccgcagtttcttaggtttggcaggatactatcggagattcatcgagaacttctccaaaatcgctcgacccatgacacagttgttgaagaaagaagagaaatttgtgtccagcccgcaatgcgagaaggcgttccaaactctcaaggaaaagctggtttcctcgccggtgttaatcttgccggatactcgcaaggacttcatggtgtattgtgatgcttcgcgccaaggattggggtgcgtgctcatgcaggacggtcatgtggtagcctatgcctcacgccagctacgtcctcatgaaggcaactaccctacacatgatttggagttagccgcagtagttcatgctctaaaaatctggcggcactatctcattgggaatcgctgtgaaatctataccgaccataagagtctgaaatacatcttcactcagtcggacctgaatcttcggcaaaggagatggttagaactcatcaaggactatgatgtgggaattcactatcatcctggtaaggccaacgtggttgccgacgctctaagtcgaaagggccattgcaacactcttaacgtccgtggcattccacccgaacttagtcaacagatggaagccctgaacctaaacatagttggtcgtggatttttggccgcgttggaagccaagcccaccttgctcgatcaaatccgcgaggctcagaagaatgatccggacatgcatggactcctcaagaatatgaaacagggtaaagccgctggtttcacagaggatgaacacggaaccctatggaacggaaatcgggtatgcgttccagataaccgagaacttaaacagctgatacttcaggaagctcacgaaagtccttattccatccaccctggcagtacaaagatgtacttagatttgaaggagaaatactggtgggttagcatgaagcgggaaattgcagagtttgtggccctgtgtgatgtgtgccagcgtgtcaaggcagagcaccaacgaccggccggacttctccaaccactccaagtacctgaatggaaatgggatgaaattgggatggatttcatcaccggacttccaaaaacccaaggcggatatgattctatatgggtagttgtggatcgattaaccaaggtggctcgatttattcttgtgaagaccacctatggagggaacaaactagcggagctctacttcgctaggatcgtgagtctccacggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcaaattctagaagatatgctccgcgcatgtgtactagatttcgggaagacctgggataagagtctcccctatgccgagttctcctacaataacagctatcaatccagcatacaaatggcaccatatgaagcgttgtacgggcgcaaatgccggacaccgctcctgtgggaccaagttggggaaagccaagtgttcgggactgatatcctgagagaagctgaagctaaagtcagaatcattcgggataatctaaaggtggcacagtcacggcagaaaagttatgcagataaccgtcgccgtgacctggaattcgcagtggatgattttgtgtatcttcgagtcacgccattgcgaggtgtccacaggtttcagacgaaagggaagcttgcacctcggtatgtgggtcctttccgtatcgttgctcgacgcggagaagtcgcttaccagttggagctgcccgcctccttgggcaacgtgcatgatgtgttccatgtgtcgcaactcaagaaatgccttcgagtgccatccagcagaccgactcagagcaaattgaagttcgcgaagatttgacctacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaatacatcctcgaaattgtgcaaagaataattaaaattcatgtgaaagcctccaacaattaaaatgtgcaaatgtaaaagtcaaatgaggcttggaggatttttgcatatttcctaaaaggctaaaatgcgtaaataaattttagtggaattttcagagcacaaataataattgaaaagaaataaacaaagtggaaaaggtttataaaaagaaaaaccctaaaagaagtcttctttcccccccttttccttcttgggcc

SEQ ID NO: 72504 - DNA, 10251 bp, Oryza sativa
  unsure (1)..(10251): unsure at all n locations
cgcgagtgagacntcacattgttacagtagctcatcatcgagaaaatttcacaaaactgcttaggctgtgttcttcccccattttcccaacccacctctcttgttttccgtacgtatgcttttcaaactgctaaacggtgtggtttatataaaaactttatgtatgaaagttgtttaaaaaaatcatattaatctatttaaaaaaatagttaatacttaattgatcatgcaataaaatgaactttgttttgcgtgccgaggaggaggggttcccaaccccctcctccgaacacagccttatttggtaacggatttgctaaaataactactcccaaaacttccaaatttgtgaccatcggatcgtcctacgatttgtgcatgaaggaaaaaaaatttcacacatatcacacgtaagatcccaatattagctaactaaaccatagttgaatgcaagttttatataagttgttatatctgaaagtttttgactcaaaaaatttgtggcaattctttagatactccctttggcaaacaccatcactttgtataactttagctggctatttttcataaaattgtaactttagcaacggaatttatcatataactactaatttatcccctatgtgtgtaagactaaatatagcaaatacacccgccagttctaataccccgcacacacctatgcaagtcaaaacattttgctctaacacccacaattgtcatgggtacaagatttcctccgtacctggatccaccaccgattggaatgggaaatggtaagagactgatgtgaaggagactagagatgtgatgagagtgtgactcctcaatcccgttttccctaccccctataaccgcatgagccccgctacctcccttgtcttgtcttggtcgcatagcaactcacgagcataatgagtcatgagtggttctagccgccaccacgagcactgccttttacttgcggtttgtgtggcaatggagaatattggtaggattgataggtggttaggtgagatgatttcatactaagatttggtcttaggccactgtaattttttttcgctagatctacgagtgttttttacccatggtagacgggacgggtgctcatagaatggacccaaactcatctacctgatgggatatagttttgcccaacactatacacatgattataagaactggactatataaagctactaaaagagtaaaaacctaccatggtcacgggaccacatttctagtatgacatatacccaatttataatggacagtgtatgtggacttaaacttgtcacacaaattaagttgtatctttctttttgataaaaccatacactaatattgcaattctttaaaatacgtggataacattgtagcaaagtgatagattgataaaatagatccagttttctgaaatataccatatcctactaattattttttcgtctttagggtgctgaaggttttggtttccatcacacggttgaaaatgttttggctttcaaaaaatgaaaagaaaaggtttgactttaaaaataaaataaaaatatctgggaaatgacacatgtggggaggggtcgggatatgaatactcttaccaaagaaaatagaatctaacgataggctgagttcagaacttcagatttgatactgaatgttatagcataatagcatgtatgaagtttcaaatctatctatgtgaatgtgattatgtatgaacaatgcctctgcaaatgggactttttacatggtctcgggcgaaaaaatataaaatatctaacataatgtatgtatcttagtatctaagattgtatctatcttcaatcattagagtctgagctatcaaaatgatgatccaaaacagcaggaaactgttgctcctgaggatttgactgggatgatgggttattagagttgccattggcttgagatttatttgttgccttcttttgtgaagcaccaacctccttgcatgccttatctagcatcaccagaaaatctcttacaatgacgaacaggcgaaaaccgtcatctttctcatcatttccatggaaatatcgaatcgttctcttcactaacatcctcaatctcttgtcttctttcaggagaaaattggtctcagtctctgcatgttctatgaaactttctaacgagcggtggaatccactgttctcttctagcgatgccatgtcggagttcaggaattctttggctctcaataattcgtgtcgcagatttgccacacttgtagacaaagcatcagcatccagtgctgctactctcttgacattgtccagctcattactaagccctgatacaatcttaaggccaaggttggagtagtaattgccatcctcctgtagagattcattggaattgtcatccgaagtactaggaaatggtggacttcttccattttccatggcgagtcttgcttcgcgaacaccttcagatcgaatgatctcttgaacaacaaagtgcagcaatgtggtcttcccatcagctcccttgacatctgataacttaagaagagtgtcaagtttgaacgcgttagcaccaccacggaacgtcccatcattcaaacgatttccagttttgagaatggcttctagtagtttcagaaaaaggcggtgcttgagttcaccgcaagcagcctggcacaaacagataaaaaactgaacacttggagaaaaaaggttggaatacttcgcagatttaatacagaagtcaactactttcagatggattacctccaattggaggaatgattcccttagacttgaagcatcttcctgcaaagaggacatgaaaagcaaagctctaatcctctcgaaagcaaaaggaatatcaattagtgccttcatcacttgttctgctaggcctagctgcgagcagtccccattataaagcctgagtttctgttcctcctcatcagtcggtttcatcctcaagattgtctcaagaagtaatctaggaagttcattcccttcataacataatgtgacagaagacaatgtcagaagtatattgaagtgaaccagcacagcatcaactttgtgtgtactacttagacctcaacagctacatctagtgaacaagagaacatatgatatagtaaatgaccaatgcatacacaatatgaaacatgttttcactgtgattgcctgatatgaaatgagatgggccacaatcacaaagacagacaagaaactaaaagaggatggccacaaatacatgtgcttagaaatgcacagtatatagtttaataagtaaacttgctatagttgcagtcgaattcttgtatcagttaaatagaatgcaacgagcattccattttttcaaaaggctcatttataagtgcaatgttatctttggcggtgcaaacatattgtatttacagcgataatggaaactttaggagctttttttttttttggcaaatgggtaagtaggctgcatgtaaatatatgcaatagttcaactaccttcaaccagagcatcatgaatttcctctgccctcacattcattgccttaaaaacaactgccagattgcatgatttcttaacatcaagaagagaaacatgctgaggtgaaggatctgcaatggaaatttccttgtccttgacattgttttggttgccagcaccataaccaaacaattcttctatcatctcctcgttcacactgcagaatgcagtcgtcagttgcaagcctaaatgaacttagaatacatgccattgctaaatttaaaaacttactgaaaagaaccaaatttgatgtcatgccaggccattgactgatcaggattagcaagaactttatcccaatagaaaggccggagcttggctcttggagcattcacctcagtttcagacgattcactggccagctcgcttgcagatgactcttcagaacgacttgactctgtaggtgacagcttaggaaatcttgccatggtggctttaggaggtgcaggtggtggagcacccttcttgataggtggaggcggaggaggtggacgcggaggaggtggagggggaggtggaggtgtaggtgaagaaggtgggggtggctgaggcatcagtttaggggcatcacttgtggcattgttctcctgtgttcctccagttactagtgtaggtgttgtggcatcacttgaggttttaaaacaacatggaaagcacttgctcatgcttacaccagcattggatggcctaaccccatgatcatccttatgaagcgggctggcaggaacatgcacatcaggtgacgaacctgccattcaaatgatagatgatatactaccataccaataataatctaccatgttgatagaagggatgtatcctcaccaggcaagttagagaactgcaagtgaagaagaggatggtcatctcgttgctcgccaaccgagaccttgcttttgttgcatccacagcagtagaaacatagaaatgcagctaggaatgagagtgcggctgttggaagaacagcgatcaagactactttcatgtagtcatgatactcctctgaaggtgaaactggaggtgccactccctgatgcttgtgtgcagatttactgggataatatgggctgggaggttccatgttcagagagttggaaggtgtaagtggtgcctccgccacagagaggggagagtgaacttcaccgccagaggacatggatggtgcgaaagctggagccatggaaggagcatctccgatcagtttatctaccaaacgccgtctcggatagaagtttgaaccgaccaatgatttctggctctcaagatagttgctcagtgcaacactgaatatttgtggaacacccaggctgaagcagtttgcacggatacattcataagtaaaagaagatttctcaggtggaagaagagccataagttccatgaacagtgttgccttcagttcatcttccgtggaatgactcgataactcatcccaggcaaatgattccccaaagccaaatgtatcctctgggctaactatgtcttgtaagcaaactgaccatattttgtctacctgcatcacagtaaggattatttgttaatgcatcaagctatctgttaaattgttctcatataatatatatgaactaagtaaaatttactgctcatcctgattgactaaagtgagcacaataaagatcaagaaacaatcagtcatatttctgttataacgaaatatactaaacataacaacggtaaataacaaaaaaggcctgaatgcctcactttcaagaagacaaaatggaagtcatattcgaagttcttggcagataacaagtccaaatcaagcaaagtaaactagagctattgaatcgattacttctatctagcatgcaaaggagaaggtttatggacgccttacgagatccccactgagaaccaacgaagaggcagctggtccagaagaaagatggcgccgccatccatagaacttccccaacttctcctcccctcctcctcctcctcttgacgacttcaccaatgcagatgccgccacaagcagcaacagaaacaccactctcttcatagccatcttcccccctatttccctcgaaaaaggaccatctttttttttgccttcaaagatgaagaaatctttggggctgtgcaaaatgagatttgctccaagaaatggccgcggagaaggatgtgtatctagaaagagctcagtgctatcttagcttctccttctccaggagtcaaatcctattgcttcgtttaccactattcattaatcagaaaggcaataaaagaatcgaagtcgtagatactcttactttgaaagtcacacgagttaggccacactgatggctcaggagtcggcaaaggagaagaggaggtggtgactgaagcaagtgcacctgcgtctgcctgcaaagatggaatttttttatgctgagagtgaggtctccctctatctatgcccattattagtactcctattttttaattaattctttagtaggatcggatttagatttcaatgcgattattaaccatttccattcgtgtcgccatgattaataatctcttttctttttgttttcttggtcttgccaaatgcataggaaaaaaagattcggcaaaattccaagtcgacgcagtagaagcagtggcttcgcttggagaggagaaagcaaaagaaaagacgtggcctttatctgttcggcgaaggcgcactcgagccaaaaaaaaaaacaaagaaaaagcgtagaaaatgcggtgctcttgaggtttcgcgccgaacttcactgcacccgtcaccgcgcggccgccggagacgaccttcttcttcgccgncgncagcctcgccgccgctgcacaccgacttgtgggccacgaggagaaagcccaccttgtcaattgggcccacgtgggctacggcccacccaccaggctcgtggcgggggcggggcccaccgggcggcatgacacgttgcgctgctgtgagctgagctgagctgccggcgacgacgacctcctcctccgccgccgttgcctccgccggcctcgccacggccacacactgacttttgtgccacgaggagaaagcccaccttgccgccggtgggcctcacgtgggctacggcccaccaaccaggcccgtggcggcggtggggcccaccgggcggcacgacgcgttgcgctgctgtgagctgagctgccatgcgaacgtggactgtgctctggaggcatcagagaatgtggctgcgacgcggagcggagatgccactcctctactaaaataacccaaaaaaggtaattaaaaaataattaaaatactaatagaactgtgcttgcaaagaggtcaaagcccagggcggctgcgctgtggctacgccggcttggattggagcagacttcacctgagtattcgggatccccgcctctcctccgcggccagttcatctcgatcaggttggtagtattagccttggtgattgcttggttgtttttcatgtggccgcaaagagatccgctgctgatgcggtgcttatgcggtttattggtttggttaggttaatcatggctatgatctctgcggttaaggcctaataggggtaaattgtttgcttgtttgattggtttatggctggatttgtagctctgtgtcacggtgaggtagggtttggggagctgggtgttcgccctagtatgacgggttctaccagggattgataaatgaatggattctgcaggtttttctttgttgattcctttataggagtagcctagattcctagaacaccagatcaatcgtcgtgtgatcgaccttcttgggatgaatcactgcttagtttcgtagtccttgtcattttggagtatgttttgtttggtgtgattttatgtttcttaccaggaatgcttggtgggtattcaaagtatagtgaaatggggaatcctgaattttttttactaaattcgtaatgctatcctaaatttgggaatgtgcctgtaaataacttttattactccttaatataaagatacgctccttgcatatataaaaaaagaaatgtgaatgcgcatttacagtgaattattgttttcaatttaggttacctttggacgattggatctacatttgcgttatatgtttgccctgattcggtttgttcattttctgttttgttttcaacaggtaacactagaagatatttgtccttgaaaaagccaaattatgtgctagtgcaccggaaagctttgctccaactgtcccgttgagttcaaataagagcagtgcctgcatgctgttataatgatttttttctgtaccctggtttctgaaccactgaagatcggggcattatatcttttatggacacgaccttggtggtgatagtgttcatttagtcatttataagctctcccttttgaaatatattgttctataagtagtgcctagaggattttcttgatatagattgctacaatggatgagagaaggacaatttcagagcgatatccttagacatctatagtgaaagaagaattgcttagtgaagaattctttatccacaatatatacatacatacaataatgaaaacatcagatacatagtatgacgtttacataggttaatagtacatactctaatgactatcaagtcttacaactttataatataagggagtttgtacttatctacttattacaaccaatattgttttgacaaactataggatatcaatataatgtcttaaacacactgagattaaagcagctttatctctaagtgggacgcactgagattacaataaatctctaagtgggtccgttgagcagtattcgatgagcatatcatctattgcagaaagcgcagtggtatcctctgggagaagaacgagggtgttctctggttcaataggagcctagtgagaactttcaacctcaggtctttcttttgtaagattgaagtgagcttcaaatcttagttcctcagaagactttttctcctttagggatttctgatacaggagaacaagatgtttttgagatgcggcaatctttagtgacatgatagtcagatacacacctgttgcaatgcatgttgctattgccacgaggttgtggtgccttacccttcctatttcctttctgtcgaccattggatttgcgcctgttgttgcgtttgcgttttccagtcagattcgtaggggtattcgaggaatttcccttaaatccttttagtgcgatactattggttcaatatcttgtcctctggaaacatagttgatagagttttctctatcttctctgcttccgttggctcttatcgcaaaatatcaacttggagcaaatgttatgtacaacatgattgtattcggccacagtttaaaatcctgtaggcgtaaatgaatccactcataattagcctctggccaaatgagttccttttgctgatcataacgctctattagagctttccataggttgagagggctcgtctccaacatgtactcatatttgagatctttatagatatagaacctcagaaggaaaaaggtaatatatagttttctgttctcaactggtggatcccaatcattgggttcttaatctgtatgtgaaatcccactagaagaaaaatttattttgatatcagaagcccaaattgggtagttactcccatcgagggcgagttcggtgaactctatagttgccgtgtccctataatcatgattaacactattaatttacagaggtaaattaataaaaacatgatattgaggttgtaatctcaatgcgaaatgtaaaacttcatatcttgtaatgtttcgaaaagatgtaggttatagacctgacaatttgagttaggatttgaaattaggtggcacaatgtggataatctccaagtaattaaacagtggagtagatctcttaatagtgggcaagttatacttgctgcctaaaacatggtctccaggcaaatatattctggtgaatataccgcagccaatgtttaggactccactaccttgtgttcaatcaaatttcaaataatctcatttttcaaaacatatgctcggaaaataacacatgtgggtaatcatcatgagatgtaaacctctgtgagatgagcgagatgctcgctgcctaggttataaccagtgcggccaatttgtagggctccatcgggtaatcatctcaaaatgtagaccacttgatgatgagcaagatactcgctgcctaaattatggtcgtgatgaccaaagtataggactccatctacatgtgattaatttccgagtcaaaatgtgaagtggaacatgcattaaatcctccattaatcatgttgcacataattaagagaatttgctaaatcaaagtacaaaatttatagaattttataaattaatgaagcgagaaagtagagtgtgtcttgaaataatatgcaaaaggcatgttattaagacaacaaataaatttagtgaaacggggtatttgaataaacatctatgttaattaacacataacatcagtgatctataggaccattacataataatgtgaacaactgatgaactggttctattaaatgcataaaacatagggactaaagggtaatggctgctaaaaataaaaatttaaaacaaaaaaaggggaaattggtggggccccctctctctttcaaggggggcgccatattgattatttttcctggcagggaagcaatccccccattctatttataaaaccttggttgggggaca

SEQ ID NO: 72505 - DNA, 4390 bp, Oryza sativa
gatcacaacaggccttggaatgagatggaactacctcgcaacgcaaaagatgtacaactattctaggcttgcactgaaattgttattggaaacgaaaagaaaatcctattctggaaagacaactggctacaaggaatgtgccctaaagatatggccccaaacctctttcaacttgcaagaaggaagaacaaaaatttaataactgaacttgatcacaaccattgggtctactcattcagagaaattgacaatggtgaagtaatccaagagcttgtgcatctcggcagccttcttactcaaacacaactaacgtcagaaaatgaagactacataatctagaagagaaatagcaaaggtatatattcagcccaaagtgcatatcaattccaattcattacctgtcaacatgatcagaccttcaaagccaactggagagcccaggcattacccaagcaaaggttcttcggctggctcatcctgcacaaaagagctctaacagctgaaaatctgctaatccaccattgggaatgtgattggatatatcccctttgtagaagcgcctgtgaagacactgaccatctttttagggagtgtgatttcattagaaccacttggagcctagtggcggtagctcagggcatgcaaactgcgataaattcaaactccaccgctgaatggatgatggctttagctcatggaaccaataaggctgaatcaaaacgaagagtgggaattctgatcaaaacctggtgacacgtttggctacaaataaatgctaaggtcttcaagcaacaagagccatatgcacaacaagcggcccagcagatcggggaagacattcaagaaaatgagtttgtttttcagcctccttgatgaagtctgctctactgctttctttctttctctattgcagtctacctcctatcgtttgtctgctttctttttgcttgctgaaagttgttccgttacgtctctaataatacgctcctaagcgatttgtaactcatactccctccggattgataataccttgtcgttttggacaaggacatggtctctaaaaaaacaactttgatcattatttaaattgttaacaaatatatgatcatattaaagtattttttaagactaatctatacatgtagtcatcatatttgaaagacaaatattttaaaaatgattcataatcaaagattgtaaagtttgacttcacccttgtccaaaacgacaagtattatcagctcggagggagtagtaaatttcaccttaattaaactatataacaataataaaattaaaatagccttcacccgttgtaacacacggacatcttttccagtaaaaagaaaaaaagggaaaaataattctccgtattgggcctaacgtatatgaggcccatgctctctagtagcacctaaaattaagcccaaaagggaccgatcagttctattacgaacggattagcgaccattaattaagagagcgcgtgacggattaagcgaagcgaaccacgcaaataatactacacacgcgcgtcacggacaccacccagtcccctccccacaccacgcgccgcccaaaacctccgccgcgtttcgcaccaccaccaccgccgccgaccatggcctccttcttcgccgacgacggcgccgacgagctcccccgcaccgcctcccaccccttcgacgccgacgacgacgccgcgcccgatgcatcaggaggcgccgccgccgacgacaccggatacggcggctacgcctccttcgtcgacggcggcgtagaggatgtggaggaggaggaggaggagatcgccgtggagtccgagggggtcccgatcggccacgtctccggagggttctcgccctcgcccttctcccccgacccggagctggacggcggcgacggccctatcctcccgccgccggcccagatgggggcggaggaggggatcctcctccgcgagtggcgcaggtgagcaccgcatctgatctgtccgggcctttgccgtttcggctactgcttgcttgctttcgctggtgctagggttccgacgcatcgagcgagatctaacgcttagatctgatatttcgcctaattttcagctaggtggggcggaatagagtttgtagtgaggctgtattatcgtattatatgtcgattttagttaggatgaaacttgaacttgttgtttaggaattgcagtgattgattaggctgaggcttcaactggttctgaattcttagctagtggtactgaatttagttagtgcaattgaatctggtttggcaggagctgttgttaaatgcctttgcttgtgaggaaagtttgttagctctggtactggtatatgtacaaaataatcgctagttagcttctactcatagaacaacaagatgcttgatcagtgttgcacacactccaaaggggaattgatgtctttgcatgtgcattaaaaggctcatgtttcttgtttagtgaagttaaaacactttaagtacttgaaccattcttctctatcatcatggtgtggaaatgagcataaggccaatctcattttgcaattcacccatggtctgttacatgtttcaactttcaagataagcctcaggcttaagcaataatgcagtacacgtaacagttttctgagttaatgagcaaatgcttagtttatcttgagctatcttacatgtttcttggtgaatggtgatattaatcctaggtcttaccatgatgatggttcgcacccttactccttttgatgcttgtcttaggatgctttaattgatcttaaaatcagcttgatttgccagaacataaatcaccatttttagtgctatgccacatgggcatggaacgtgctcggcaaaggtgtgtgccaacaggagcaaactggctacttgtttgtgcttctgaaatttgcattttgtctgtcatgatcttatattctgcacttgcacgctcttctgcacctgtcaaatttttagtagtttcatgtatatccattctcagctcaaattttgtaaggtggtaatgttagcagttttactaccagtggtatgtgtttttgtgcctaatttatcctgtgcttggtataatctggtcattacaattgcaacagtatattttgcattagtatatagcgcaggtgagccacatctgatctgtttcggctatgccatttctgctattgtttgtttgcttccgtgggagctagggttccaccccttcaagcgagatccaacgcttagatctgctatcttccctaattttcagctagggagggcgtcatacagttgtagtgaaattgtcgttaaggaaatggcaagtgatcgattagtttgaaggtacaaccaattctgatctggttctcatgcccctgcagtatcgttcttcaagagctgctgtttaactgcctttgcttgtgaggaaagttttctagctctggtatacgtacaaaataatcattacttaacttttaccgatggaacaacaaggtgcttgattcattatgcgcacactccaaaggggggctgatgtctttccatgtgcaataaaaggcttatgttgatttgtttagtgaagaaaacctaagtacatgcaccgatttcttttttcagcctggcatggaaattagtgtgaggccagtgtcattttacaatacatgtatggtctattacatgtttcaactctcaagataagcctaaagcttaagcagcactgcagtaggctaacagttttgtgatttatgatcacaggcttgtaaggctagtttgtcttgagctacattatctgttttcttccagttggatatcttggtgaatcctaatatttatccagaacttactcctttggatatttatgtcctctaatgtatcagatgctttatgtgatcttaaaatgagtttgtagtgccagaacataagtcactgcttttagcgctatggttggccaaaggtgtatgccagcatgagcaagctgtctacttgtttgtgcttctgtaatgagcactttgtctggcatgatcttatattctgcacttgcacactcttctgcaccagcctatccagattttttgttagtttctcgtatatccattctcagctcaaaagtttgtaaggtggtaattagcaattttactaccagtggaatcgtgttatgcctaatttatcctgtgcttggtatgatctgaacattgtaatcacaatattatacatcttgctataatgtttttgctttggctgttctctagtaactgttttccttatcatgtaaaattatattatgttcatgatctatcttttgaacagcatcactattgtttcaggcaaaatgctatagttcttgaggaaaaagagcggaaggagaaggagctacgggcccagatacttg

SEQ ID NO: 72506 - DNA, 32341 bp, Oryza sativa
  unsure (1)..(32341): unsure at all n locations
acaccgaacagtactaggcgggcccatttggccggcaagcaaaaaaggtggggaaggggcggggttagggttagaatcctaaccgccccagcgagatttccgccgccgccgccgccgtgcatatcgccgccgccaactgccgttggtccgccgtggggtgcgccgccgacgccgccgtgggtgcgccgccgttggggggcgccgccggttccaccgccgcctcccgcacccaccgccgccaccttctccttttgttacgccgccgccgccagcctccgccatccgccgcccaccaccgccagttgggccacgaggagaaagcccaccttgccgccggtgggcccacgtgggctacggcccaccaaccaggcccgtggcggctgtggggcccaccgggcggcgtgatgacgcgttgcgctgcttagagctgagctgccgtgcgaacgtggactgtgctctggaggcatcagagcatgtggctgcgacgcggagcggagatgccactcctctactaaaataaccaaaaaaaggtaattaaaaattaattaaaatattaataggctgtgcttgcaaataggtcaaagcgcagggcggctgcgctgtggctgcgccggcttggattggagcagacttcacctgagtattcgggatccccgcctctcctccgcggccagttcatctcaggttggtagtatcagccttggtgattgcttggttgtttttgatgtggccgcaaagagatctgcagctgatgttgtgctccctgcggtttcttggtttggttaggttatttgtggttgtgatctctgcggctaaggcctgagaagggtaaattgcttgttagtttgattggtttatggctggatttgtagctctgtgtcccggtgaggtagggtttggggagctgggtgttcgccctagtatgatggattgctctgctaccggggattgatgaatgaatggattctgcaggtttttatttgttgattcctttatcggagtagcctgaagtcctagaacactagatcaatcgtcgtgtgatctacctttttaggatgaatcactgcttagtttgtagtacttgtcattttgtcgttttggagtatgttttgtttggtgtgattttaggtttcttacaaggaatgcttggtgggtattcaaaatcatagtgaaatggggaatcctgcaatttttttactaaattcgtaatgctatcctaactttgggaatgtgcctataaataattttactctttaatacaaagatgcgctccttgcgtataaaaaaaagggaatgtgaatgcgcatttacagtgaattattgttttcaatttgatttacctttggatgattggatctacattcacattatatgtttgccctgattcagtttgttcgttctccgttttgttttcaacaggtgacactagaagatatttgtccttgaaaaggccgaattgtgtgctagtgcaccggaaagctttgcaccaactgtccggttgagttcaaataagagcagtgcctgcatgctgttataatgattttttctgtaccctggtctctgaaccactgaagatcgtggcattatatctttgatggacacgaccttggtggtgatagtgttcatttagtcatttataagccctcccttttgaaatatattgttctataagtagtgcctagaggattttcttgaaatagattgctacaatggatgacaggaggacaattttgatggatcgctatgaaataggtaggcagttaggacagggaaattttgccaaggtatattatgctcggaatctcacaagcggacaggccgttgcaataaagatgattgataaggagaaggtaacaagggttgggctaatggtgcagataaagagggagatttcaataatgagattagtaaagcatccaaacattcttcagctttttgaggtgatggcaagcaagagcaaaatttactttgttttggagtatgctaaaggcggtgaacttttcaagaaaatatccaagggaaagttcagtgaagatgttgcgaggcggtatttccatcagttgatcagtggtatagactactgccacagccggggtgtttatcaccgtgatttgaagccagaaaacctacttctagatgagaatgagagcttaaaagtctcggattttggtttaagtgccctttctgagtccaagagacatgatggcctccttcataccacctgtggaactccagcttatgttgctcctgaagttcttagtaggagaggctacgacggtgcgaaggctgatatatggtcttgtggagtaattctgtttgtgcttgtatctggctaccttcctttccatgacacaaatcttatagagatgtatagaaagattgccaaagctgaatacaaatgccctcgttccttttctgctgagttgaaggatctgctatataagatacttgatccagatccaagtactagaatttctatcccgaagataaagagaagcgcttggtacagaaaatccagtgatgtaaatgcactgaagagcaaacatgaaacaggagacaaggtgtataagggtgaagccacaacctctgacacaacagaatgcagtatttttgagggaaatcgtgcgtcatcaagagacaaagtgtacactaatggtgaagccacaacctctgactcaccagaatgtagtaattccgatggaaagcaagcttcattaagcctcccgaacttgaacgcgtttgacatcatttctctgtctaccgggtttgacttatccaatttgtttgaagaaagatatggccggagggaagagagatttaccactaggcaaccggcggcagctatatttgctaagctaaatgaattggccagacgcttcaagctcaaaattaagaaaaaagaaaatggggttctgaggttggtagcaccaaaggaaggaataaaaggattacttgagcttgatgctgaggtttttgagcttgctccatctttccatttagttgaatttaaaaagtccaatggggacactatagaatatcaaaagctcatgaaggaagatataaggcctgcacttaaggatatagtttgggcatggcaaggaggtcagcaccagcaacctgagcaatctatgcaaggaatgcaaggagagcagcagccgtcacgtttaccatcacagcagccacagggctaattaatccgctacattgccgacaaaagccaggacaggctgccaacgcagttgccgcctgtaaaacatgtgaccagttgcaaataccacgaccaggtttacaatacaacttcagctgcagagcttgttccatcagaggccagagtcacaacttgttcacatacattggatcgttgttcaggtttaccctgttctagtttctccatttcgtaccatttggcttaatttttttgttccctagcttctttacatttcagtatttcttctgataattgtatattccatttttactaaggatacaaagtatatatgagtcaattttggaacatgtatatatgagtcaagcaactgtgcactacaggagtttgtttcagtgtaaccaacgatgttggccagtccaaatgtaaatttttgcatgcaaccgataccatatttgtagattgttgatggcgaaggcggcctaggaagtagataattattgtaatgtgattaaccttttgtcatcaagacctcttcacatacaaacaaatatctgggcaaattctgggtaccaaatctcactaggattcagcatcatagtctaattcttcatgtttatcattcatgcataattttaggatctaagtgacagtgtatgttcatatatgtgccaaacagtgaaacaggatcatcttctggtgcatcaaaaggaatttctttgctatgtgaggtgttcaaatgatgcaccattagcttctggccatctataacttacctttcaactaacagtcctttttccccctttttgagggcaactcgcagtcttttttttagatgaactagcagcctttttagttttagttactttctttggctgtgctgggtgctgctgacacttccatgccagagatatcaattgtcaataataacgtttgagaattttcttttccccttctggattcgttctgatattgggactatttgtaagtacttgaaacatcctgattacaatgggcacgatttgtatttggaccatagtatacagataatctgaaactttaaaactagtatattgttcagaagcctactttagcatacggctgtttttatttgttgaaaggaaattcgtgtaaattctcaacagataagtacaagctcaccaattctgcatcttccatgccctggtggcaatagcgagatgtttgcacattcaaatttggagttgtagttatttatcatttctgtgtactggacccaagactgaggtatactgcaaatccgcagttctgaaatctgtagagctaacttttctgtgggaagaaaagaaaagaaggtctttggagctaattcctcctggatgaggaagatttgtactacacgcgaagcaaaataatctcactggcacatgattaattaaatattaactattataaatttgaaaaatagatttatttccttttattaaacttctatatagaatttgaaatttggagtcgaactactttttagtttgataactttatagaaagatatagcagcattttcaacacaaaacaaatacacaataaaaatgtattcaattgtggatttgatgaaactaattcggtgtggttagatgctgctatatagtactccctccgtttcaggttataaaacgttttgactttggtcaaagtcaaactatttcaaatttaactaagtttatatataaatataataatatttataatactaaattagtttcatcaaatcaataattgaatatatttttcataataaatttgtcttgggttgaaaatattagtactacttttctctacaaacttgatcaaagttaaagtggtttgactttgaccaaagtcaaaacgtcttctagaagagactatatattttgtgatcgtggtcaaatttgaagaagtttagcctatacaaacccgaaacttcaatgcagcgagtaccacattattctgtactcctactatcgtattcatagttttacgtgttcgtttgcgacactgcttgacaaagtattagtactaggctactagcactatcaaagagattattgataaagattagttagcgcatgtaaaacggaagcatgattagttaagttccaattactacaaatttgacagatgaatatatttgatattttaaaacaacgtatatatggaaagttatcgtacaaaatacattgtttagtagtttaaaaagcttgctaacagaaaccgagataaaatcatctttaatcagaaaaggacaggcactcatattctgacttgcaaattgtaatgcagtacagtttgtagttgtactgctctatagtctgtacttgccgtgtccgcccaggttcaggacggtcacggtcatgctgtactgcctgcctaaaacttcatcgttgtattggtcaaatcatctccacaactctgaattattggagagaagcgtatgcatgattcttttgttctgaaaaatgctgcactcataagaaaaatcccatttttctgtcaagtattacatgtatgtggaattttagagagctcatctaaagtctgaactctgaattagtagtacgtactacctgatcgatcaggacgtgacaaagtacaacacatagaaattagtacaatccgaggatgctgctgcatcccatggtagtacaagcaacaccgttaggcacggtgcagatgcagtagtacaaaaggaggaggtgacctgtctgaaaagcaacacacacacacacaaatgcagtgcagatgcagctacacacgcacaagcatggaagctgcctagccaagtgatgcatcctgttcctgggattagagatttagagctaggaatattggcagattcatgatgagatcgatgggtgatggaagagaagggaaggcattattgagtgcagcgttgatgaacctgccggccggctaaattaattagcaagaaagtctgaaactggctcaaaggttcaccagcactgcacccaatcacgcctttgctctctctgaggggaaattaattagtttgtgctagttcatcagatgcacacacaatccatatccatatccataaatcttatagtactattagttttcaattctcattgtagattcgacaaagttcatatgagaaccaggggatggatgcagggatgcatttggtaagttagctctcttcactctcacaagatgcgttcttgtcccaggtttgtagctttatcacatcccttcttgtcttcaaatactgtcatctcgatttggtaattagacatgacaaaactgaaattaaggcgctcttgacttgattagtactcctttcatctcaaaacataaacataagacgtaactattttttcagatgtcttataatacaagcatgtatatatccatgcaattaactaacatattctctttctctttaatttggttttttaagtccagtctcaagatctcaagatggtactgatttttttttccaaaattagtaaatgagaaaatggagggctacaaggactccagtctactctcgtacgaagttgattttattttcggaacagagggaataggaggctagctagatctccatgcataaggatgaagatacatgtaagcggcagaacattttcacaaacgggtcgaatctgcactaaactggacatgcagatcacagagacggaagatggagcacataagccagcgatcgatcgagatgccacacagcttaaagaagagagaagagcactacactgcacagagatcagaggaagacgacgagacgagtggcatatgttcttcaggaagatgtgagatgagtatatataatataaatcagttggggccccagcagacgaggtggtggaccttgcgcagcctcacgtcggcggcctcctccgccggcggccgcgcggcggcggcggcggtgttgaaaaggggggaacgcagcctgggcgagaaggcggcggcgcggaggtaaagggagcggagggcgtagtcccagcggcagaggcccgcctggtccttgagcgcctcgacggcgcccatgctcgccgccaccaccagcgacggcgccgccgccttcgccccgcagatcgccatcccgagttcccgacccggttactccgcctccgcctccgctcggtcacagtgcgcggcgcttgcgcttgctagtgatgcgaaggtggtgaaggcgtggtggtcaggggagacgccatgtttttatacgcgagatgagcggaaagcggcgaaacggggagcgcgtcgccgccggttttggacgctcactctgtttccaaggatgctgggcggtgcgagcctcactgcgaggacacggggattattgtttgttttcgtctgtccagaaatataaacaatttttaaataattgaaatatattttaatattgcgaataagaacagtatcctatatatatatatatctatataggtcatcccactaactacaattaaaactaatttccttctccaggagtgatccacatcacctctattccacctgaccgttggattgcagatagattccacctagccgctagattgcaaatgagggtgtaaagagcgatagtgggatgcacctcttcgttttttttttaattccgatcatcatgcacgacagtaattaacaaaggggcctattcaacagttaaaccgtttgttcctgacgggtcatcttctgattgaaaccaaaacgttggatattcattcattggctcacgcagcaggccttccatcttccactgcacttgcactgcatatattccatcctctagctaaatgaattaggtgaatactcggcctttattcctgattcctctgaaaacaccatcgcagtggattgacatgctgaccacaagccctcctgtccagagtccagttgctatacttgatcgttgcgatcaatccttcattccgttagccatgctgctgcgtttattttgccgctatatatatgctcatgctccagcggatcaacatttcttttagcaatttgttgttacttattcccttaatttgttttgtataatatgagtggaagggagtgccagttgagtttccctccaattaatggtaccaatatcgaagccatacgtttgaaaaatattatttgcaggctatgaacttggtacggttgaagattatttttatttgtacaaatattcctcacgcgcagtgataaattgggttaggtttttccttttaaggtgattatatttcatccaaaattttgacatttgtaattgcttaaatttccccagcaacgcgcggggtgacctctagtactacctccgtcccaaaataagtgcagtcatgagttttcactcttaactttgatcatccgtcttatttaaattttttttataattagcatttttattgctatgagatgataaaacatgaatagtactttgctcgtgacttatgtttttaattttttttcaaaattttttcaaataagacgaacgatcaaaattggacgcggaaaaccatagctgcacttattttgggacggatggagtattataatgtgttccgttttttaaagttattatattttagaatggaggaagtaacctgtttcagatttattatcattaaatcacgttctatattgcaacattttagaatgaagaaagtagaatttatttcacatatatgatgtgaaaatttcatcctcggtatttttttttgattgaacgaataaggtctaatgtaaactaataccatatccttacgttacaataagatgtagaataatatttttcactcctttgagtgtgccggttctttttttatggataataggagaggttaaagtagtaaagataatcgtgaaaaattataatagagttttacgtaaatatactatcatgtactattccaccaagaattatatttaaacataatctaggtaaacgaaaaagacaaatgttttagtttttaacgtgagttgagttcagcatatgtggctaggctaaatttgtttttctttcttantcttttgcagtagacgagtagtagagtgcttccaaaacaaagttcaaaaagtatcagggcatatggtgtgaatgtagattgtgtggtattttatgttctcaatttgtttttaccacagttatgtgagggtacgtagaaaaatgcagtttcagtgtagaaccattttgattttttgtaggatacttggtgattgagaatttgtaggatatattattttttaaaaaaaagatatttagcgatattgtttaggctatagctccacagcatgacttttaacctaaagactctcgtgagttcagaatctaaaagctgcgttcgggacatcggtttgatcttagccaacacttgaaacgagacaaattattagcgtatcattaattaattattaattattataaacttgaaattagataatttgtttttcaaaaaacttatatataaaaaactaatgtttcggacattcacaccttctattatctgtgccttgtctaaatctccatgaagatactgtggaatagaatatgatacatcaattagttgtccgaatccaactcattttcatccttgactcacatcctaattatgtttcggcaatgctctttttttttaatttgaagttgataattcatatttttttaacatgtataatcatagcgtcattcactatttcactgataaaaatcttctctatcatcatttatcttctcgatatgtgtttataggtggcttatagcattgtacctgctctaagcggttgtatactccgttcaagcttgtcgctggtcactagctagccatgttataggttaaaaaatctagattaatttcgttttaaaaataaaaatactaagattaattaactcaaattaactgttgtttcacaggccaatttgttgtccttcaaccttattatcccgagccatgcaatcaaatagtggaagtatagtagtttgtaggtgaacggtccaaatcgtatttatagctatgtaatctcacacgtatccctctctttaatacgatattgtgtatatctgagacgtaccataaatcaaacctcaacatttaaaatcactaatatatatacaaaacactaatatgcagtcatttttcagataaattttactaaattaataaaaaaaagactaggaaaaaagtttgtgtgttgcaatggggaaaggcaattttagttgtatatattaaaccgctcacatggatgactataacgaatatgttaataccacgataaaattatgttgtatagagtactaagtttttttctagcctagttaagtcatataatattattttcttgtattatataatttacatcgaatctttagcaagttaccaattttagtttggaattcatcttaaaattgaatgatacacattttttccgatcgtcacaatccgtttttgttcgtcgtcgtccttgtgtaccccgcgacgcctttatccatagtccgtgccaatgcaaataattcgctcgctttgactcccttcctatctatatggcaaagttggctatttcttacctactcaagaagatacttactcgagaaaatagccgactagccaactatgccgtatagaaagcaggggagtcaaacggaacgaattgcacgggaatggggtttggcagtacttcgtaagtatgtacttttcttttacacgcataaatatgtacttacgtacaggattgggattaagaaggtgggattagccggttgtttcctagatacataatctagtggtaactataggtccaccggtttaagtgaaaaccaatggttaatatttgtttttttcccttagaagttataaaatttctctaattattagatctacaagctattttttttcaaaacatacatgtgtcctgaattgtggtaatttagccgtctactctggcaaagttatcttgaattttttagactaattggatgatgtacacacagctatagtgttggttcattttctgtttttcataatcttaaattattgatttaatcatgagaaatacaattattgaaataaattagaaattaaatttgtagtttagcagctatggttattgctgagccaactacaccataaaaaggagaggagactttttaaaaataaatagagagaaaaaagaggagagaagtctagggacgaataggaggggatcgttggtggttcctaagtactactctcttcttcttcttcttcaaaacgtactattctttttaaaaatcacgaatattacggaagaacctaatattaaatagttagaatgagcgaggctttgaacccaggtcgaatattatagaaggacctaataatatcaaataattagaagatgtgaggctttgaactcaggtcgaatattagggaaggacataatgtcaaataattagaatgggtaaggcttcgaatctaggtcgtctagtccaccaccttgtgaaactagtcggaaaacccttgagcgtttctctacttttcttttacgcacgtacgtacttacacacatataggttaggaaggcggtattacctgaatggtagtgatatgcatccaggtttggcggttcttatacgtacttttcttcttctcctcttgatttcttcttctttttagcgaattacactttggatcatcttttatttttaaaattttattttgaactattatttactcagtctttttaatttggattagataagtttttctttgttacattttggaccatccgaaaccacttcttcaatacggagcacatcaacaatctcaagcacattggctctaacaggccagtgaactctcctacatataaccagatcctgttaatttatccagaaaagaggctacatgcaccctcggtcaaagttttgaagggcatttagactgttttgtcaaccaaataaacaagttgttgctttgacgtttaggatgacattttgtcaaacactataaacaacaattatatgttttaaaaagtttgtaagtatagtaggtttacggcaatactaatggtcaagatcttacgaaaagtttgattagcctttatcttacaagttaaatccttatgaccggaagcatacataccattactcctactacttaattctactaatttctattgacttgtctaactcaattatttacaccagcttactgctcatagcctcacattgtcaccgcaggcatagagcaaaggacgagactacaaggtactccagctcccacagctgtttccagtgcttagtgcgtcctggctgggacttgtgtcgggagatggattttcatcctccaagtagcggtggtcagaaaaagaccgaaccaaaaagaccgagaccgaaaaattcaatcctagaaagtgaaaaaccgaattttatttggtcaattcggttagtctcaccgaatagaccaaaaagactgaattaacaaaaaaaaaagtataaatgtaacatacaatcactatgttcaataggattaaactctatttttcgcatcctacttcttctaggcatacaacctaataagagtatttactcataagtgcttacattttttctgtgatttttgtattgaaaatttccattgcttctttgcgtatatgaaagtgttgttgaatttgggtcaggaccgagaccgagactgaatttgtcggtcctgatatttttgcattgaaatttgatctttactttttaaagaccaaagaccgagaccgaaattttcggtcagaccgaatgtccacccctactccaaacatctgcttgtttattgtatctcatcaaaatggacactgaaaaatttaagaaaaaaattataaaataaattaatatgggatatatcgtctcacaaaatgcaattttaaatttcacttcttcaagttataactaaaagaacatattaaattcaaacgagttaacgtaaattcacaattatatttgtgtttttttattataacttatagaagttgaatttaaacggatatatcttgtatgaatctaacttgttatttttctaactatttatgtgacatataacaaacaatggaacaaaaaccctaccacaacaaaaaccctgttcagggagcttaaatctactgtttgatagccagcttagtttgatagtcagcttcttataacctgaagaaacttggtttttcagcttaatacagtttctattttatttttttagattttacaattatatattaccagaatctgaatccaaataataatgcggactatttgggatagctaaagaatccgagagaacctgcagctggttaaaaacttctcttaacatgccctttaccggaagaacgagcccaaatccaaccactggttcattccggattggtcgagagaccccgtttttcaaacacgcgcattactccacgcccctttcccgacaccgaccgcccgcctcgccgcattcacgacctcccctcccctcccctggccgccgtggaaaattatacacccccgcgcgcaccggcgatcgcgatcgctgtacgcactgatcgccaagcgcgtggtgatcccgcgccgaggcgttgggtgcgggataaaaatcccgtctttgggtatctctcggccactcgattttggaggggttcatcaatcatggtggctgatatttattgctgactattattgcccctgttgattgcagtttgcaggaggtgactcaggactgggcttttcacactagccattttctgaaaacatattttataaataaatccttaaaaaacttaggccctttttagctctcaaaacaaaaaatttcacccatcacattgaatatttagatatatgcatgaattattaaatgtggataaaaactaaccaattacacagtttacgtgtaaattacgagacgaatcttttaaacctaattgcgccatgatttgacaatgtggtgctacagtaaatatttgctaatgatgaattaattagacttaaagaattcatctcgcagttttctgacgaaatctgtaatttgttttattattaaactatgtttcatactttaaatatgtgtccgtatatccaatataccaaccaaatctaaaatttttcccaaactaaccaaggacttaatctcttcgttacatattataaaaatgtagaactagagctatgagtctctccgagagagcggaaaggagtctattctaactatatagtactagtatctcatctttagattgttatattcaaacctgtagctcggtgacagaatatttcatctgttacatgatatagcaatcttgtatcatacttcctccgtcccaaaatgtaagtatttttgaggttagcacgggtattaagaaagtatgtgagaataattgaagaaggtgtgtgattggttgaaaagagaaagtaggtgaaaaagaatggttgtgattggttgagaggggaaggtaggtataaaaatagcttcattttgggacaaagtactgtgctagaaatagctacattttagaatgaaggtagtattggatatattttagttgtaagatatctgtccaaactcgtcatgatgctggaatgtgtcatattcagtaccatattatatttctggatggaaagattaagttttttttaaagatctatttataaaataaatgttcataaaaggctaaaatgtaaaattgtgtgtgactcatgaccaggagtagtgcagtggcagtataagaggctaggtgaggtggctgggagagagaagagaccggactgaggatgagcagcacgagctagatagcatagcaagaagggccaaggagaaagcggtggttgattcgccatgagcagcgggcgcgagagcaggtgggagctcccggcgacaatgcgtgcgctggcgcgcgacgccggccagcagctgcgggtaccccgcgcggccgcgaccgcggccacgccggcggcaacggcggggcggcgcacggcggacgtcggcggcaagacggacaaggtgatgcacctgctgctttgggggcccaagtgatcgatcgatgggcctccgccgcgccggccggccgccgccggcgggtcatcgtctcatctccgaccagatcacggctgtacaatatatatgtactagtactagctggctgattgctcgcttgctccgttctctttaatttcttatggtgtttttggtccagtatccatgcactgatgatgcttgtttgccgggtcagtctacaggggtttccaccgtttttctgtacatacgaatcaagtggttttcctcgtgaaaatcacatgcgttctaatcggtcctttttttatggagcaaaacttatgtatcatcaatcatgtactactaccttgtaaacttttgccttgagtttggggcaagtaatgatcagatcgtgtaagactgccacttttaattttgggtaatttttgtttggttgctaagattcacagaatcacaaataaccgcagacacggacgattctaggcttctaaacggtacattagttgatgtgaccatggctaccatggatgtgaccatggctaccacggatgcaaccattgctcacatcatggatgaacaagaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccctaagctggtggagcacgaccctaggcacccctaggtcgtcctcccacccctatatatagctagttaccccttcagggtttctcgggttttgttagattaaagtttagccattgctacttgcttgcagcgcgcgtgtcggatagaccgtccgtctgcttgttcttcggaaccccaacttatcattcgtatttaactcctatttgcaattcagattgcttttatcttgttcttgcttgtttcttcgatttgcttgtaggaataaggttgatttgcaccggcaagatcaacaactcacggagaggtgtatcgatcgctaaggcgcaacgcaacgtcttgtacggttgtagtcgggtcgtcaacgtttcttccaaatcgtagttttcatcaactcaccgaaagatcgggccaacaacagccttgagtgtcgagaggaactcagggttcatcattagtactcctccattctaaagtaaacgaatctaatactagatctaataaacaaatctagtcctaaatctgaatgaaaataaatgaacctaatactagatctaataaacgaatctagtcctaaatctgaatgaagagagtatatgttgatttttgtaaaaactttcttcatcggtaatttttgtgaaaagaaatgtatacggttaaatatttaatttactcagctatgtcttgaaataattattataaactcagtttcacttataataattcatcctgcatcagctacaaacatgcctaccagtgagctgatttacgcacagttgtgtttgcgatggacatatgtgctccttattatacctcgagcatatgcaaacccttttttttcttcttttacagtcggattttttcggccctgttatttgtggcagatttttacttgcaaaagggaaaaggggctaagcaaaagcgaaaaggcggggatggtaaatatcttgggcttgggccgatttgtgatagcaggaacagctacataacgaatcatggaggcaatatctcatctcaccatctcctactctgagaggccaaagcccacagaaacaatgaaaagcaccaaaaaaaaagtaaaagaaaagaaaaggcctgactatacttaaataaattaatttgggagtacctatacatctttcgaaagatttttataatcgtatcacacatatttttaatctttggattaaaatccgatagatataataaaagcaaaaagcaattaagaaacactataatggacactaaattaccatatcctcaagaaaaagaccaaatccaatacaaaatttaaaatttacatgcgaagattcaaaaattacagtgtaacttataaaagttacattgtaagtttcataaattacactataacttacaagaaaatgcactgtaaatttgagtgagaaaatcgagtgagagataagaaaaaatctttcgagtgagatatagcaaaatcgaattaatttaggtccaatatttgcagtgtgaaaaagcaacatttttgtaattatttctatatttttttaatttaaatatattctttattcttacagctaaattaatcatccaatagaaattatgggctgagaaaattgggccagacaaggtctccatgggaaaaattgcagtgtgaaaaagcaacatttttgtaattatttatatatatttttaatttaaatctattctttattcttacagctaaattaatcatccaatagaaattatgggctgagaaaattgggccagacaaggtctccatgggaaaataaacttgtcatcaataaactgcggacaagctcaattgagagtactgatttatggaccaaagccccaaggaaaacaaacttgtcatcaattcttcatttacaaattaaaacaagctgacatcaaagtgacaaacttacatggaaaacaacaaacaaaatggtacacttacaacgacatgctatgatcagtcctactccctctgtcaaaaaaataaaaaaagacaaaccctaagtttccgtgtccaatgtttgactgtccgtcttatatgaaatttttttatgattagtattttcattgttgttagatgataaaacatgattaatactttatgcgtgacttacctttttatttttttcataattttttcaaataagacggacggccaaatgctggacacggaaactcagggtttgcctttttttttaagatagagagagtacataccagtagtacaaacaacatcagaatcggcaacaagtttaattaccaactaatcaatgagtgaacccatgctgcacccctagctatgaaaagtactccatctgtaaaaaaaacccaacctagtatctagatacaacataatctagataggccgcctgtccaaattcattatagattatgtcctatccaaatactatgatgagctttttgatgaagagagtatgtgtattcttctatcataatcaggcaattaatcaattagcttaactgaaatgatagatcaatcaatcaacattgttcatgttagctaagcttttattctcttctctttttcgcgaacgcgtaaaagctttgcacgtcagtatattagtagagaactctagctcatctctagggctatcctcttcctcatctcggcgccgccgcggtcgggggagtcgacgatgaacttgcgccagaaccagtgcttcctccagacgtgcgccacctcttcgagcggcacgcacttggtctccgggaggagggtggcgatgaagacggtcatgaggaggacccaggcgccgaagaagtagaagaggccgaagcggaggtggcagaggagggtgaggaagatctggctgatgaacgccgtgaagaacatgttcaccgccaccgtcacgctctgcgccgccgacctcaccgccagcgggtacacctcgctcgggatcagccaccccatcggcccccacgaccacgcgaacccggccacgtacacgcacacgaacagaacgatgcacatcgcgtactgctccgacatcgcccccgtcccgctcaccccgaactgtaatccgatgaatgttcccaccaagatctgcaaagaaatcaaacaagattgttaataaattaaatctttggttttgcagacaaggtgtttgatgaaatgggtgagtgcttgctgaataaattaaatctttggttttgcagtcaaggtgtttgatgaaatgggtggttgcttgcttgcctgggagatgatcatttgggtgccaccttggaggaagagggcgcggcggccgaccttgtcggcggtcatgacggcgacgaaggtggagaagacgttgacgaggccggtgatgacggaggagacgagggaggcgtcctggcggaagccgacggtcttgaagaggacggggnnnnnnnnnnnnnnnnnnnnnnnnnnnnnnnnnnnnnnnnnnnnnngaagaaggggatgagcaccgcgaacgcgagctgcggcttgtacctgccgccgaagaagagctcccgccacgggtgcgccaccgccttgctctcctcgctcgccgtcgtcaggtcctcgaactcggcgcgcacgtcgtcgacgccgcggatcttggccagcgtcgcgcgcgccgcctcgccctcgccgcgcgcgatgagcgacaccggcgtgtccgggatggccagcgaccccagcgcgatcaccgccgccggcaccgtcccgaacgccagccccacgcgccacccccacccgccggcgatcttcgacgtccagtacgttgtcaggctcgccgacaggatccccaccgtgatcatcagctggaacagtatgttcagcatcccccgctgctgcgccggcgccatctccgatatgtacagcggtgacgcctgcaggccaatcaccggcgatcgatcaacaactgatatataattttgagtattttctacaccttagctgtatacatgcggtttaaatggttatataaaattttcaaaaagtttgataagatagattataatgatataagacactatagaaacatgtaagttaaaattcaataataaaattaacaaatttttatgggttgtacattacaattacaatgtactattcactgtttgattttactctttttttttctaattgtagattaaatttaatcttacatgcttatctatagatttatatcatttcaacttatgttattgttttatttaaataaatataattatttaattcacatacaaataataatgagtgttatggtatgcaggtgatcgatgtcacatgacaacgtacgtggatgcagacgccgacgccgacgccgaggaggaggcggccggtgaggagaacgatgaagttgaaggagatggcgccgaggatggcgccgatgaggtaggcgacggcggcgacgaaaagggtccacttgcggccgaaggcgcgggacatcggggaggcgaagatgccggcgaccatggcgaagaggaagagcgacgagccgacaagcgtcagcacctggctgtcgaacttgcagtactggttcgtgatcacccgctcctgctgctgctcgaagatcaccgggaagaacatcgccaagaacgactccgtcgacgtcaacccggctgccatggacgtgatcagtcaaccacaaccaagaagaatcgtatgtaatggcggcggcggcggcggcggccggtgaggttgcgtgtaccggtgaggccgatgtcgtagccgaagatgcagccgccgacggaggcgatgaggcagcagaagaagacgaagccggtgacctcgccggggtacgtcttgtaccgcgtgtggtggtgcacgatcacggcccccggcatcttgcccggccggccggcggcggcggcggcggcggatcgatcgaacggcggcgacgtgggagatcggtcgatcgatcgatcgaagccgcgagctgcgcggaggagggaatcaatggaggaagagaagagagagaggagtacttaagagaggggaggcctcggcgaacggcgcgacggcaatggtgggtgcatggcgagcgcgagcgccctaaatcgtagggacgtctccttggtttcaaggtcaaccagaaaaaatgatttccattcttagcaagtttacaagttagcatctttgctggatgctgcaaagaagatgaaatttcgtttagttcttatttatttgtaccaaggaacactagcttgtgttatattttagtttggttttgtaaaatcacctggtcatgaattgaatgtggctttatagcagtaaggcataacgacttgtgttcaattttgtgcacctaagaattgggggcaataaagtatgaaacactacagaaagcttcaaaaatcataagttggatgtgacaaacaaacgattgattgattataggccgtgcgatctacacaaaagaatttcatggatagtacaaaagaattgtagggatgagtagtgaggactgaacaagaatgtaacaggcaaagaggaactatgaacagcacgcagccacgcagggtagcaaaagctgaatcaatgaattctgtggttcaaaactgaagagcgatcaggtaaacgcgagaaggaagtcatgtgatccggattctcgtaagaatgctttgcaacttgttagcacagagtttcttcacgatcttcttggcaggaaggtcaccggagtctgcgagtcctttcaagctgacaaaatgttgagacgatatgatcttcttccttccagcactggtctctgccaacgacacgaggcaagaaatggccaaatccttcgccatcgtcttgccgtcaccgtgctcaagcgactgcagcagccggttcagattatcaccatcttggatgaaaactacacggttagagtgaagcaacagtaggttgcagagtacttgtgctgccatctccctgacctgacaagatttggctccaagtgagcttaccagggcagtcatgaaccctgccctgccaaccatcttgctgtattcctcggagatcctcgttagccgtaccagaatgttgagggtgcattccaggacagcatagtcaacattgttgagataggtttgaagccagctaagaaaattggagctgatgagatcatctgtcagagctttggaagggaggcagaagaatgcaatggctgagagagcaacctccctggctttggatgagtatggaagatcagggttcatcagctgagtgagtgattggatcatccccatgctgattgctgcttgtctgacattggcatcagccaaggccatgtaatggagcagctcaactgatccaactttgcgttcttcctccttttgtcgggacagcttcaccaactccataactgcaccttgttccaccatgaacatcttcacctcctccaccctgctcaggttcttcagcaccgcgaaagcggagctgaccagcttgcccctgctatcgacattggcgcagacgatcaggagcacggtgacaccgccttgtgcgcagacggcccagacgttgtcggagttgctcgtcagctccctcaatgcatgagctgctctctcccttgatgaaacagtagtgctggtgcagcttggactatccagtaactggacaagtggagcaaccacacctgctttcacaagcattcctctgtaagaatcatagcctgcaataagggagacaattcttgcagcctgttcttgaatgcatgcatcccctgattcaagaaagctgatcaggagagtgatgctattatcaatgtcaagagctacaatcttgacatactcgatatcttcagataggagctctccaatggtgaccagggcttgttttctttgagccaaatccccaatcctcaccctcaagaagagatcattgatgtagaacctcttgttgcttaagcttgcaccaatggcaggcctcgttgcgatgacagcttgagaacgcacagaaattctggaggaaaccatctccttgaggtccttcaggtggatatcaagcttggagctgatgctgtccaaatcactcctcagacgaagccttccaccattgtaagattcatcgctgcattgagaagcaatagcttgaatatgacttactgttgctgtagccgtctgaagaaactgaacaagaatcacattttcgttgcagctgccgtcgtctcctggcgcattcaggttggaacagagttgctgaagcttgtacttgatggattgccacttgactgggaactgaacaatcgaataagccattgatgctgaagccgatgcctttaaaatttgcagcttctcactgcattctgctacctccattcctgcactcctgttgggatcaaaactggttcttggagttggagacatggaattgaagatatgcagatagtagtttttctgtttagtaaatgataatgataaggttcttatagctctagtggtctgcaatgtatatgcaaagcccagctggcctggccagatgaatggatcagttggtgaatccatttgatctgtctttttgctgcctccttttggtttcttcgattggaattttgcactgctctgcctgccacaggctcgaggcatcttttgctgcaccgaagtgggttagatttagtgggataggtgggtggagtgctggggtgtaaagcatatccttaatataaacctcggtagggttgattacacctgataatcatatataaactgcttctcattgtgatatgtgcaaacatcaactcttccataaatgcctttatttagtaaaatattaatattcaatttaccttttcccttctttgttttgtcctatggaaaaaaagctggctggcaccaaacaaacagttctttttcttttcccttttttttcagattgcagtagtaccatacaaacttgcattgaaagaaacactgtataatggggtcatctatgatgcagaatctgagcgctactgcatggtggacctacagaccccaaaaatatgcatgacaaaagcaacttggaatggaagtattaaaggaaagattaatgtttgcatcaagccatggcccaatgaccagtcctttcacagttcaagtgaacaatgcataacagtaataggctgtaaaatgcaaatgtgaaatgataagagggtgtgaaagaagtttatcacatgttaggacctgaggtactggacctgtttcagactctccccatgctgccctctgctcgtctgtatccagcaggtttagctgtgtactgcattcatttataaaggtagttacaaagagattagatacggtacggagagctaagataagagcaagtgcacgtgctggaaaagagctaattggttggtgtgagcattgagcagggaaaatggaccagcatgctggagtagtagagactgtacgaccactgaccagtacgggtggtacctaattatcccagtggcacaccacctcccatgtgatgtactactgatgtaccctcctaaattcaggattggataagctagacatactgtcgtcgctaaccctgtagaacaaattaaaaaaaaactaggagcttgagaccacactttatttctagatatatatgcatctagacaaatatttgtctagattcataagaaaaaattgaagtctaagtaggacagaggtagtaagtaaataaagaacaagtaaaggtgcatcctctccatacaaaggaaatccataggagaaaattgcagctatattattttatagaagtatgtttatacctagaaaatgcatttcattttagtataataatttgcagcgtgcagtgtacgtgctagtgctgctcctagatactcaaaggttattactctcagctacctccagaatcagatattaaaaggtcatacggattgtaatgggggccatccaatcagcaatacagtgcttttgcagttttgctcccggaagaacccaatatgggataacaagatatacccagtcgtctttgtaaaatccttctccagctgccactacttaaaaattaaacccccaaaataatatggatgaacttggaagtaacatacatctccttcatgctgaaacctggtagctttgagcctttgaagagcaaggtaaataaaatacaaaaactggtcaccaagtgaagaaagagaagagcaccaataggactcaaagactaccagtaattggctaattgcttgtgcctttttaatttacaagtttccccatgattttgtagcccaccttttaagggaattgtgaacactacccagacatgtccacctgcccgcaccactttctggaagagaggggactaattattattattattatggctctaaatcgccacttcaaataacttgatcctgtagtccctgtagcaacatagctcgacatcaaggaatacaaatactaaaaagtagtctcaactttcaacatagaccaccactagcacagtagcacgtatgctgtacactgatttaaataagatgtgcacataccattcatcataaagtaaatggtacagtgaaatgggaggagaaatgaaaaggcaggtatactaggcaaacaatacagtgaaaaatggaaggacaaaagaaaagcaaggtactgcaaaggacacaaatatttaagagacgttgagagagcattcatatgtatgtaccagacatataattggttatttattattatatttattacaggtcagtagtatagacgtatggaacaatgaaaatactcatggaagactggaaatagaactgtagaaaccacctgagctgttgggcaacaaacctttcccaattcatgtcttgatgagccatatatgatatatgatcaccaacaaggcatttatatgaatgaaatccaaaaaaagaggtgattccaagaccagcagcccaaacaacagcctcgaataagtttccccaactgatgtttgatgagttcatcgcagttgatcattatcatacagaataagaattgtgcttcctctgcaggctttgctttgacaccagggaagtaccatcagaaaaatatcgaactatggagtaaaagaccaaaaatgcattcagctccttgtataaaaggccaaaaggacagggtgctggtattaccatgtatatagtcaatggtcatcatattattttagggcaaaaggtccagggaattggtctagtatgtacatgttgactgccaaaccaaaccattggtttctaatggctaattagtcatctactgttccagaacaactcatctgttacaaagtaccctataaagctcaaagcccaaaattagcatgaagtaatactagcttattattaaaattatgtaattaaattaactgaacaaaatgagtgatataagaaaagaatttatcagaggcaaataatactccatccgttcttgaataactggcaatttgaccaaatcatttgtttcagaatatttgtcaccaccatactttcattggtaaaatccaattttgcccctactttcccatggctacacttgtgggtctaaatcaatcttcaccatagagaaaacctctagatacttctattttggatccattcctttccccccacctcccatttattcttttttttaataccatctcctaacaattgccaagggcaaattggtcacaaaatttgttgccttgttctacatggaatggtcaaattgtctattgctcaagaacagaggtagtatagtgttctactaagatgttattctaattggcaaaggctgacttcagtttatataagaaatattaacgaggctgggtatacacttgtaacaggaaattctttacccagtctttcttaatcaagttagtagccatcttgaaaaagaattgtagctagtattgaaaataggggttgtcatatgtaaatatgtacctaacatattcaacataacatgcagactgaataacttaaagttgtgggagaccttcaataataaaatcatgtacctctgctacaggggcaatcacagtaggcccaccatgccaccatagatcacaaaaagtaggacatcccttcatttcctcaccgacatatgtgaaggcgttccaagtaaccaatcacattccttgagatcttgtaagctgctcctccttcctgatttttttgcaaggtggcactgttagtagaggatatatgtagctcatgtatctttgaaaagttaattttagatagattgcagactaaaataaaagaatatatagattatttctcaagtattgagaaatcaccaacggtaaattttatcaatggaggtgctaccataaattatttctcaagaaatgattaggtttgcatgaaaatgtctaattaaacacaaatcaccccaaaagtattaggattttaaagtgagtatttgtgtgcaataggttaccaaacaactaaatctccttggtcctcccagccacaatcggatctgtacaggtgcttctagtgtagtgtagtgtacaaccccttgagtcaataggcattgaacattaaacggtggaattctcaacgttgctttcaacttctgataaaaacccaagaatctatattaatataaagcagaagtatggattaacttgcagaaattatgacatggcatatcaaatttgttctggatgtaacgatattttactgtgctttggagaacaatcataagtagctatgtaagcatgaaaaagtcatcaaataaagtcatctttgaatgtgtcaggcaaagagaaggatttgacatcaaaatggaaaattatctaaatatccataacctaggaaggcaaagagaaggatttgacaaaaaaaaatgaaaatgcatatatttacagaaaattatctcacaactaaataccaatagcctagttattcttgtcatggtatgttactgtttgttgaccagcctttaaacgcctgtgaaccagtaggtagaaaaatgcaagtactactacagaaacacacgacagagaaagtgtgaatcccataaagcttagaaatcactaagcccaagaaaagttaacgttattcttttttttgcggggcaaggaaagtgttattcaatagacatgtatgtaaggttcatatcctaaagggttcaaaatatagcaaaatacaaacacattagtaacagtgcttttcaacataaaaatgcataaaataggttgtagcataatggatacctttatcaacattacccatatcattccacaaatcacaatgctgtgtggctcaatagttctatgtggcacactggcattataaggtgcaaatgcaaaacaataaaaggtgatatgactttcagttcatataaggagcacataagaaatttcataaagatgctccacccaggtccccccagctaacccaacagaccaagggtaataccaccttcttaggggcagtgtgagcttacatcaggaaatcatcagcatgaaatggttcattcagtcatgcctcctccaacactgcaaagccaagaaacaaagctagctaagaactgttcatcaattgatctcatccctcagcatccaaatgacccaaacattcaagtatttaacagaactaagaggccatgatactagccccaaataaaaagcaggtataagagtcccaacaccacattttgagcatgagttatatagcgcttccatatgacttaacttaccaccatatgtttcatcagtgcccttctcagatatatgattgcatgaaaagtcaatgttgctagtatcgagtaaaactggctcccaccaacaccacaagtaattcagcttccatacaaagccgacacaaagctatctttcatcgtaactttgtcacactgacttaaaataaatgtagatcagaaaactaaatacattggttggaatttagaaagcattccatccatttaaaataattaaaaagaaagaaagaaagaaagaaaaggaagggagagaaagaagaatcaaaccaactccttcagaactcagatgcatttcataacagcaggaagcaagcaaccaccacacaaaatagaaatgcataaacatcagtacaggactccctctattccaagcaccaaatgagcatagatgctagaaatcatcaaacaagcttatactagtatatatttgcatgaagtataaaaaactggagtccaactgactaaagaacctctatagtgaataaagagtgaagagcaagagttcattcaaatttacattcctatttgagtacatctgcgccacttttttttcagcttctatactgaaatatgtttgctattgatgaacataagtcaagaatatacacagaatacgaattttaagaaagtatttgtttcttaagaaactccttgggaactttcgtgcattaccaacttaaacaagatatacgcacagtttcacaggcaagaaaggcatgctgaaagatgtataagacacattatacaagaccaggattctctgaggaccgctaatgaaaaccactcttaaggttgcacaggtaacttaattcgtgacatacagtccaaggagtgggaaaaagaacacatagcccatatcaattcacattagttgaatgtagaaacacgtgttctgtcatccgtgccacctgtcctatctaagttcaaaccatatttttcacgttcacgaacaattgaatatgctacattgatgtccataacttctgtagtttgtccaaatttataatcggtaagacactttctccgtgttcatttcttctctaatgtatttttttacatgtgtcatgaagatcaggcaacagaatagctcaccaattttagagtgcaaaacataccagtccacctccagggtaaatcatttttataaatggtatcttacagataattggtaccacataacacacagttatgttcataacacacattggtgtatgttttagctagatggcatgccaaaagcaaattttaaataagctaactcttgaggggattttggacaaggaaaattcaggcatttgaaaacacaaattgcaattatgttataccaaactatagtttcaatcatcttgccagaacacgaggatcataagaggactggaataccacaaatttcaaccatcttacccagacatttcaaaacataaattgcaaatatattataccaaactttgtatgcttgcagatctttttcatgtctgttgcctaaaagctataatggtaataattaaggagcagcaattaaactacggtgcaattgcttatttcagctaaactctgacaaagacctccgaatgcaagggtagtatctgaggactaacagactcatcaaaaattatctgggcgattgctgaagctctttcaagatgcaatacatctgtcttgagaaaatggggcagtgcctccgagtggacctttcggaggccttgtgggtgaacctccttgggagcaatcaggaacagtttgttaagacggctagctttcctcagcaggaaatccaccagtcgtagttcattgcgataacccttgaagtttgtcatcttgaccaaccgaaggttttctaatccgccttcaggcggttcttcctctgctacctccaaataattcgtcgtgaacgaatcataagtgtttgttgggagctgcaatgttgaacacaatatgttaagtacataaatggcacacacctataagtaaactagcaacaaaatgcattttgcctagaaataacaacctgcacgaagagcctctccaactgaggacaacggcaggccttgaggaagctatagatatctgcgaggttggagttggccattccgaacatgagcagctggagctctctcaagctgttcaagctcttctccacgttgggggtggctactgaagcagagacatactacaaggcgtgcaagtataagcacaaaagcaacaaaatgaaacgcaaccaaagacggcatagatacttgggcagacctggagagcaatgctgcatagggtgagtacggtgaggtttgacaggcgggggactgccgacggcaagttggtgcgcggcaaacctgtctccggcccgccggagcagaggtagagatgctcgacacaatccgcggtgctaccgaaaatgttgctgcagaggaacgcgccgctgaaccggaacgaccggaggaggggcgccgatggcacgcgcagctccgtggcgcgggagcagtcgacgacggtgaggctcttgagattggaggccccgacggtgaaatcgatacggcggaggtgtcggcagtaccggagctcgagctcgcggaggcgcgggcaggcggagaccacccgccgcagcgcggcgtcggtgagggagacggagtggaaatggatcacctcgagcgtggcgaccatcgcgttggcggacgccgtgaggtggagcccccgcaccgacagccgcgcgaggagcttgctcccgatggggaagtgcacggcgagcgcgccgggccgccgcgtgccccctctcgccccacgcccgccgccgtcgtcgagccgcagccgcaccttctccacgtcgcacgccgccgcgtactcgatgaaccgcttcagctcggggggcgcgagctgccccgcgtggaaggcgagcgagaagaggtccattcgacgtcttccgcgccggtcgatgcctgcgaggtgctcggcccgcagcgccgccaccgacgccgacgcggttccttcccccgatggcagccgcacgtcgagcgacgacgggtcgggccacccgtgcttccacaacccccgccaccgcgacgagagggcccccgtccggattgccgacttgagcggcaggaggctcagaatctggagccgcagcgcgtcggggaggtccgagatgcggtncttctnctactncccccaaccccgncgacgattgtcgcttccctcctgatcccccaccatttggcaccccntccccgctaccggcgtcgccgcacgaacgacgcggattggatgggattcccacgccagccgggtggatagctggtctactcaacttcttttttctttgtttaatctcaagaagaagaagagacctgtggagcgtccgtatcttcgcggggcaaagccgtgcgtgtgccgtttacaccgtgctactgccggtcggtaaatacacactggttcgacgggttcaccaatgtaaaggactaccaggccagcctggggcggcggagtaattatggtttaacggagcctgaccgaccgaacattatgaattaaccgggccttttatgggcccggacaccgggaccgaggcaaatccttttaacaagctgggcctcttgacctttcttcctatttttctccactctcggggttttttcttcctttgttgtcacaccctttttttgggtggttataaaaggacattcgcgcggggtattgcaatgtgt

SEQ ID NO: 72507 - DNA, 11520 bp, Oryza sativa
cattgtaaactaatatgttaatggggacatgcaaaatcacctccatattgtagtatttgcagaaatatatcttttgttcacacatttatcttttgatatgtggcagatgatggaggttgagctcaagaagctggaggatactatcaactctatccatgaagaaatgttttatcttcgcgccaggtatggcttgcaatgataaaacatttctttgtgaaattcaatatgatctcttaaatcattattatccgtgtttcatttctctagggaggaggagatgcaggaactgaacaggagaacaaactcaaggatggcttggcttggtttcttctcactagctatctgcctgtcagtggcggggttgcagttgtggcatctgaagaacttctttgagagaaagaagcttctataattctgactcagaacatttaggcataaaattgtgtgatttctctttttatgcttaccaggcgtaaatttcctgcaagggacagatgttagcatagttgaggaacatttcttttcagtttcctagaccaacttaaatagatgtaaaatgcaaagacgacaccaatttttgtttccttgcttgcaaagtatgttgttttcatggttcaaaagacaacgttctatttttttgttcttggcctggcctcactgctctaaccaaatacttcatctgcagttggttactgctgattatggtaagtttagaaccaatgttgttgtgatttgtgataacacattcataatattttatatttctaacactaatgccttgtacttcctatggttatatgttttttctttaggcttgaagcatgagtcatttttgcctgctagatgcgcccaaagactgattatcatgtcaggttctgtgactgaaaagggcaaaggtatacactgaactttctattagctgttgcatttgcccttttttggccttcagaaacaagtgccgccttctcacctttccatgaaaagcgcacttacttatgaccatatcaataccaaagtttggcttacgattatgtggggttttttttttttgaagaaacaactatcactacgaagcaacaggccagatgtgtggacgttcggttagatggccaaactaataaatcatgattacaaaacgaagaggaacgtacatagattcttgttttattaactagctagccacctatacactcaagggtctgaaggctcttcaatagcttattggagaagacatcccttgggagaatctaaattaacgcataaaaaaatagaaaagtaacagagaacaccagcctgaaccctgttaaacagactgcagtggtccatctgagacaatagcaatgcataaacccgtgcaacatagaagtgatgatccaaggcagtgaagttatcttgcttgattgattgtcgttgtatttttgtggggacaaatcttttagttttagatcatgcagtccaatgcttatggcacgtttctgggtagcagtttccacattttatgcgaccaatgttaatacactagtagtatacttgtgaagtgagttttactctaattcttgcactttcagatttctctataaaactattccaggcctgttctagctgatagacaacagatgaaactaagtttatgacaattatttgaggatacaaatgaatgagttgactatcagaaatttgataagttgattttatttttttctaagaaatgttgatgaagaatgtttttttttgaaaaaaaaactgtttaggagattaggaaacgtgtccacgataatccataatatgtattgtcattagaatgcccgtaatacttgcattttgacaatatgttggttggcactaggtagtcagcttgtatctggcaaatccgaccaacagtatgttatgcaaaagttttttttgtttgttattatcaacatttgtttgtaaatccaactggtgtgtgccagtgttaaaacgttatagtcatgcgtggtattttgaagaggaatgaactgacgaagttccactgttattttatcgagaaaccgtttttttttcttgcaattatcaggcatctgcagctgtatggctcttgaattttgacttatctgcaacttaacgaatctaattgcagcaactggtttataaatgtctcgttgctggtcagaataatcaggcagctgacgtatctgtatggctgtatcagaggtgttagtccacttgacgcttgctcattttgcaagtactagtaggggctgtaggacaagtcaaagaaagcctggtagataaaagaggttaccgccaaatatttcaactcaaatcgaaagcaacttgatggaagcactgcatgaagattttcaacgagatgtctaaattattgcaaaatgacgaaggcatcaacaacgacagattcacagttaaaacataagtacatgtcacagcgttaacataggttgaaatggagctgtaacaagctgattagacccattaggtttgcgttattatgcagcatcaagttactttaggaactttgctataatttcgtaagaaatactaattccccctgttaaaaaaacatcttttttttactatgaatatggatgctttgggatgatactttgcttgcatgctgcagcattcaacgaaaagtctgaacatgcaggcagcaatgtttctacatgcctttctttctctgaaatattcggcaaagataatatatctgctaagaaatataaaagagtcacaatatttttaggccatgtttaagctactcctaaaatgtcctcactagctgaagacactcgtagggaaactcagctcgcaatgtaggatacccctagatgggctcctcaaaatctgaagtaacttaatagagacactccaacccataataggtattccaatacacaaagccccatatttatttttactaccctacccctaatctctctctctcccaccccctcttctctttttcttcgccaccatcctcgcctttccctctcgctgccgccgctcgcctctcccgtcgccggcggccgcgaggatgacgaggagggccgcctctcccgtcgccggcttccaccgccgcccctctctctctctctcacgtcgctgcccatcgccgtccttcccagcatcctctgccttgcaccgtcgccggttgggggcactagatccggtgctgtagtgggcaatgcggatccgtcttcgctgtcacctctctcttctctctctctctcattgccacgccgccggtgaggggcaagaaggggaggcataggggaaggaggtgggggacagggcaccgggtcgccccattgtgtacccccaatggagtagctcaggaaaagtgagctgaggagcccagagccacccgtcccctgtgtaggggtcacgctcgcgcctccctcctaggggacgacccgacgacggaagttggatgtcatttgcgaggctactctctaggggcacgcgttgctgatggcctaagttcccacacaaaaattttataccctgtcacatcgaacgtttgaacacctacatgaagtattaaatataggctaaaaaataactaattgcgcagattgcagctaatttgcgagacgaatcttttaagcctaattgcttcatgatttgacaatgtgatgctacagtaaatatttgctaatgatggattaattaggcttaataaatttgtctcgttatttactgacagattttgtaattagtttttttattagtgtccgaacacccccatgcgacatcatatataatacctgatgtgacacgacaaaactttacactccgtatctaaacacccccttattttatacgcaacatagattttgaaagcacgagagatgaatataaaaatcagtggccaaatgataggctgctagcgatatgcgtggcctatttctttttagaatcttcatagcttcccgagatatcagcacatgctcatgctcttagtcactctagagtctattactatacgctccctccatctctaaatataagtgattttggttggatgtgacacatatggagggagcagttactactaagttaaaaagaacaaacatatatacaaacctattttttatgagatggagagggtactctttctgttccaaaataattcaacttaagataaaatatgatctatcctaaaacaacaaatttgtattatcttagaatatgttattttgggatggaggaaatagttatccttgcgatctactccctccatctaaaaagggcaacctgcaaaaagatgtgaaacaatatagtacgatgaatctggatatagaggttcagagttattatactatattgtgtcatatcctctcatagtcctttttttagatggatggagcatattatagtgatatagtcatcccagttggctataattggaagtgattaatctggtcaaatcaaataaaagagaatatcccgtcttaaaaataacaagtcattttgaacttctcgagacccattttagaattttgactacctagttcagtataatcattatcataaaaaagttatttagtttgttcttattttttgcataagtgtaatattatgaaagctcttgttaggataaagttgaatatatcattttcatatacccaaaaagatattttgaatggtttttatggttaaaattaactctttttgaatgttcgtatttcaagcaacttgtttttgagagcgggggtatgttacttatttatttgtcatatcggatctagcccaaggaaaactttccttttatattggatcaatcacaaaaaaagcgaaacgtcgaactgaacgcaaatagtgtttctcctttcccttttcttcggtttgactacaggagtgataaaagcatatcggtccaaaatatctttcctacaatcatatttgtctcgcacaacagccaaaacatagcaaaattctaattttcattaccatgttcatatagaaaggcaatgtcgaaagcttcagataccaacgatacatttgaaaagtttaaaagttggattgaaacactcaatttttattttggtacaaagtgacagagcgagagacaaaaattactcgcacatctgaaatgtgaccaattcgatagattgctgcaccattttcatataaaattcgaactaaagcagtttgcacgcaccaaacacatgactagttgactactagcaatcactgcccactcatacataatcccggcaatggcggccgaggcgaccaacccctccacctcgcctcaccaacctcctccacgactccggggaactcgaatcccgccccggatagtcgccgccgagatcgatccatggcggccgaggaagcccaccgcctcgccgacgccagcgccaccgcgccgcccaagaacgccgccgccgtcgatggcgtcgccgtggcggcgccggcggccggcggcgggcatgggagggcgccggggaacaagctgtcgctggtgccgctgatattcttgatcttcttcgaggtcgccggcgggccgtacggcgcggagccggcggtgcagtcggcggggcccctgttcgcgctgctcggcttcctcgtcttccccttcatctgggccgtcccggagtcgctcgtcaccgccgagctcgccacggcgatgcccgggaacggcgggttcgtgctctgggcggaccgcgcgttcgggcccttcgccggttcgctcatgggcacgtggaagtacgtctccggcgcgatcaacggcgccgcgttcccggcgctgtgcgccgactacgtcgcgcgcgtcgccccggccgtgtcgggcggcggcgcccgcgtcgccgccatcgtcgccttcaacgtcgcgatctcggtgctcaactacacgggcctcagcatcgtcgggtggaccgccgtggcgctcggcgtcgcgtcgctgtccccgttcgcgctcatgttcggcgccgcgctccccaagatccggccgcgccggtggcgcgccacggcggcggacaaggactggaagctcttcttcaacacgctcttctggaacctcaactactgggacagcgcgagcaccatggccggcgaggtggagcggcccgggaggacgttcccgcgggcgctgctctccgccgtcgccatgaccacgctcggctacctgctgccgctcttggccgccacgggcgccatcgacgcggcgcccgaggactggggcaacggcttcttcgccgacgccgcaggtaaattcttccgatcaccaacaacgccatcgaatcgaatccagtaatcagatcacgttcttgcataatcacaaacacctagcacgcgcgccacgccgagattcttgattgattgatttatttattactttttgctcttttccattgacattggtacacgattccatcgaacgtgtggaccatggaaaacaaaaaagatttttttttctttttgcggggaaatcaatcttttttagtgttgttgtgattgtcatgagccatggcaagttaacaacgtgggaaagaggagaccaagcaattaggcagaaaggaacaattagatgatgatattattgtcgtcgaagaaaatctctataaagtcaattccccttagaacaatatggcaatatctttacagtactgtcagtacagctacctctccaagaacagtacaaaagattatgtgtcagtgtcaatgacatatactcctgtttagagctagtcaaatcctataaattaattcatatatcttactgtattatcttaatttggtgttccatttggacaatgataatgatgcccaacatttctaccattcttcagctgcacagatgaaattaattacgcgctgcatgttccataaaaagaatacaacaaagaatacaacataaatagtagattgtaacgacgcataattaccttatacctctctctttctcagaatttaaggcctgatcaaacttgacaatagtctccaaaactaatatttttttcgcatgtactacctctatttcaaaatatctgttgttttagattatttagtaaagattaatgcttaaaaggaaatgaccatagcgccccctattaaatgatgtatgatggggagtgtgtcggtagtttagagtaggatagagaaaattttcaattagaggtaactaatgtaacaaaaggtacttttaagtgacaaagctttttgacaaaatttaaatcctaaagcgtcaatattttggtacggaggaattactacactgtctataggaacagagtcatagctataagaaagtatattcaaatgtcaatcccgaatccaataataccgttgtcaacaagtaaaatttaatttacatcaaactaattgtcagtaaaatattatattgtgatgaggaggagtgagtattttccaagcttcacacaacaatcgatttacgcggcgcattaatttaacgatctctgcatctgcattgcactactgtggatggttgatcattttgattgatcactttctctgcaaacgcatgaacacgtacgcaggcatgatcgccgggggttggctcaagtactggatcgaggtgggcgccgtgctctccaccatcggcctctactcggcgacgctgagcagcgccgcgttccagctcctcggcatggcggacctgggcctcctcccgcgcgccttcgcgctccgggcgccggtgttcgacacgccctgggtcggcatcctcgccaccgccgccatcaccctcgccatgtcgttcaccagcttcgacaccatcgtcgcctccgccaacttcctctacagcctcggcatgctgctcgagttcgccgccttcgtccgcctccgcgccaggctccccgccatgcccaggccctacgccgtgccgctccggggcctgcccgccgccgccgccctctgcgccgtcccctcggcgttcctcgtcttcgtcatggccatcgccgggtggaaggtgtacgccatcagcgccgtcttcaccgccgccggcgtcgcggtgtactacctcatggacctctgcaaggccagagggtggctcacgttcagcgccgctgccgcagaccgcggaggcagcggcggcgacgcgatgatgtaccggcgtcaggggagcacggcgagcgaggtcgtctgatgaggggatcgatcgtcgtcgacgccattgattccggcgttgcattgcaagctgtatatgctttccgatgtttgtttatctgtgtgtgtgtgcgcgcttctttccttgtgcagaagagcataggaattgagtgatttgtaacagtcttaattagtcgtagatgctgatcaaatcaagaaatgggttgcatattactttcaaattagcaaattgtacattcatgaaagtggtagaactaaagaagcatacataagctcaaagagaaattctcgacctcactaaaatcctattgaaaacccaccaggatttcaatcctattaaaggaaaatgagcaattctaaggcacaaatctaatgaaccaatggtagcatcttgtccctgattgcaagaaatcatggacaagctcaaaatcgcggcgaacatggttagcacttagtagctagtacgaaacacctagaaaaactttgaaagaaatacaatcttggctaaccgaatgcacacttttggagaaggtgaggagccatacctacatgggcgcgacatggcttgaacaggaggacaacacagcagcatgccgacggcgtgatgattcgatgatggcacgcatgggcgtcacaggacacagcttaggaagaagaaatggtgtgtgccgtctcaggtcatcatggagtagtacatgatgtttgctttgctaggggtatttgagaagagtgtgttttcttgtcttgaactgttgatgttgggggagaaactgtatttgtcggatctgctacagtactagtactcctactcttactccgtaggccggtacatttctgttgggtggaaatgggaggaagacttccggacccatcatttcgcttattcgcggaataagccaagcggcacatttgcaagcgaaaaataatttgtgaataaaatttttatatttgtagctatgcttatctctgaagtcgatatccggcgtcttgtcttggcgcatgttggcttgtatgttgatattgtatcttgatctattgtttcatgtcccctctcctcctagggggccttatatttatactcataggtatccccttgttcaagtagaactagggaaaccaatatggatacaatccgagtagtccttgtcgtttccatgtagaactctattcatccttccttatgcggaactcctcctatatccgaaggttgtttccgtataagacatggtatgtggtgggtcctgccaagatttagtcaactactataaggtatgtggtatccataacattgacaatgtgttcttagcgatccaaaagaaaatgctgaaaaataagcttcgatgaaaaaaaaaacctcaaaatcagctccaaatgtaacattgaaaattcaaatttggctgataagcataagcataagtaaaaatatgaggcccttcctctctgttctcataaaaaccggtactcggtaggagggatgcagcggttgataagaaaagtaaaatgtgtttgaaactcacaacgcgggaaaagatgtagtgcaaactacatatatagtggaaacatgaaaactaccattagaacgtaaaatggatgttcaatattcgtccacgtatgagtaaaatttttactcctgataatgtggacgaatatcagacgttcatttgatccaacgatagttttcagattcccactacatatgtagtttccaccctatattttccccttactacgcagcaaacatgtgacatagaggaaatccaaaatcagaaaatggaaatgctaacgcatttagaaatgattagactcatttcttagacacgcaaacaataataagagagtaaagcacgagagctgtcttgtttgtttgtgtaggccgaaattcaggcccacccatttgtatgccagaattgggcccatcaagacgaggccaaggttagctagtgggttgggctggtgtgggatgcttccaggtgatatttataaggcaataagttcatattgattcccttaactagtaattgaatctgattcgtatcctataccggatatctcgatcctcaactattaaaacggctacaatttgaccccatcgataattttagagggtggttttgccaacgtggctcctacgtagtgattttgatctagtcttcgtggtgcatggtggtggtttttttttcctttcctagctaatgcctattaagaatcaccgcaccatctggtgttagtcgtcgtaaaaaaaaaaaccggtagattctcgttagcgaacttgtaccagaactgctccgtccgtgtgaagcgcaggtcgggggcgtcaaagaagaatcggcatgagctcgatctcaaagcagaaaaatcgccatgcctgcgccgtctccacgcactcgaacgtcaccgacgaccccggcagccgatccacgaatggccgccagaggcaccacgtacgagtcgtacgacaacacacccttcgaagctcccccaggaggacgaacacaattagaagtataatagtataatagtgagttataagcctactataagtttacgtggatgagagaggtaacaaaaaaaatcaagagtgtaatggctctcatgcaagagctagcttaacacaaactccaagacaatacattaaatgtataagtgagagatagagagaggaaaagaaaaattgtagccgaccttataactaatctattatatatgttggctttaaaatggactaatagtatgaagtgagctctactaccatctttgctcttagctgcaccgggttcctggaaggacctgatcacggagttgatggaaggacctcttgttggttcttttctccaacaagagagagttggatgaagattaagatttttgtggcacgcttttcaaactgataaacggtacgtttcgttctatatgaaagttgctctaaaatatcatattaatttattttttaagtttgtaataattaaaactcaatcaatcatacgctaataccacctcgttttgcgtaaaaaacttaatattcatcttcatcttcagaagaaaagaacaccactatatatactatatgtgtcggttcttaatctaaaaccatcacctatattttaagaataggtgataataatttaaaaaaaaccagtatctaaacggaaagaaatatagctgtcggttccagccccaaaccaacatctataatatattataggtgttatttttcttaaaaaacagcacctatacgaaaccgagccgagccaagccaaggagagggatcattttccacccgcccccgcagctcgaccgtatggttttatccgcatcttagcgctctctctcccttcccttttttcagagagtagcatagcgctgtccctttccgtccttctcttctccttcttctcttctggcaaggtgtccacggcggtggccaag

SEQ ID NO: 72508 - DNA, 1045 bp, Oryza sativa
aatttccacttcagttcatggggtttatgaatttatacatatggactagcaatcaagaaaagtgcagttttagttggatagtgggtcaataggtaagcatgggtggacccacttgcagccctagtggcttcttctccttattgaatgtacttaccttataaaacttcgtctttcactttatgcatattaacgtatgctttattggtgatatggcgcataatcttgataaccctaacacagagagaaggcatgatttatacttgctaattttggtgaacacaagtcattgttgattagataggctagggtgctagaccaataacagaattctcccctcgtgctgccacctccctgcatcgctccctcccgtagcacctcattcatccctcagcgctctgcagcacttcatagtccatacgtcacatccctggccacatctccttgttctggtccctccccacattagcccctttggcatcgttgatgcctgtatgccctatatgaggcagcagcagtagtggccaaggagagttcgtcatggttgtattgactttgtcgttgatagatgccaaaaagaggacagctatgtcatacccagtggtcaattgggtttataatttacgataaactttggcaaagggcccaactttttagcctataaaatttgagggccaggcctaaaatggggtgatctgaatttctatttttttacctaaaaatatttaagggctaggtagggttgtgaaagaacccatcaccctaggtagatataatttacacccatagttcaactcccatgtatgaagcttgaaaggttactcctttcttcaaagcgctaatgacgtagtgactgcataaaaatggtttgcctttggcatattgcttcaaaatcaagaaggaactggtaatttttttagaaaggtattgctcccaccaagtaggcctcttcacaattcatgttgcaccaatgacaaatcatgttttctatccatttcctaattaattgtgaggttaagcaatacatgttagttcacactagagcatg

SEQ ID NO: 72509 - DNA, 4525 bp, Oryza sativa
ttgtacaataaacagtgtgggggtatggagaggtcttctttctcttgtgggccttaccttcaccttttgcattcacacattggcatatataaatactagagttagggaataaaagagggtttggggatagagggacttgaaccctgacttagaaagtcgacggattttccttttaccagaaatttcattgttgtcagtattgacatgtagaatgggactctctctttatcctcgtccgattaatccgcttttaaaaagatttcaaaaactatgatttgaaggatttgattactcaatattcgattggaatggattttataacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgtttttttttgttacggctaaaatataatgaattttactttaagattttaaccctaggtgtaatacaattgaaagtatgtgtatgattttttctagattttttggtgacattttttagttggtgtgcacgtgtgtacacgtgagggcctgtgtgcataggatatgttgccacatatatatatatatatatatatatatatatatatatatatatatatatatatatatatatatatatatatacacacacacacatacaaagctactacctactgattcctaggcccatacaaatttatatttgtatcggtatatgcggaatgtgtgaaaaataaaattaccttgtgatggaagcaatagtaaaattaagtagaagatatatacctgctattaaaaatactatcttattccccaaatgtttgacggtagttaaccaacgaaaaaaacagagatagtattttttgctcatccatgtcaaaaaaacgaagccaatatctatactacattaaatgtgggcagtggtgatgccagtgaatcttccgtcaccaccactcttactagcgtgtaggctttcacgctgttggtggtgttggtgtttcatcctgaaacaacataagctttgtgtttcttggtctggctaatttagtaagcatctaaaaattgatggcaaaagacagccggaattgtagattcttaaggctttgaaatgaatgccaaaattatcctttaagatttggtggtcatgcacgggcaaattagctacaagtataaacaaacaatataaaacccgtctcctctcctctactgttgcctctttcccagtttgtgctctctcctctcctcactccgccttatccccaaaaccctatcgatcccatcccctttcctcctcacccatggcggccacgctcttctccaccgccctctccccgcacctcctccccctcccctccacctcctccaaccccgcctcatcctccctctccttcctctccaagccgctgctccccgccctcgccgtcgcgggatggccgcggaggaggaccagccccttcgtgccggtggccgtggccgtgtcggaggaggtcgagacggaggaggacgaggaggaggaggaggagggctccgggggcgaggagttctccgacgacctgagggtcttcgtcggcaacctgcccttcagcgtcgacagcgcccagctcgccggcctcttcgagcaggccggctccgtcgagatggtcgaggtcaccaccccattcgtctcgccttactaagtactcctatcacaccaccttcgtcgagtcgctcgctggtgtgtccctgtctttgtgaaaccagaaatggaccgctggtcgctggtgaagtggtgatgaatgattgtgtctagttgcttcatattacagttcacgacaaattcattctgttgttaatttagcttaaaccgcgatacaattgggttgcatatggtagtgtgggcatattctcgttcttttaagaaaaaaaaacttatttcgggtgctcattgtgaggttgtatttggagatgattaaggatgcgataaggttgccattatttaaggttgttaaatttggtgtgctggcgctcatgctattaattctgtgactggcgaaagatttaggattgcatttttctggttaattgctcaattttaagagtagtactcggctttggttgatttttcctatattgtatcatgctaaactgcattgttgcaggtcatctatgataagctgactggaaggagtcgtgggtttgggtttgtgacaatgtctagtgttgaagaagttgaggcagctgtcgagcaattcaatggctatgtgagtatatgcttccatacttctaagtcattatttttgctccatgttggtatatgggctggctaaaaatatattgcataaagtgcgctcctatttcatctctttggtttgcatgctgtggcttgcattctttcaagataactgtagctgaggttgctcgatatgaacctgcttgcttgttttaatccttgtttgcttttagcttattcatgactagaaaacaaactttaatttactcttttctggcatgttgctggacatatgttgtgttatatcctatacaacatcattgaattgtgcttaactaatttgctgatttcatttcttaaaacagatacttgatgggagatctttgagggttaactcagggccaccaccaccaagggagcaatcatcgcagagagcacccaggggtgaggccaacagggtctatgtaggtaacctttcttggggtgttgacaatgcagctctcgcaaacctattcagtggggaaggggaggtcttggaagccaaggtcatctatgacagggagagtggcaggtcaaggggatttggttttgtcacgtatggttccgctgaagaggttgagaatgcagtttcaaatcttgatggcgctgtgagttttcactaagtctggctggtttcttattctcatatgtctttcagcatcattgttcttttagtgtgtgctaaaacaagcctattttctttgttgtgcaggacatggatggcagacagatccgagttacagtagcagaatcgaaaccacctaggagacaatattgaaattcgtttagatgccctgaagcctatggttagtccagatatgaatcatactatcgtcatgattgttctatagcatcgatggaattctagtcgtaacttccaccatatggttcaaaagattggtttggtgatgagatatatatcattttgttttaactttttgaacccacttttttttgttatgtatggcttgttccttgaattatagagtaaagtgcacggccggtctctaaacttgtgctattcaggtctcataatttgacaaagtgtgtcattccggtccaaaactgtcataatcctttcgagatcctggcgctgacatgatataccacatactaagcaccaacatggtatcatcagtaactacgcagtatgtccacatctgtatttctagattgacctgcccttccaacttggcatctcattgaatctgctcagtatcttgagcggatagaccaggttgggctgatcttgttttattttgggaacaatttcgattgatggggctctgacgggaccaaatatacttggactttttttttaccagtatacgttgtacgactccattttccaataaaaaaaaaggtgaatagcctatgaagtttcgcttcgagctcaatttagttgttgatgtttcaaaccgtccaaaaaaagtcctccaaatttattatttgggttaatatagtccttagaaaaaaaaagccacgaaagcatatcaagtcatccttgtatgtagcggtatgaataaaatgactattctacccttatataccatatagaaaaaaaaagacaaacagaaaaaataacaggccagcccagtcccaacattgttaatttacatgatcgctgcagcaatcgtaagtgataattataaaacgatcatatacgtgtgaaacatttatcttcttttatcttctttcttttttatatggtatataagggtagaatggtcattttgttcataccgctgcatgcgaggatgacttagcatgctcacatggctttttttttttggtcaaaggactatattaacccaaatgattaatttggaggacttgtttggacgatttgaaacctcaagaactaaactgagcccaaagcgaaacttcagtgaccatgttagttattcacccttaaaaaaaaggaataagttcacttggtgactctcaaaagtgattgtaatctaatccgtgaccctaaaccacagaaccggatatcttgacccccaaactatggaaatcggtacaatttgactccctcggcggttttagagggcggtttcgctgatgtggcgctgacgtggcggtattgaccgggtcttttttacacgtggcgttgacgtggcgcttaggtggcatttcaattaaaaagttatacgtgggacccatttgtcattcacatacacaattgtggg

SEQ ID NO: 72510 - DNA, 2262 bp, Oryza sativa
acagtaatcatccgttaatcatagattaatatacctggttagattcgtctcgtaaaatagcctaggggttatggaattgattttgtcagtaatttacgtttaatactcctaaataataagatttcggagggctatttaatagcccgaaggatccaaacaaggcccatgtcactaagcataaaccataaagctccaagaagatattatgcaagacactgtaacaccaatacttttcagggcttaaatgatgcttaacatgagtgctaaacgtattaattaaagaccatttcttttcattccttagctggttgttgttgttgtcacttcatgagtgtccacttcactacaaatgtgaccgtacgagagagacagttcaatttaaaccgcgtctctgataatgaacctcaatcatatggggtgatgagaagaagcacgcgtttcttctctgcacgtatatgtgatgattggccaagagaggcctggcctcgatcgatccttttttatttttaacgaaatcggcaagctactaattttcattgaatagagaagtgaaaattatacaaaaagtaagtaattaaaagttttgaggcctcggccctagcggccaaaaaaggttacactttcagccatgcggcaaggtgtctcgtgcccgcgaggctccacgtttttgcttcttccttttatcttggagagtatatttaaggccgacatctctttgtgttggaagatcctctggttcctctcattccaaatttcccatccgaccaacaaggttagcatatgtagtgcttttttcagcgcttctcttgtattaaccgtggcctcccaccactcatgtaccatcgaggccggctcccaaagcgacgggcttagatggtcgcagtccatccatcgtgcaatctcctcccagattcttctcatgtatctacatccttctagtaggcgaagggccgtctcctgagtctgacaatagagtgggcatgtggagccatttggccatcctctggttgttagtctgtctgagatccaaactctgttttggaggaccaactagacaaatgtcttgcacttgcgtggcgcctggcctcgatcgatcgaataaagaagacatgatgttattcaaagcgtcatgggtgccatttcagagacactggtagctagttttttttatcagtagttaggcctaccacgggaagggtattgggtaacccatatccatacctaattttatctgtctccatctaaaaaaaatatgacccatacctaaattaagtgggtattacccaatggtatgggtaacccaatggataagagaagagacatatgtgggctccacatgtagaaatggatcaaaatttgtacaaagttgctctttaatataataaatcatccctccaaattccagtcaaatttgataagattttgtaatgtgagttcgagtttaaaaattttaggtccgaattttacaccatagcaaatgggtacggatgaagtgggtaaaatgggtaatatcttccccatattcaaaatttaaattggtaattcttttacccataccctacccaaataaaatgtgtatgggtatggggatgggtactgaatacccagtggcaggctgatctgtatagtgcgtgtcacctgcttggtgttccatgcctccatggtaatgtgttgccgtttcatgagtgttcacttcgctacaaatgtgaccctattggagataaaaagagagcccttcctttctttttttccccaggctagaatggaaagatgctgcttgattgattcttctaaaccatcctgttcatgcttgcgcaaatcagaaaatgtcacttcagagcttcatccaaccctgtatacaggggtgaagacagctatagaaggctaaagctgctggatcgtttttacgatgagatcggcaatgatgacttatgacgagtttaagtagtgctgccgcaagattttgtctgctcttcgtgctggtttttttttttgccaatttttattcgattataagcgtatcgttgtaaagtttttcgacccggtttccctcgtaacctcataaactgagaaattcattgtccttttaggacttttcttcagagaaaaaaaaattgatcagcatgcatagatatatgctagtctttgcactaccaagaaaggcacgcacaagccagcattatacgtgccggaatagcgaaaaaaaaggggatcctctagagtcgaatgcgggcataaagctgagatagcaatcaagccgcg

SEQ ID NO: 72511 - DNA, 4700 bp, Oryza sativa
  unsure (1)..(4700): unsure at all n locations
cacaagccagcattatacgtgccggaatagcgaaaaccgacgcctagtattttctcaccttcataggctgaaaataaaaaaaaccaatacctttaaacgactataggtactagttcttgagaaaaaccaacacctatactataggtgtcagtgtaaaaaaaccaacatctttaatatattataggtgttggttaattaaaaaccgacactaaaaaaaccgaaccattccggatctaactctttttagcgcggaagccaagaggggggggggggcttatccactcaccccctcctctcggccgtctctctctctctctctctctccagctctcgagctctcctcccctctctaccagttccctctcttgtcctgccccctcctctctcgcctccttcgccatcggcggatcccggagagtcgatggcattggcgggtcccgtgggccggatctgacgggcctttacccttttccctttcatccctaagcttctctcgcgggcagatccagcaaaggcagcggcgatggcggtttcgatagttttctaaccctctccctttccccttctacccctaatcttttcccacggtagcgatgatggcatcggtgctcccacggccggatctagcggtggcgcttccgacagatggatccgacggtcctctaccccctcctcctccgtccncaagcttttcccgcaactgcagagatggcatcagtgctcccgtgggtggatccgacggaggtgtttccggcgggcagatccggtagcggatccggatctgccccaagcttctcctgtagcggatccggtggcggtggcaatgccgacggctcccgtgggcggatccagcttgattgttgttgtgttgttgcgatgatgttgttgttgtgttgctgtgatactgaccgatggattgattttggggggcgaagtagggggaatgtgctcggtgatgatgtattgagcatttttttttcatcccggaaaccttaaaggtactggcacctttgaggagactcaatggtgccgccttctaagtgtaggttgggaaatccgacacctattgccgcttcccaactggcaccaaaggtcttttctgcagtagtgttgacacttcgttcttcaacatgcctcttatacatgtacatggtgatgagtgacaatccttgcatagatttgaattggcagtgatttaccttgtatttgaatacatgttccatataacattgtgataccacctgagattgaatgactcaacagaatgattagattgatagaaatgtggagtacatatataagcgtaatccttccattatccacttacagcaagaaatatcgggaggatcggctaagcaaaacacgggtacatgccatatacaagtgaaacactaccattttcttccatttttcatgttttgcaagatgaactgtgccaaaaatgggttcagagttcagactctgtccgccgcaggaggatcatcttgtagttgcagatgagggccggcagcaacgacggtgttaaacccgagccacttcttggacctgcacaccctcatgacgccgtgccatcccacgccaagggcggtgagcccagcggcgatggcggagaccctccacccggcgacggcgatcacgtacgccaggaacgccgacggcacgaggcacatggcggcgagcgccgggagcgggagcgggacacggtaggggcgcttgagcgccgcagcgtgcctcccgcggcagcggagccagaggaaggcggcgaactcgagcagcgtgccgaggctgtagagcaggttggcggtggcgacgacgtcgtcgaagccgaggaaggagacggcgaccgagacggcggcggaggcggcgacggcgacccacggggtggcggatcgtccggggccgcggcgggcgaagacggaggggaggaggcccagctccgccatgccgaggagctggaacgcgccgctgctcagctgcgcttcgaacaacccgacggaggagagcaccgcgccggcctccgtccagtacttgagccaccgcccgccgatgatgcctgcataaaataaatctcttagaaatcagggttttaaatttagaaattgctatttctgctgggggcaccgaaattttagaaattttaaatttttttggccgaaattatttaaaattttgactgattttgaatgaatttgaataatatttggtcaaattctcaaaaatatgcagaaaaacaaaaaattccatgcgagatatgagcttgctggtgggggggggggatttcagaaattttgaaacgaaatttcaaaccctacttgaaataaggttgtcgtatgttctgtaaaaacttctttgggcaatgcgtgtcaccctgtccatattcgttgacgctggatttgaaacacgttgggtggagtcatgtacagatgattacaccaccacactgatgcttcttttaaagcacgatattagtttgaataatttgtccttaatcttttgtgtagaaagagttacaaaagtggaacacgataaatcttcatattaggataaacttgaatatctatttgtttatatgcaaaacctgatcaagttaaattgtggtagttacacacgaaactgctattcggtgaccagtcgtgcgcgcctctctccgcgcgactggacacgtgtcacgtgcggagaggggcgccggacagcgcgccgcgcgggaggagctccgtgttttcccttttttttttcttttcggtttctctttttttttctttcgtatttttttcggtttcgtttttctttttttctttccgtatttttttcgtttttaatacgtatgtatgcaaactttgtatacgtaaaaatataaactttgtatacgcatgtataaagtttgtatacacgtatgcaagctttgtatatgcgtatataaggtttgtatatatgtatacaaactttgtatatgtgtattattttgggttttatatgtacatatacaattttatatacatgtatacaaagtttgtatacacatatataaagtttgtgtacatatattttttttaggttttttatacatacgtatacaaattttgtatacacgtacataaagtttatatgcatatatataaagtttatatacacatattttttaggttttttaatgtgtatatatttttttatagtagtagtactaatagtagtaataatagactagtagtagtaatagattagtagtaaaaggtactagcagtagtcgtgtgcggccccaggcgcgcgattagtcgcacattaggcgcccccagttacacatccttaataatgttcttttatgattgaggttatttatgagaggtagtaatcaagaaaagaatttatgatgcatgtataaataaaaaaaacgtactacctctattctaaaacatagcaatatattggatatatctaagtgctataaatcttaacatatcgatccatgtttagatttattagttttataatattagaatatatcatatctatatttagaatagagacagtaatatactgctagctttatatcatccgaccatgatctatatttatgcttacttttgtctgttttggtagctgtgtgcttgtttgtttcataaccgatctaggcattggttttgcttcggcatgttggtgttgttgctgatcttattgttctcttgccttggcttttgcgataccggaacagacaaggcattgtaagtagctttggtagagcggaacagatatgcaactgccccttgagatttctcaaaactcactagcagcttcgtcactgctataacccattttgttcagacagaggtgctgtgtgtgggtcaaggatatgtgtattacaatatcaaaattgatcctaaatgcctgtacaatgatagatgctactactctgttttctattattaagaatattttgtttcattagaaaaaaactttaattaacaatatatttaccaataatataatttatgtgatacaaaagcataattataagtaagtacttctgaatataaatccatctatctaataggggatacaaatttgtaaatttgtcacctaaaatcgcacattgataataattctaaaattgcagtagtatgcaatgtgtaattttactccttttaactataattttgttgtcatatttagctttacattatttttatttaggtttgaatattttttatataatttgtaaagtttatgaattgtaaatttatttcatatattgttatgtttaaatatgttattcaacctttttagaagaaaaaaaaggaagaagcaatgagaatcactgattaccatcaaaggtagaaaaaagtgacaaaaatctagacgtacgctcccaatgtaataagatcaattttacgccataaaaattatatcataataaagtagtgttgtcctaaccaaaacaaagtatggcatacagttttcaatgaaggatgtactatattaggtttttttttttttgaagttatatagagcgaaaagaatagaggatcgatcggctcactatagtggagaaactttgaggggagacatattacaacgaaatagagggtgacacatgctttaatttgcactggtactaccatctttcttgaatcaggcaagtaatcgattttccttttcctagttctttacatagcaaatttttttaacaatggacaattacatat

SEQ ID NO: 72512 - DNA, 2368 bp, Oryza sativa
aattactagttcatatcacaaacttacaaggaatgtaaatgtctagatgtttatatggtaaagtatgcatctagtatacagaatagcacctttgacatcctaacggcaagaaaggtatgaataacagcccaaattaattggagccccactatggtgctctccattggcattagaaagcaatctgaaccgttaatctcatttgatcgaagggtttagatctatttatactaccatcttagttagcagtaatagaaatgtggaggggcattattgtaaaaaaaaaggtgcggagaggtataatcgtcatcggtcctgcttgtttctgcatcagattataacttaaaacaatttcgaattttaaagcttgatttctaaagactagttttagataggtttttcagctttccattttagcaattactatgaaactagagccagacaagaaagtggcgaagaaaaccactaaaattagtcctaaagtttaaaatctaatctgaagctcagccaagcaggcaccaagtctaggaaagcgattgtccaacccaaaaattattcgtttatctccttcgcaagtgctatcgcccaaccagatccaatcaactgtcgcatgtcccttttggttgggccatccattgcattaagccattgcgtcatgctccaatatggccctagctacattgcagccgccacctaaatttttggggtatgattccaaaaacaatactacttcatggtgatcacctcaaccaccgaaattctctaaattctaacatccactacttttcttccgcatcactgtacccaaatttggagcaatagtggtatgctgagccgagtattgtccatcacccatcagaaaaagggtaaactttaacttccacaggagaaaaagagaggtgcttgctttttcctttgggtggtgggggtgggttcggctaacacgcaatttccaaacctccctgttcttgcacggaatcctcagataaactgtatagagaaaaccattttctccaatgaaacagtatggagtatatgcattttgcttcgacgaattcgtctcgaagtttcgcggaagcaaagcatatgggacagttagcagttagcacagggttacacgcccagatcaagaaacccaaaaggggggaaaaactgcaatcgatgtagtgataaaaaactaaagcagagattgagaaggcgagagagtagtagcagacgagatccgagttggggaggaggaaggagatgggatgaataccatgggaccgggaggcggtagtggaggtcggcgacgtccctgtaccatgcgcggagcatccagagcgcgtagaggatgacggccatcccggcgagccccagcacggagttcaccgccttgagccccgtctgcacgcagctccgcaccaccctccccgccatggccgcgccccacccgcgtctctcaccaccaactccggctactcctcagctcggtctgcacccccaccccacctgtgcagctgttctccgcgcagcctcgcgtgggagcaaagaatgggaatgggagaccgctgctgctgctgctgatggcggaggttgacggcggcggtggcgtggaatattggggaagaggaggggacgtgtggaggtgggagggaaagaggaggcgatggatggatgggtcgctggagaaatggatgtgggaattttgggttggattgtttcggcacggatgtgacatgagttaattgctgcctgcttcatttattttgtttttattttatatattacttattattgtttttccgtgaaagattaaatgattgttgcttctactctattgtattttgtactaccgtatatacttgtggaaatacgggtttgccgtgacgctgctgtaccttgaaaagaagtgtacttgtagttttttttcttagtcaaacttggttaagatgattaactaaatttatagaaaaatttagtaatatcaaaaataacaaattagtttaataaaatccagcattggatgtctgttttatgttaaaaaatgctactatattcatttataaacttaattaaatttaaagaagtttggctagagaaaaaaaataaacaacttataatatgaaacacctagacatagcaaaatgacaaatctctcggctcttcgcaagacgaacaagaggactaagtaagtacacccataatgagaaagcattagcgtatgatcaattgcgtttcaataattacatacttcaaattatatttatttgatatattttagaggaaattcttatatagaaagttttcacatagaaatgtactatttaacaatttaaaaggcatatcttaattattaaaaatgaagggagctaattagggctgcaggaat

SEQ ID NO: 72513 - DNA, 64719 bp, Oryza sativa
  unsure (1)..(64719): unsure at all n locations
tcggtaagatattaacttgcacttaccgatcgagagtctcctcccctcgcctctgttcgcgtgcgctgcacacttcacagcagcacggctcctctgacctggtgttgtgcagtgcctgtactcttcgtgaattgataccgtagagtagattagcttcctcctaatccttgacctacgggcgcgtgatggccaatcactgccgccgaattgattaattcggcaaccgacgctaaaacagtatattgatttcggtcatacagaggaccgaaattctctccccagcgaagtcgccacgctttttttttttttgtcaacataagattacctaacaatttacggtgtaatcaactgaagttgtcaaaatcgataaatcaaaaccggctagcggaaccgattttaaaattaattcactttcacggaatcaagcgactaatttacaagcaaattagtaaaaaggataaatatcgtacttacgtgacgacgaacgactagtttccgagcaaactagtaaaggataatctcctcgctttcgtggagaagcacgaccgtttttcagcgcaaaacggtaaagattaaccaaattccaaagctgctagaactcagatacgaaaatgaaatagaaaataactaaaacaaaagaagatgaatagtgattgataattgttcggattctcccgttctactgttaccgatatatatgtcggcaaaataataatggccccccacagaataaacaagaaaataaactaacaaaaatccattattatctttagcgccggacgcgctaattcaccggttcccatctcctgccaaccgacgccaaaactctataacgcacgcacgcgggacacagctgcacccaaatttgtctcggtcagcaacacgaactcctcaaggatctccaaatttgcatgcatctgactcctgctctgcttctgcttttcagactgacatcaagcaactttaactccctcacatgatcaaatgataaagccaccctccaatttacatggaaccatctattggatcacaaattcctacacatgtaaactgaattgattccaaccaaatcataagataattgcaccatctattccaaaataatttggcatgcacaaatgaactaaggctgtttttgttcccttcaaactttcaacttttccgtcacatcaaatatttggacatatgcatggagcattaaatgtggaaaaaaaccaattgcacagtttgcatgtaaattgcgattcgaatcttttgaacctaattacgccatgttttgataatgtggtgctacagtaaacatttgctaatgatgaattaattaggcttaatagattcgtctcgcagtttacaggcggaatctgtaatctgttttgttattagtctacgtttaatactttaaatgtgtgtatatatacttaaaaatactaaaatggaactaaacacggcctaactataagccaaattataaacagcaggaataggtagccttgcattgttccccagaaaaaaaatataatatactctaagcaaaagtttcaaaaagaaaattgtatgttgccggattttcgcgtgggctgggtgcgaggggtacagcggcgctttaaggtataattgatcccagtatatttattctgatttttttacatgtaagcacatgcatcagtttaattctaaatataaacacgccaaacccatatttcaatatgtagacaagatgctcgagtgcaggtgttatttcataacataatgtccaagcattgttgcatacttgcatatataataacataatgtccaacaaaataataggccattgaattgagttatgttactttgtattaatgtttgacatatttattaagtatggttcaaaatatgctattttgcatttacaagtcgttattacatattttttaagtataatctgaatatagtaatagactaaaaaaattgatactccctccgtattttaatgtatgacgccgttgactttttgacaaacgtttgacctttcgtcttattcaaaaaatttatgtaattataatttattttattgtgacttgatttatcattaaatgttctttaagcatgacataagtatttttatatttgcataaaattttttaataagacgagtggtcaaacgttggttaaaaagtcaacggcgtcatacatagggagtactagtttacaaataaataagtttacattactgggctgctaactttgtgaacgttgttgctaggaacaagattgcaaaaaggtccatttattttgttaggcattagatcgagggattgacgtggtcttgtgcatgtatatgttagaaatggaattacgaatatggtgtgctcaaatacgtaataaaagggctgcatgtgtttagattaaaaaaatcggacagaccgtttatttaatttcgtagtactaattaataatcaatagctgtactactagaattcgcatcgagattctcttctctagctaccacccattttcagtgctacaaattaaatagccatatgcatgccctaattaagtaattaattaaatcgatactccctccatactcgtaaaagaagtcgtttaggacatcgacacggtctctaaaacataattttgacttcttatttctataaaaatacttattgaaaaatgatatatgtacatttttatgaaagtgtttttcaacacaaatctatacatataatttttacattttcaaactcaacaacttgagagttattcatgatttatattcctaaggtttgacttaaacattgtcctaaacgactttctttatgagtatggagggagtatgatcgtgcctgttgggccgggtcaatgaattgaagtcgtcgtttgtctcgtttattaattttactccaacgacgtgccgcgtgctatatatagacatacatatgcatgtactcctatatgctaagaagtactaagtctcagtgatatgctagcttagtggccatggcaacaaataagcgagtagtggagctggagcgctgcatgttgattggcgtctgtctgcttctgctatgcctcctgcacaccgctgaggcgcagttgatgcagcatccgccggcggattgcccagaaacgtgcggcaatatagctatcccctacccatttggcattggcaacaattgttccttgctagggccggcaggcgacgacttcaccgtcgtatgcaatgatagctacaacccaccaaggcccttcaggggtgactatgagatcaccggtatcgtgctggaggaaggcgtgttgaacgccagctacacagccgtgccgtatatctgctatagctcgcccaacacctcccaacaattcaccatgtcattcgacctcgccggctcgcctttcctcatctcgacgacaggcaacaagttcacggccatcggctgcaacaccctggcgatgattataggcaaggaagatatgacctactttaccggctgcatctcctactgcggtggggatgtacaaaaggccgcacccgatggctcgccgtgcagtggcctcggctgctgccagactgaactcacgccggagctcagcttcttgaacgtcacctggggagtcgatggccacaacgacactacaaatagtgcgtgggattacagcccctgcagctacgccttcatagccgataaaaactggtatacatgatgctcattcattaattaattaattaatgttgtcatcatccacctatatatatatatatatatatatatatatctatatatgtatgtatgtatatatacgtatgtatgtatatgtatatatgtatatatatgtatatatgtatatatatgtatatatatgtatatgtatgtatgtatatatatgtatatgtatgtatgtatatatatgtatatatatgtatatgtatgtatgtatatatatatatatatatgtatgtatatatgtatatctatgtatacatatatgtatatatgtatgtatatgtatatgtatatatatatatatgtatatatgtatatatgtatatatatgtatatatatatatatgtatgtatgtatatatatgtatatgtatgtatgtatatatatgtatatgtatgtatatatatatatatatatatgtatatatatatgtatacatatatgtatatgtatatatatatatgtatacatatatgtatatatatatatatatgtatatgtatatatatatatatacatatatatacatatatgtatacatatatatacatatatggagcaccaaacaaatttactatatataactatatatatatatatatccctgattcatatatcatctatctatcaattatattattaagacaaccttaaaagaagatattacgtttaatgtggaggttagaaattctcacattaatagaagaaaaagaaaatgatctaaacttaaagaaatataatctaatagttgtatatgaaatccagaccttatataaaaaatctaagagttgtgatataatatatacatacacacacacatacacacacacacacacacacacacacacacacatatatatatatatatatatatatatatatatatatatatatatatatatatatatatatatatataatgatacctatagaaataaaaattcagagttgtatgtaaaatccaactagttccatgcaaaacttcacatggcaattccctagttctattattaagacagccttgaaagtagatatcgcgtttgttgtgaaggctagaaagtcccacattaaacaggaaaaaattaaaaaaatagagttcaagtaaaaatataatttaaaattaactaaaatttagaatataaataaaaaatattgaaagaacaaactatctagaacacaacacgatattaattaaaagtatgaataaaataaattttgaatttacttagaaaagaaaaatgagagttcaaatatgaatacaatttagaaataattaaaactcggaataatatataaggaatattgaaataacacactatacatcatgagattgattaaaattcagaataaaaacataatatatactccatctgtttcaggttataagacgttttgactttggtcaaagtcaaactgctttaaatttgactaagtttgtaaaataaataataatattttcaatccaagacaaatttattatgaaaatatattcaattattaatttaatgaaactaatttgatattataaatattactatatttgtttataaacttagttaaacttgaagtagtttgactttaaccaaaatcaaaacgtcttataatctgaaacgaatggagtattttctaaaattagagaaagaaaatttagagttcaaagtaggaatacagtttcgaaataactaaaattaaaaaaacaaggataaaattgagaataaataaaaaaatgagagtatggtaggaataatatttggaaataatggaaatttagaataacaaaataaggagtatcaaaagataataccatctataacacaacaggagattcattaaaattcaaaataaaaaaataaattgtactatattatactaagagggaaagccaaggggtggaaactaagtaggggaatggtgattagcaatacttctaaaaactagtataaaaataagacccgataactattaggtttgatttttaaaatcctagtgatagtaaaatggaggggtaacaggctggccagaaaggaagaatagggtggcagtagttgatagaacatctaaaagttataaaacagaatgccaatgaaaattataggtttgatttttaaaatctcaataacaataaggagtagaggtgacgataggatgtaaaagagtagggtgacgacgattgatgggacataaaaaagaaactccaatgatgattaggtctgatgtttgaaatcccaatcataataaacaagagggacagcgggcaaagccgtgtaaacgagtatatatatgatagtggtgtctaatagaacttcgaaaacaataaaaaataaaaacatgacaagccaataaaccctaaaatctacgaggtttaatttttaaactttccaagattatgaatagaagcggacggacaaagaagtaaagagcggcaaagtatggtaagaggtggtgattgatgtgacttttaaaaactgtgaaattagatatctggtgatgatcagggttggaagttttggaccgaaatttcggtcccctccgatacgatattacttcggccaaaatttttcatttttttcatgaattttggtaatatttgttcaaattcaactaaattttgttcaaaatttcggaccgaaatttccggaattttggtgacctctgatcaaattgggtaaaccgaaaatgtgaaccctagtgatgataatgttcaaaattttaaaatcctatgatacgtacagttgtgactatttaataatttttccaaaaaataaataaatggaagttcttatgattatgttgtacttatgttacatgcatatatatgctgcaggtactccttcaagcgggaggacctcgttggcaatgccaactactttgacaaaaaaggcattcctttggtgctggactgggctatcaggagtaacgggtcttcatgcccgcacgagtctggcaagatggcaaacccggttgtgccttacggtgcttgcgtgagcagccacagctactgcgtcaacgtcaccaacaacggacacgggtacctctgtaattgctccgatggatatcatggcaatccttatctccccgaaggatgcataggtacgttcatatcttagtcttaactatttaaaaagagcaattttacggtcctttagaaggtaccatgaagtaccattttttctattgtaaatttggtacctcatgaggtaccaaaatttatacctcctgaagaaccgtagaattgctcatttaaaaatgaacaattttccaatcgtcgcatacgatttttgcccgccatccgtttccgaaatcattgttaatttgcatgcacgcctcgccggtcccggcctcggccaaagtccgcgtgcctgctcctttgtcccgatcggtgtgaattataggaaacaagatcctttttattttgtatttgtatcatatatagcagaaaataatatatcttttaaattgcttatgtttaatgtccacacattttcaactatacagatattaatgagtgtgatccatccacttataaagagaatccttgccctggtgggacatgccataacctagaaggtggctacaaatgtaaatgcaactttgggcgaagaaaagatagaaaaaacaacaattcctgtcaaccagtactatccaaatcagctacagcgctgatcggtaagacacatcctaactactctcccccctcccaaatcaaataaacctattactcctatgatatgtgacacattctaatattatggatctcaatagactttaattactagatttatttgttctgagacaaaggacgtacatagtataatgtataaaaggttacatgttacatatagtttttttactctattaattgttagtaacatcttaattaattagaaacaccatttgttttcagcaacaatatgtgccatcgcaatttcgtccatcgtactcattttcttgcgcatggaatatgagaagaggaagcttagagatcatttcaacaaaaatggtggtcaacttctcaaaaacataggtattaagatattcacaaaggaggaggtaggcaaaatcacaaacaattatagtatcattcttggaaagggtggcttcggtgaggtgtacaagggaactactaatgacaaccagcaagttgcggtgaagcgctccattgcagttgatgatgaggcacgcaaaaaggattttgctaatgaggttacaattcaatctcaaatcaatcataagaacgtggttagacttgtgggttgttgtttggagacaaatgtcccaatgctggtctccgcgtacataccaaaaggaagcctgcacgatgtgcttcatggtaatggcaatcacgttgcaaaatataatctcacattacaagtacgtctagaaattgctattgaatctgcagaagctctagcttacatgcattcatctgctagtcagaagatacttcatggagatgtcaagtccagcaacattctcctagatgatgacttcaagccaaaagtctcagactttggaatatctagactcatatctatagagaagaaccacactaacttcgtcgtaggggatataaactacatagatcctgtgtatatgaaaacagggatacttacagagaagagtgacgtgtatagctttggggttgtgctcttagaactaatcacaagaaaaaaggcaaggtatgatggaaacaatagcctcccaataaactttgttaaatcttacatgacggatagccaggcaagagagatgctcgatgatgatatcacgtcacctgaagtcatggactgtcttcacatgattggtaggatcgcagttcaatctttgaaggaagacgtggatgagaggcctaccatgaagcatgttttggagcaccttcatttggtgagaaaggaatggatgcaaattcaagggcatatgagttgttatcaaagttgatgattattgcatcaccacaacaacgcttacgacaacatagttgcctttcagtgtgaagctatatattgcactactttgcgctgatggtatactttgcattataagatgaaataattctgtttgtaagatttatatattgtgttgtttttagatgtttaactaaagatttgtatgttgctatcacagctaataatacgttgaactttgtaagttcttttaactaaggttttgtacgttggtatcatagctagtaatatgttgaactttgtaagttcttttaaccaaggttttgtacattgatatcgtagctaaatagctaggtggcccacgtaattgtacggctagcacctatacaaaattttctatctttttgacatgattgtcttaaaaatttgttaaatagccctctcattgtcttatgattttaaaatatcaaaactaatcattatcagtttttcaatttgcagaatgtttgatttataacattgtagtcattatttaggccaggtcgatgataccaaaatctacgagtgggcaacagtccggaagaatactgatagctagtggaatcaatcaagcaataggtagatagataagtgaagtacccataccaactacataactacttaactactaggatgtgaagtaggagatggttcaaatcagaatacattttcaaggagttcgcagagatcatttaccttgtaatccttcttcagagagtgaagcaacttagcagcttcgattgctggtcgttgatgcacgcagccactcgggccctcccgtccgaggaatccactactgatttgaaggtttattcttgtgttgctgctgtatctgtataaatctgtgggtgtgagtgcatgttgttatcctgaaaatgcgatcgatgttgcttatattccctgcttcattttctggttgcagtcaggttcctcacaagctgctaaaagtaaaaaatatccttctctgatgataattttttttaggtgatgatgatatctgaatgcagtaaagttatataccctacctagtagtgcatatcttgattgcttctctctcgtggaattttactatgatttgacttatataacttccaaatgaccaccagtttcaaggtttctatatatcttttctataatattttaagaactgaaaaactaactcctttgagctattaaaacctccgagtattgagcatcagtgaagtacttctagtcttatcagttattttcaattgtgagctgcaaactttgttactatcatgaaaggctggaaggctctaatttcttgctattattaatagtaactagcatggtggcccgcgcggattacgcggctagcatcattatattttatctcatataatagcatatatgttttctcaatttattattaaaatatattaaaatgacaacacaattttaaattttgtactaactttaatgtgtaatattcatattttattttatatcgtgttagttattaattatttttaatatcaaattttagttatttctaaattatattgctatatggactctagactcttatttcaatattttttattttttaattccgaattttcgttatgtgtaaattgtatttttatatagactctaagctcttattccaatattatttatttttgattctgaatttttattatttctaattgtatttctatgtggactctaaactcatcttttaatattctttaatttttaatttcgaattttagttacatctaaattgtatttctatattgactttagaatctaactctacttttaatttcgaattttagttgtttgtaaattgtatttttatatggactctaactctacttttaattttattatttttattctgaattttagttagttttaaaatcctatatggactttatattctacttctaatattccttatttttaattctgaatttctattatttcttaattgtatttctatatggactctatactcttcttctaatattctttattttttaatttcgaatttcagttatttctaaattgtatttctatatggactctggtctcctcttctagtattcctactctctctgtttcataatgtaagtcattatgacttacgttatgaaatggaagaagtaattttttagctccgaatttcaacaatttctaaatgtatttctatatggactctgtttttctttttctccgattaatataagaatttctaggccgtgagagcgaacgttgagactcctttttctattcctttagtaagttaactagctgggcggcccgcacaattgcgcggctagcacctatataaaattatatattttttaatataattttacttaaattttattaaatagttgtctcgttgtttttaagactttgaaagaaaaaacctcatcatcctagtgtttctaattttatagtttttaacagtcactagttgctaccccatatatttctgttatatccttatttatttgcttgcacgttctaccactgtttctatttattctcctcggaacctttaaaaattgcataatttgtcatcccgataatttttattcataaattatattcctacttgaactcttataattttttatattattgaaatttattttatttgttatttcgaactttaattaatctcgtcatgtgttctagattatctcttatttcaatagtctttatttttttattaaaaattttagttatttataaattgtattctagttgagctcttatttttctttttttatttttgaatttattttattttctatttcgaatttattctatctagactatttttttaatatttctaaattttttagagtaaatttcacaaaactacatatactttgaccaaattatcgtaaaactacatatttaaggtcgtatatcatagaattacagatttagcaacaaatttattacaaaactacaggtttaaaactaactatcacaaaactacatattttagaataaaattatcataaaactacagattttaggatttaaatcctttgcactaatgtaatgtttgagttataaatatccaagttttatgattaaattgacattaaacctatatgtttgtggtaactttgttctaaatttgtagttttgcgatattttaccttaaattgtagttttgtgataaaattagtgttaaatctgtagttttgtgatatatcatgttaaatccgtagttttgcgataatttggtcaaagtatctgtagttttgtgaaatttaatcaattttttatttctaatttcaattgtttcaaaattgtatttctacttgaactctcttttttattatttgtaattttttattttatttaattttttattttaaattttaattaatatcgtattggtttcttacttggtatctttttttcaatattgcttatttttaatctcgaattttagttatttttaaattatattcctacgtgaactcttattttattttatttttctaatttcggattttattttatctttattccgaattttaattaatctcgtattgggttcttgtatggactcttctttcaatattccttatttttaattccgagtttcagttatttttaaattgtattcctattggagactttttttttctaattttagattttattttatttttaatccaaattttgattaatctcgtattgggttcctataaagactcttctttcaatattacttatttttaattccgaatttcagctatcttttgattgtatttatatttggactcttcttttctttttcttcgattattgtaggaatttctagccaccacagtgaatgtggtgctttttttcaaggttattttaataatataatagatagatagatagatagatagatagatagatagatagatagatagatagatagatggatagatggagtagagtgaagaattcatttacaggatttcactgtcaaaaccacacaatcttaaatttatagcttttctttcctgtggagctttctcgttgaacagatttccgtgggtacaaattttgtgttttcctgtagagtgactcacaatagttaatttgagcagcagtgctggtgggattacacctgaacagcagtctatggctctttgcctgtaatttcctagtgaatttctttatttattatctgatcaatatgctaatctctattgcctcactttctgtgtttttgtaatttgtcatctctgctctgctcattctctctgttccctatttgcaaagcgttcaatgttttgcctatgaagtttgcagtcataaaagtgaaatgaactagtaaaaataagagaatgcaagttataagaaagcaagaaaggtcaaggttacctgcctgccagtagccacaactttaatcgccatggacagcttcaatctcaggcaacacaagtcagtcgtccggtgctgcaagtgatctcgagtgaagagaacaatttgactggctgttccaattccattcagagccagtaccagcattttctaaaatcaaagaaagcccaaaacaaggatcatacagaaacagaagaaaagaaaagataatctaggaagagtgtaaacaatgagctagtcaaaggaaaggagctaagcaacttgctaataaaacatgcatgcatggttaggcaagctagcacatctaatattcacttttcttgggtggaaattacattgttgacccaatagtgaaggtcttggatgtagacagaagaaccaggtgccttcatgcacaatggaacggagagctaaatatataaattaacctcaagcagatgattcctgtcttaccaatgcataagagctcagacatggcgcttaaattgccagtgtggatatctgttgtgcttattgttttgttcagtgtgacttctgcttcttctccagttccgagcaagaacaatggcagcaacaccgaccttgctgcagtgctggctttcaaaacatcaaatcttataaaataaacagctaataaattcctcagcataaatgcaagggatatgagtaagataatgtttgcattaatatatgtcatttatggtgggttattgtacccctatatgaacaccggcaacagtgaaggtcatagaagtagcttatcaaatcatcaggagaacaaaacactatagcctgatcttgtgatggcaatcatttccaagaaaaataacacaatggccctcggctgcttggtggcttttgtgatcttggctgtcgctctctcatcctgcaaagcggacggttagatttaatttcctctctacaatgtctcctacaaatttaaacattgctccaaatcttagatccatgtcaaatttaaagtttgtatatatgtttgacggagctcgtggctcctcaccggcagaccgcacaggcccccctttgccggttcggccgggggcttagggtgaaatctcaagctctctcggtatgtggaaagatcgcgagccccaaaagaaacgcaagacacgagcgatgtatacaggttcgggccgctgggaagcgtaataccctactcctgtgttttggtggatctgtatatgaacaagtaacaaggtgtcgacccgccccccaatcgctctgggatcggatctagaaaaaggtctccagtcgccctttctaagtgggcaaggtcctccttttatatctcaaggggataccacatgcccctctctctttccaaactggactgttcttttcttcataaatggacggagatcggtacggttcctgtccgattgcccttctgacgggacagcccatacctacccccactttcgtcggaaacagggacgacgtgggattatggctgtccgttgatgacgcgaccagtgtcagaccggtcattcttgtccactacgcgtcagcttagcaacgtgcatgtctgcccttcttcatgtaacatcttgcctgtaatggttaggatgaagcctggtataaatctaaccagggctaacgtgccatctctaagagataacacgctagctccggcttgagacgagggcctagaggctttcgtcttgacgggatggggcaaggcgtgcgtcagaccgccagtcgccacctaacccgtgatctgaccggtctgtgacaggtcacagaccggataaaggaacgcgctgcactgcgctgcatgcagcgtgacacgcttgaccagactacaataaatgcggttaggtgagcaccgccgtgttcacctatcccatatatgtggtgcaaacttcctcaaggggtcagggtgcttcggccctcggggccggggcaggagtaacctgaccccccccctcggggaaatcaggaggagggcggacacgtcaccctcgggcccgacgtccccgaaggtgccaggccacgtgggcgattgtgtctgcctcaagcctctggtcacgatactcccggtcccatatcaccgacaatgttaaactacaattgtttaaaatattttatttcctctaaaatataaataaaatgatttatttaaatattaccaacgtaatcacagaatttctacatttagaaatacctagcttaaaaaaaataaattagagttgtgccgaacaaggccaatatacagagttgtgccaaacagattgaagattttataagcgaagatttttgaaattgtggtagttactacaaatttgtttatctttagtacctactgtaagcatggcatcattcgtccaatatgtatgtgtacccaatagtatatacatcatcgtatgacagaaacttggatttgaatgcatgcagaaaacagaccttcaaatcacagttgctcatttttttttaaaaaaaaataatgaaccttttaatctatccccgctataggacagaatatagatgcaataaagctaaggcagaatatatctacctaaaaacctcatctactcatttttattagctggttgaattgacatgcatacaaaacaatttgtataccgtgaaaagagcagccggcttccttaatggattggatttcaaatctgattagtcattaacccgttaataaggactccacattagcaccaaactgcacagatcttggaacaaaccgcatggtggatgagacgggagtaactactcccggtagtagtatataattttcatatatatatatatatatatatatatatatatatatatatatatatatatatatatatatatatgtatatatatgtgagctattagtacaaaactgcagggagagctatatggccgtactaaaacacacatgcccataatccggttgattttcttagtcataaatatagttgattgattgatttagagaataatctatattcgcttaattggtaatcatacgataattttatgtttaaaaggatagcggttggatatattggattttcttactttataattactgtaaaactataatggtagaaacagctgtgcccaaacaatgtttactgtaaggacatgaatttattccccagttaaataattgttttcccgataatgattaagagattactgcaaaacaattatatatatttagtttactccacagttaattacatatatttttatacaaaataatatttcttgaactatatttgtaaacacgatcttgatgttagacggttcacaaaaccgatggaatctcagtttgtgataaccggtcgatattagccgatcttggttgtgaaaattttcgtatggtattcactgaaaggcgccggttttcgatcggatttattgctgtttttttactggttttcgatcggattttggtaaacttgtgaggagcggtttttacttcgaaatcgaaaaattgaaacctattttagcaaacaatctaccatttgcagtagtttattgccataaacaacaaaaagatactaccaagtttttcagcacaaaaatgctgttgtttgaactcttctgtcgtgaccatcgtctacttgttgctgagcatgatgacaatattcagatcctgtaaaatgcatgtgcagtaccatggcttaaacttgaaccaaaaccatgggctaaacttgaatcaggaacacatctcaatgtgagatgaaatacagcgcgattgcattgcaacaatatcacaataaagaagagaacaaatcaggaaacgctactctcacttttattgcatcgcagtagtagtttcagtacatcaataacctatccagatctcgtccaagtataacatgtatcaagaaacaaatcagccatctgcagagaactactgcaactacaccacactctcatccatgtcgcacccatcacgcattcagcatcttgcctgcagatcccagaacttgcatcttcatttatgctgcggccataacgcattcaattgcttgcttgcagattccagtcatcgtcgcttctggcccatacacctgcagtgatgggttgttcaaacagaaatcagctcatccgtgttgtgtgagggatggtcaggatagtgattcagaaccaccaacaacaaactgataggtttgcccatttgcatttatgaacttcagacataacaggtcttgcatagcaaagagagaggtgcagtaggagacactagatccgtacctcaatcgggacgccgagttctgcgccaagcttgcgcattttagccagcccagtttggtaatttggaccaccacgtcggacatagatgtgcatccttgcagccttcaacttggattcctgaaagcaagtttcagattcagttgacagtcaaccaatcagatgaacatgtggaactggtgataagttttagagaacattggccacaattcgagatttaggggtcagcatagctaccttctctcttaaggcccgaatgatgccgctaaatgtggccccgacgtcggtgaagttagctataccccctccaatgagaagagctctcttgcggccatcaggatcagcagtcgcacactgcattgaatgttatcattaacaaattgacataacaagggagtggagagaaatgtggttatggttatatcttgagtgcttacatcaagtactactctagcatactgcagaacctcctcctcgttgggagcaccgctatactctgcatagttttctaattctgaagcatatcccaaatctccgacatggtaaataagaaaaaaaaacttaatttcatgagagtagcatgaaatccttgaacagctaagttaaaacaagggaggaactcaaagcttactgtatcagcatatatgacactggcaccacctccagcaaccattgtccagatgcgcccctttgggttcaaaacggtgaacttcagagatgcacttgtctgaaagaataaggtcattatatcacatttagcaaataattcaaaaaaacatatagtgctgagccagactgccagcactcctatctgaattcatgtgcaaacctactgatgatattatacaggcaactcatacttaaaaaagattggggaggaggcttgaaatgtgaaacgtgtaatttgagatgtggataccttctcatccaagtcatggataaagccttctgtagaactgagaactctaccgaatggtagtgggaattcgatatttccccacctgaacagtgacaagaaatgcttaataaaacattcgcacagaggcatgtatgctagagaagcaatgagacttacttcttgaagttttgaaagctgctgtgtcatctaattctcctctcatgtccagaggatacggctctccattcacgatggtaaatgggttcatctcgagaaatgagaaatccaagtctgtaaagggagcatattattatggatacatgatataccaatacgcttattattacattttacaattaaaacattacaacaaatgacaagtgaattctatatgcatctttaataccttggaagacagcaaagactcctttaatgaaatcaccaatttttccacgtgcctaatgacgaaatgtacagttcaattattataagcatgtgacagatagaagtactcctcaaatgaaatcaactgaatgaggtacaaaggcaaataattttaacaggacaaatacctccaatggaagggtagcaatcaagggagcacatgcatcaggtgtcattggcttctcagtggaaagaaaaattgtcttaaccttgtcccagttctcctcaatttctattcctccacactctgagaagctaatggtgctgcccagcctctccgagacaatagaaaggtagtattcttgatcatggggtacaaatggctccacaatgaaggtggtgattggagccttgcagccacccatctcgacctgaatagccacaataggacagaacaacttaatttatcaagcgaacagagaataagtcagattttaaaggcgatagcaaaattgaactacctcaactcccagcctctccttcacaaactccttgacttgagcaatatctaggttgagggccacaagtccgctcttgccacgcttcccgaacagcatgtcgggcttcacgaccaacttcatggttgacagccatggctgctggtttaccagctctgtgaagtccgtcgattgtgtaacctttttacaaatcccagaatcagccaaaccgatatttttaacttcaaacaaaaatatgctatgtcaaacgagaaccgtaattaagattaatttcgcgcatagtgcaatttgtataattcaaaatcagtcagtttaaactccctagtgaccccaaatgtgtgaatgtaacaaaaggaactatctgcttgtatgtagtatttcagaggaaatcactctgcatcaggacaacattcaagtgtcaacatcatgaccagttcaccaccatacggacaccagtaatgaattaattaacaatttagacatacaaaaaaaaaacaaaaacaatactgcaagacaaaactccagtctccagatctaacaaagaaaccgattcttttgcactactgccagtaccaaactgcaagcaataagccgtactagttccaatcaaaatcgcacctttgcaagttacccttcacatacagaaccaagaacatttccattctaaaatcaaaatcctgtcagtgagcccatccacaatgcctaccagcacaaaaattgcatcgtcctacgacttgtacccagatcccccatttcatactatcaccattgtattttatcctaaacagagaactatcttctcacgaattaacaaatgccaatgcctcattgagtaatcaatatcgaacccaaaaaagaaagacaaaccagatctttacagtttacacgcaaccaggccaaatcacgcgggcccaaatcaggccaaaaaaaaaaatgaaaaagcgccaaccaaccagggatcaccggaaacaacagctaaaactttgagatcaagaagaagaagaagaagagagaatcgaacctgggcggagaggatctggaggtcgataccggcgaggcgcttgaggtgctccttgaggaggcgcttggagtcgtactcccggatcttcttgcgcgccatggctcggttagctgccgccgcgagaggagaggcgtgggttcttgaggagggttcagcaaaccaactgcagaggtaggtaggtaggcggagtgaacgaagccaaccaagatgaaggtggtggtcttggtggtgtgtgcacgttgcgtctttgggaggaatggaatgaatataaagaagatgactcgctgtgttctagattggatctactaagtaaaagcaaacctgcagcatcagtgtagaagagaagcattaattaattgactaaactactgctaattgtgatatgcatcctcctgaattaattgtctactgaagatattgtgatatgcacaccctgtatgagaatgagaccatgtttatgaccaatcggaccagattacattgtgctgtgcgagaataatggtttctgcctttggtttccttttccatcttttggtgtttcttggtttgacagtggatggattaattacgttattaaggagaacaattcagcagacagactagtgactagtgattagactgttgaacaggtgttggtttgtttgattttggttcaggaaaggttgttttgcaagagaagcgagagggagagtttggtgtttggtgagtagatggcagttgcacaatctgcctgcttgctggtagccttgttgtgctccagttaggtagcaggtagatgtgatgacttcttttctcttgtgttgctgttggtcctctgatctactgcagtgttcagttttgtttttctggccacacatcctaccaaaaaccggcgaaatagcgatgatatgggcccaaaaaaatgtggcactctgggcctgtgattgttcagacagtaggtatgggcttaaatatttgggctgctcccggttagtatttgggcctgatttatatacgaacagaagctgcaaacacgttgtatattttaatctgaatttttatagtatatttcatatagctacaactattttttgtaaaaaaaaaaaaaactatcattctgttacaacgttagctcaaaattttccaagagaactacagcaatatcgtatgatttataaaataaactacaactctatttgaatgataaatttgcactcacctgtcatatatactatacatgttactcattctggtatgagttggctcacatgtcataaaacttataggaagataaaatcatagttttttaataaaatctttgctatgttgcagttttggggaaataccagttaaagttatagtgatagttttgaaaagaaaatttacattgtagttttgtatgattgttagtgtgttccagcatgtaaatagtgtatttgtatactgttggctattagtgcatagtggggattgattgctgaaccactgttggctggatccttgttccatggcatctggcgccaatgtttcccgccaaattcctttcctttccattccctccaactcaaccccattctctctggagtcttgctggtcaaaaaatatcctcaaaaaaggaaaagaaaaaagaactagggtttacgctccatggaggtcgaagcccagacctcggccgccgcggcggcggccggcgacgagctccggtcgctcctctccgccaccctgagccccgacaaggcggcggtggacgccgccacggaagggctctccaggatcgccgcctcctccgacccccgcttccccatctccctcctcgccgtcgccgcaggtaccctcccctttctcgttgtagctgtgctggtggcgtttccatgccaagtgctaccgtgttcgatttctgcggaagcttgtggatatttttgcttctgctggggaatttgagcagtggtagcctggattgtaatttactaatttgtggaactccatgcaaaaatgaaagctattttggacaaatcacttatgcatgtttgatgtttgtctgtctattttaaattgccacacgcagcacccaaaatccaactcatgattcgataaactgcagttagcaagtgcgggagactatttatgtgcatgtaaaaacataattttgggaaatggttggtgctctgtccatggagacgaatatattgatgttcttgtttcattttgagatattgtacagaaaaatggaaatgttataccagtatttaggcctggtttagttcccaactttttcttcaaacttccaacttttccatcacatcaaaactttcatacacacacaaacttccaacttttccgtcacatcgttccaatttcaatcaaacttccaattttagcgtgaacaaaacacaccaattttagttgtgagtatatgtgttctttttgagcaatcaatgctcaggcaggcagcccacctgacctttataattgaattgtgcttatagctgatggggaccaaggaacaaaagttgctgcagcaacatacttgaagaattacacacgccgaaatattgactgggggttgtcatcacctgagctttataaagagttccgtgatcggctcgcccaggcgttgcttcaagtggaacctttccttcttcgagtattgattgaagttgtatgtctcatttctacttaatttctctgcaactaaattcctcactaccaagccttttttgggtgttatcttacatccttatggtttgcatcaaacagttccgccaagtcatagaaaaagattttgtcaaggaaaatttgtggcctgaacttgtcccccagttgaagcaagtgatccagagcagcaatataataagtccaggccagcatcctgaatggaatactatcaacgcactcacagtacttcaatctgttgttaggcccttccaggtatatctcatggactaatatttcatatgctgtatgcctttgtcgcatgtttttgaaaatcaaatccttcactctcagattttagtttttgtaagcgtgaacattttattttaacttcattttattcctttttttttgttaaaggactcctgtctctagcttgtccatacaagacataactctgttgatatttgtgcaattgtctgttctaattgcataatacttattgtacacatttcagcttacaaagggagtaaatagtatgccttaaagcttaaacttactttactcattatagagttttagcattcctgtatcaacaactactgcacataaatattttagtagagcggatttcttatttatttctagctgtgttatcttacagtacttcttgaaccccaaagtagcaaaagagcctgttccaccacaattggagcaaatcgcatctgagattcttgtaccactacaagtgacattccatcacattgctgacaaggttttgtgttgcactctgctttgctctaaatgctgtacacatgctgatctttcctgaactttttatggtgtgtggttctgtggtcaataggttctgttgtcacatgatgagactaatctggaatacgagcaactcctactcatcacgagcaagtgcatgtatttcactgtaagacatggttccttccttctgtattaaaaataccattatgaccataacatactatcatcatacggtaaaatgtagaaactgctattaataaaccatgtgctgtttgcataattatattgaagagtgccaattagcaacatctgggaaggttaagagaacgaaaggttgggctgagactgaggagtataatgtgtttgaatagaacttaaagcattactgttcatgtttatgtaaacaatttaggaatacaatactgagtttgttcttttggttctccaaatgctgtacttgaattactggtatatttacattgttttaattccatagctaacgttttggcatgcatgattattaacttgctatgagggatgcctaattgtcatactcatgcaggttaggtcatacatgccatctagggtaaagcagattttgccttccttttgcaaagacatgttccgcatactagaatcactggatttcaacagtcaatatgaagatagagccacaacaaggctcaagactgcaaagagatgcctcatcatactttgcacacttgttactcgtcaccggaaacatgctgacgagtacgtactttaatgtttatcgtcattcttatccttttagaatactaaccctccagttttctcagccagatggcacatatagtcaacagcgcaaccagaatatcaagtcaaagcattcatttacatgtaagttcagtcagtggtttgtataatccttttatttgtacaatgtgatgaagcccaaacatcatgaacccgaactaaagcatgctagattctgaaggttgcgatggtcatcagtcatcatgatcatttcctaatttatttgacgagattctgagagtgcttaatgattacagaaactcggccctctctctgatcggatcatttcattgtcatttgatgtaatttctcgtgttctggagacaggccctgtaagtatttacattatgcagttaaactgaaccaaaatcatgattcacatttttttatgtttgaatttgatgggtctgtgctccttggttgcagggatggcgacttgtttcaccacatttttcttcacttctggattcagcaatttttccagctttagcattaaatgaaaaggtcagctccctgcctttttcgataggaaacacataagtactgtttcaatatgtaatttgtttggtttaaactttatctgtgtgcaggatataacagagtgggaagacgatactgatgagtacatgcggaaaaatctaccttgtgaacttgtatgtacatgaatccatcacgctaattttctctctggcttttgtgttcactgatatatttgctggcaggacgacatttcaggatgggctgaggatttattcacagcaagaaaaagtggtatcaatttacttggtgttatagccctatcgaaggttgtgcctttttccatagtggaatggaacataataacaagtttagatccaccagtatcttttaacattgaattgctatattaataaaccctttgataaactgttccttcataattcataaatcattataaggtattacagcttttgactagcactggtagaaggataacaatattctttttgtattgaattccatttgcatctatcacaacctgcaagcatacatacttaaaatgctattaacaactgtatgttcaatctacctagttcacacattttctatctatcacctgaaccttttcacttattgaattgaaataaaacgtttaaagatgttctactcatgtattagcattttctggcatcagggcccaccagttgtatctgcagcttctaagcgtaagaaaggtgataaaagtaaaggaaaaggagaaaggagctccattggggagttattggttataccattcctgtcaaaatttcctatacctccccagggggaagatgtgtcatcaaaggcagtgcagaagtaagaacataataattacttgttttaaccaagaaaaaatggtagcaaaaagtctagatatttgtatctctcatgcttacaagtgaactacagcatattcgttttgttattttcccatatttctatatagttggaagttcacttcatttcactgtcactcattccagttatttcggtgttctaatggcatttgggggcctccaagatgtaagattcagaagatgtgtgttttgtgtttttttgttagaatgaataccaatgaatttcagtaacccattttgcagtttctgactgagaaaaaagatttgacaaatacaatcattaggaatcgtattcttccactgtattccctggatccatgcagtccatatttgatttctgcagcaaactggattattggacagcttgcgttgtgcctaccagaggttacattttttccttcataattttatcatccagccttatgaaataataggtgaaaacaaaaggcttcattaatatgtacgttccaatgttccatatattatatatttgattttctgactgctgtttgcttggatgtaggccatgagcacaaatatttatcattcattaatgaaggcattgacgatggaggattttgatgagttgagctgttatcctgttcgtgcttctgcttctggtgccattgcagaactcattgaggtaagggtttatgtgatgttgtcaatggatttcacctgccacttggaagttggaactatgctagtatgccactgagatatttctttgtgcctcatgcagaatggttatgctcctcctgattggcttgtccttttacaagtggtgatgaaaaggataagcgttgaagatgaaaatgagtctactcttttgtttcagcttctgggcacaataatcgagtctggccaagaaaaagttttgcctcacattcctgaaattgtatctaacatagccaataccataatgaagctattgccccctgtgccagatccctggcctcaggtaattgcacatctgtatcctctatttgtcaatacgttagtgttttctgtaaaagggaaaataaacattgccatatatttaactgtaccatcaagtgtcatttccattattaatatttttgttgtttgtattagggattagaattttactatattattgctttgagtggtagatgtcttgaaaggtaggaactgttcccaaatttagcagatttggtaataggtatacttattgagagtgaagctcaataagtagattatgagcatttccgggcttctttcgttataattattaattaattacgacttaaaccatcatgtgcaatcactagtgaacattgagcacacatctttcaacatgctctctgttcaggagtgatgttttgggcacaaacagtatccaacatgcacctttgacctttattttttgtataaatatcaaaaaatgcttgtgaagaatcagtattttctcatgaaaaatctaatggtttcattttgacatgacaaatataaaaactatttgacacatcagtgctcaaagttaccaaagttaataaagttgactatgacaatttctaaaatgttgcatattttcaagcggagggagtacatgcgttttataacccatctgcattatatttcaagattcctatgtgttcaattcatataggaaaaattcccatcaaaccagcagatttacatgtatatgcttttaggctgttgaacggggttttgctgcactggtatcgatggctcaagcttgggaaagctctgcaccagatgaaaacaaggacattgaaatgagggtctggcagtcaggccagtttgctatcgcccaaacattttcgcatgtgttacaaaaggcttggttgcttccagttgagcaaatggtatgctacatttgctgtttattttttagcaaagctaaatgctgtttattgaggcattcatgtgatgaaatctgcttgattgctgttaacattcattccaggggttatctgtttgctcttcattgccacctctgtcatgtgtaaatgatgcttctattttacttgagttcattatgaggtctatcacctctatggaagaaactgcaagtatgaaggtgtttgagctagtagctatatgggctgacataattgcttgttgggattcttgggaggaaatggaggatcagggaattttcaatacaatcaaagaagctgttaacttccatcaaaactttgattctactggtttcttcctgaaaatactcccttcccgatctgaaaatagttcacaaagttcagtcattagttgggtttctagttttataaccagggccattgaagcttacccatctgcaacatggagggcatgttcatgcatgcatacactgctgcacactcctaatttctctcttggagcagaagatactagaatgactcttgctgtatcctttgcgcaagcagcattctcccgtttcaagtctgtatctgacagcccttctgggatatggaaaccactaatactagtcatttcgtcatgctacatatgctaccctgatgctattgagcaactcttacgcaaatatgacagtaacggttatgcgatatgggcatctgcattagcacaaatctcaagtagctctttcaatcctggcttgtcatctgaatccgagatcaaactagctggtaagtaactacttactgatcattggaatgtttaatcttgttcatgtttggtctgtcatcctgtgaaggtacatcctgaatttgttttctgttattgtgcagtgttaacgttagcaactgtaattgagcgtcttttggccctttctacgggtggcaccaaactgttgcatgattgctgtgtatcattgatggagtcttgcatccatctgaaggaagttcaagaggatggggatgatggtgatggtgcagaagatcttgatgatgatgatgaagaggaggaagacaccgatgaagatgatgaggtaactgagcagaatcatgatttgtatcttctatattcatgcccaaccaaattgattgaatatcacaaacaacatataatcaggattcggatgatgatgatgatgtacgcgaagagacagaagaggaatttcttcaaagatatgcagcggctgccgctggtgaatcaattgaaattgttgaggacggtgacattgatgatgaaacccaagacattgaattgggtaaacccgaattattttctccatcttaatcttgcctcaatagttcttttttatacatatgtaactttactttcatctcttggagcaaatgcaggttccctggatgaaatggacgtacaacaagtggttctttcgatgatgaagattcgtcctgatctcattcgcgctcaaacatttccggatggcctaatggagagaatggcagaaacgtttcctgaatatgaacagttggtccatgttcatcggcaagccttggcgatactacaatagactagtgtgcagccttgttatttattgtttctagtttctttttttttaacttgtaatatatttatctgtgtgtttatatatttgtatggaatggttggccgattattttttatggttaaggcgattattaactatattttgtgatttggatcggagtaatctggcgggcatgatcttttagggagttcaagggtagtaccatgagcaacacatgggtttgcttcttggttcctacaactgtacttcactgagtagtatgtaagctccttgggagatgtcatgcttgcagtactaaagaaagatttagcacaactttattgaacttatagcattattattttgtctattttaatcaactacagctggattgatccgtacattaattagttcatttcattttctcatgcatgtttccgttttgtggcagcagcaagtcccttcctgaatgcaataggcgtattttccgtttaagcttatcttatctcggcaggctccaccgttcatgcaaagataggattgaagcaataatctgtattaaaggcaagaagttaagcaacaagaggcaaaaataagatgcatcaaaatgtgttgccaaatgcaaagtgctaggctgctagctagccaacatccatcgagttccacattgcaaaaaagtgttaacgagaggatcgagggattaccgtctgctgagataagagcaagtttaatagtatagcacactactaactccaaatcatatataaccaatataagaggaggtagagaaccgggcgttgctcggttcgatccctgggatcgcaactcgcgtgtctcaccaggggtttttccccgtttccccgggactgacttcggttggtcccggctaggtaatagggtacacacacgtgtgcgcgttcagtgggactgtacgtttcccgtgcactgaggcctagtgcctccaatgttattcctagcgtgtgttagtgacgcgcacacgtgtgtgtgcgtgtgtagtggtgtgagtgcggtgtgtgtaagtgtgcgtcctgggttgtacccttctcaaaaaaaaatataagaggaggtacaatagcaggctataagccagctataaacatattataaagagataaaggaagagagagaagagcagcgggctacagatctgtagctagctgcagcacgggctccaaaacgtaatgtgtgtgtgacagggggaccagatattaatagtaccgtaaacaactattgtatgaattggctattacattggctatagatgatttgaagttagtagtgggctatactattaaacttgctctaatagccaattcatacaatagtttgacgcacaaatcctttgtgcatgtaaattcaggattgaagcaatagcctgtattcacagcaagaaaacaacaataaaatatgcactagtttaggcattttcatcagtaggatacatgtacatatttgagacacatcaaatctcaatatgcatactgccaaactaatattgataaccaataggaaaagctatgttgaaccatctgcattgncaggatgagagagcaatagccatgatcataatatatagacaccatgagagggcctcacgaccacgggcggtgaggggacccggcggggggagtaaagagtgttggcccagggacgaacccggcgatccatagtcccagccgaggaggaagacgacggcggcctgcagggccatttacagtcgcgagctagatgccggaagccccggcaacggcggcagcacatcgggagatggcacgaggccacttggtgcgaggtggagagacaattcaagcatcagtcgaggaggttcggcgggatgccgcaggcaccttgctcagccggcggtgacgacgacgggcacagacgtcagcgtgaacgacggtggcgtcgaccactgtaacgccccgctttccgcgtgacgttaaaagctaatttacgaaaaccctacttgcgaaaattttgttctttgagtgctgagtctaaagtcgtgccgtagatctcagtctaaaactctcctttgtctcaattcccgattgtcaaatcatctactcaaaatctccatccaaaatcaatacttgaacctattgtattcatatctcccttctaaaacctctaccgagatatttcccttcaaataatttccgtttcgttgtttcccctaaggtttgagtccgcactcaaatcctcttcatttactccttcgaaggttccacgttttcaaatcttagaaccggtaaaccctaaaacctaatctacctctcacctttcgttttgaagacagtttcgaagtccgaattcgtatattcggatttcgttccaaaaacactaaccacaaatatcgtcgcatccatgaatccaatctagtccaagcatttacctcgtaaatcctaaacctttcccttgatctccctcccatgatttttccatattcccctaaacctaattcccccaaagtgatcgcccaccgagaatcctcaaaccctaaccctaattctctctaatttcaatcccgtagcagaagtctagttcacctcctctccatccttgggccaacttctctgcgaagtctgttttgcctccctagcttggcccaacactccccagcccatcttcctctctcctttccctctcccacgcgtcctctgccgagcccaccgagctaatttgtttcgcgcgctcgcgcgtggtcgtggccgaccgccaaggatgatgctgccatcaccccttaccgtcactctaccgccttgtcctcgctccgctccacgcccactgcaagagtagaagtgaaagagaggagagagagaggatgacttgtggatcccacattgtacttttcttaataagccgtgatgactagagcatgacatatgtgcaacatcggaccaaaaccatccaaaaacaatgctaggggatatcgtccggcttcaaaaatccataggtatagaatgtctttacgaggataatcaaactaatgcaataattcagggtaaatctcagactttatatatgatggttaagactataattttttaacttgaaataatcgatatactagatctgtagtcaatcagaggtttatctttagttaacttcaatctgtagttaacttggtggatacatgtgactggggtatatctttttatattattgaatcaatcagtaagagatcctcgcaaactatttgattactcgagcggatacctcttgtttgcttaaaaactattcaaatagttatgaaataaaaatttaacaacactcatacaacatatttatacaacttcacaaaatcttaggtccaagctcaacttacatgttgagatataaaaagataaattcaacatatggatatagtagcatactgttcatatctaaatttgtctttttttttcaacgtataaatcgagtttgaacttaattttttattgaccgatagatattaatatagagatatactctatattattatattttttttaaatttgtttataactatttatattgaatttaaaagaaaaagatacgaggaacgtctcctcgataattacaatccacttatgagatctttgcaagcttctcccgtgacggtcaagtcacgtctcgtttgtttacaagctagtcctggtcatgtcaaggtctcctgactcctgtagagtccttttaaaaagttatttttttttaatggaagtccattcaaagtttcattgaaatcaggctggcaaaactggaggagtcgacaagatattccattccaaggcgccacttaaagctggcctagtagctggaggcaatccgcaagacggagacccacttcaaagggtgtgacctaacaaattagcatttcacgaagcgacaacgcagcacggagcagtggcggatctataaaatcgatttgctggtgtcataataacgtatgtatcggcatcattgtatgctaactatgtttagatcatactggtataatatatggataaacaattttgctataggacttatcgaaagttgtcggtgtcgcggcgacacttatattgtagatccgcccctggcgcggaggctgacgagtccttttttgcttttatttttgtcccgatgatttactactacttctatgacattactgttagcagtgttttttataaggataagataacttttattttggttatttcttcatccgacaaagtgatagtaacattgtttacaaaattcacatatctctttttttttataaactataacatagatatataaattttgtgaacaatattactaacattttattggatgaagatatgataaaaataaaagttatagatcttgatgagttatataactttgttgttgatgacttttttagttgaaatcatttagtatttgaaaatattgtttgaagttgtcatattttcaaattcaaattcaaactattcaaaaaaatatataagaaatgaccaaaataaaagttatagttcttgatgagttatacaactttgttgttgatgacttttttagttgaaatcatttagtatttgaaaatgttgttttgaagttgtcatattttcaaattcaaattcaaacggttcaaaaaaagttgtatagaaaaatgatcaaaataaaagttgtaaatcttgataagttatacaactttgtcgttgataatttttttatttgaaataatttattacacgaaaaattattttgactaataaaacgaattattatactgcagttaattattttgctacaggtcaactcacaaatataaacatttcgtatgaaaaatggaaaaaaagtcatcgatgacgggcgttagttaaagcccgatagaggttaagtcatctcaatcgggcattagtatagagcccgtcacggatgagttatatgcgacgggcctagttgttatctcaatcgggccccaagttggtgcctgtcacggatgatggtcatctatgacgggcgccaacttgaagcccaattgagacatggaatgttatctcaattggatctaaattacggcccgtcactgataggtgtcatccgtgacgggcctgtgttttatatccatctaacatgtatgttcgagcatatctcaatcgggcttttttcagctcgatagagatgactttcttgagacgactcgctaatttcagacatgttagagttccaagcatgttagaggccgtcacagatagaagattctgtactcgtggtagtttttcttttttttttccactcaccctcaaataaataatctttactgcatgaaacactacgcgcacgatatgtaatatttatatgcaaattgaacgttgaaaagtggtcaattcataacccttcgtcacgccgcagaaggaaaattagtggcatacaggcatgcatttacgtacttgaaatatttttttgtcgattgggtggtgagtggcaatgcctgtctaccactaccctaccgttacgcacacatacctcatgttcattaatttatgccgtttccatttaacatctctacttcctaaggaaacagactgactgacaaataggacatgcgattttgttttaatcttcagcatatgactttgacaataaatttagcctccaatggaaaaaaaattcaactctgaactctgaagcaaagcaggacgacccggccggtcgaccacaactctgcagtatattggcgccaaccttttctacgcgaatcttttcacctccccaacttgatcaatgctggatcaacttagaacatgagatcatatggtagtaaattcacaagagtgatcatcacttgctgttttaaaatattggtagctcgatcagctcgatgcatgtgttctgattggaacaaactctctgacttatattattgttcctctgaaactctgactacattattgttcttgtgaaaggacagcatgcgaagcttctctgacagtagctttactacgagatgggctagaagaagatgatcagataacaaaacaaaagttgctggcgatggtggctggggaatcttctcctgttaactttctgaatcgtcagagcagcagtgttgccatctttggatgcttgtgttgttgtagccactaatcgctgcaggagcgcatgcgattgagtgccaaataatgtaatgacactttggattcttgtggcctgacatagcacgctcatctcatcagctcaatcattcatgaacatgtatgtaagtttatgcatttttgtgtatctgcatatctgtatttatgtgtgtatatctctctgtagactgtacttgagtgattcgctttcttcagaataatgtatggtgctttacactgtgtatgtcgttcctgtggactgtgttcttcctcatggctgttctttgtcttgataagagaactcatctgtgtgccttttttgttttgtatgtttgctaacaagtagtaccaactaattaatactacctccgtacttgagtgattcgctttcttcagaataatgtatggtgctttacactgtgtatgtcgttcctgtggactgtgttcttcctcatggctgttctttgtcttgataagagaactcatctgtgtgccttttttgttttgtatgtttgctaacaagtagtaccaactaattaatactacctccgttttttaatgatgcgctttcttcagaataatgtatggtgctttacactgtgtatgtcgttcctgtggactgtgttcttcctcatggctgttctttgtcttgataagagaactcatctgtgtgccttttttgttttgtatgtttgctaacaagtagtaccaactaattaatactacctccgttttttaatagatgacgccgttgactttttctcacatgtttgaccattcgtcttattcaaaaattttatgcaaatgtataagatataaatcatacttaaagtactatgagtgataaaacaactcataacaaaataaattataattacgtaaattttttgaataagacaaatggtcaaacatgtgagaaaaagtcaacggcgtcatctattaaaaaatggagggagtaattgttagtttgtcactgtgaagattgggatatgatgaatgacagtgagaaactggactggcaaatcctcgtgtgcctctgtttggcgccaaaccatcgaactgcccggggttcctttgtttgagctgccttaaaacattatgtaaattgtaaagtgcgatatgaagatctttatagtgtaaaatttgatgtctctcggtatattaagctaaaaattattgtcttttggtacctctggaaaactgtaaaatttctatgtaaaattagcataataaactcaatggaattgaattctaatccctcgagcaaatatttgctatatgcttcccattcataaatggaatacaagtagttaagagtgcgtatttattaaaaaaattatatattttcactgaaaaaaaatccatctctgatagtcaactgcccagtagtggtagtgctacctatccaagagtgcaaaggcatatgaacagatccaacctaattgggcctagttaataatcaatagctgtactactagaattcgcatcgagattctcttctctagctaccacccattttcagtgctacaaattaaatagccatatgcatgccctaattaagtaattaattaaatcgatactccctccatacttgtaaaagaagtcgtttaggacatcgacacgatctctaaaacacaactttgacttcttatttctataaaaatacttattgaaaaatgatatacgtatatttttatgaaagtgtttttcacgacaaatctatacatataatttttacattttcaaactcaacaacttgagagttattcatgttttatattcctaaggtttgacttaaatattgtcctaaacgactttctatatccgataagtatatgagagtatccgatacgtatctatatccaatatgctagtttttagaagtattcaggtgacatacgtagtaggtagctagtcgtgagccatggacaaatatatttccacatgcatgcacggcagtggtcagaaaaattccaacaaattagaagaggagctaaactaattgccatatttcaactttctcttgtcttacaaggtggacttggcacatgtgcgcacgtcccgccataatgccacctaaatccggccaacaatttttgacagtcttattgtcttaggcccaagtgttcaaccttaagatcatccactatcacaagtggaggattaatttgtatgtgtccaggtccataattcttcctcatgccatccaagtttcgttccttttcggagaaggaattatatatattaatttcaccctaagacaacacgatcactatcaaattgcaagttgtgaaactgtgtgaaacttcgcagagcccctgttaattggacatgcaggctgctaatatgaccagatgtaatacagtgtggttgataccgatcgatctcggccgttgagaaacagtgaaactttgcagtaacccagggattcggatcctctgcattaccgcagagaggcactgtagccacagtgatatgtgaggggaacagtgtgtcaatgcacagaacactaccgctacagtgatgatttactgtatctacagggataaaattgataaaagttcgccgcgcgagttacggagtgatttttttttgtcacgaacgcacccaatgcacttcaatatgtccaaaaaatcatgttttggtgttttttaaactttttcattctggtaaaaaacatcgcacccacgtgtgccaatatatatcaatattgactttaattgacaaaggttagccgcgcgggtcacggagtttttttttttttttgccacgaaagcacccaatatactccaatatatccaaaaatcatgtttttgtgatttttgaacttttttatttcaatgaaaaacatcatatccacgtatgccaaatataaattaaacaccataacaagatcttagctaaggtagctaacacggactctttttatatatatcttggacagtacgtactgtcagttaattaatccaattgaatgatgaattaatgaatacacaagatgaataaaaggtttgaaaatggaagtggtgacgcgcgcggcagctccttgctgacggaccaagattacgcaataaaaagcgaggaacgacacaggcctagactggttggaattaattaaggtttgtaacagcaataatgcaatagttaagtaagtttttccttgatgcatgttaaccatttcgacggaagtcggtcaatgatgaagttgaggtgttgggttatgaagggacatttttttttttgcgggaaaggagattatattactgagaaactagctagctcctcgttaacgaggagagagttaaaaaattacagctattatcagaccaaaagcccttattggctaaagtatggctacaaccattttgacttgggtgaatcttcttgatgaagggacaaattaattgatgtacgtagaaagaggcacgttggctaaatatataaccagctagctgcaacggaaaaggttgactaacttgcgattcgttaattaaatggtgcatgaatctggatcgccaacagctagcgtaacatgcatgtagattccatccatcgtgtgccccggccgcatatatatagacatgcatgcatgctagctgatcagtatgtgcagatctgctataagcttaagctcagcttaattagccacggtacgtagtttgtacagaaatggcggtgaagaaacacaacgtcgccatgcaattacaagtggtagtactgtggcttgtaggagtagcattattttctgtgatggcgtcgtccgctccggcggccgtagcggcagcaccgccgcccgcggagtgcccgagcaagtgcggcgacgtcgacatccccttccccttcggcgtcggcgacgactgcgcatggccgggtccagatgacttcaacgtcacatgcaaccatagcttcagcccacccagaccctactacggcaacatagagatcagggacatctcggtggcggcgggggagatgcgtgtgtacactcccgtggtctaccagtgctacaacacatccgaccacgtcgactcttcaaccagcttcctgcagctcaacatcaccgactcgccgttcctggtcgctccggggagaaacgagttcacggccatcggctgcgacacgttggcgtggctgcagggcagggatgactggagcttcttgaccggctgcatcacgacgtgcgtgagcttagacgaggctgcccacgacggcgagcagtgctccgggctgggttgctgccaggtgccttccattccgcccaaccttgccctcgtagagctgaattgggggaacttaacaaaaaactatgcatggagatacagcccatgcagctacgccttcgtggctgagaaagcatggtaagttaaatagtagtaataaagaaaatctagctatcaactctggtaacacaattactactccatatgcattggtgctaatattagtatagggacaattgcgtttttaccctattttaaggactaactactaatttggtcctgcttttttagttgaccctcttttttataaatgaaggcgagacttggccctactctgggaagtcaacatgacggtgttaacttaagacaaatgtttcatttatacccttgtgaatttaacccagtttcttaaagttttttattcaatgcagttttgtgcacttattactatatattaaattgcctcaaacacaaatatggcacggatttatgtctaccaaaaaaaagaaaagaaaaaaaaaacatgccacccctcctcctcgtagtcgaactgccgccgccgccgctcctcttcgtcgagccgccgccatccctcccatgccgccgccgccgccgcagccactcctccaccttgtcaagccgccaccaaccctcctattcatttagccaccgccggacggcagccattgcacaaggagagcagcgggaggaagttcctctaaggccgccgccgccgctccctccctacacaagccggcgtcgcctcgccgctccctccctccgcgagccagcgccgcgcggatcccctccctccacgagccgccgccgacgccagcactcggagagagagagagagagagagagagaggggatacgggggagagacgggatagataaggatagggtttgttcgagggtattttggtcattacgaaatgtaattatatttctttcttttttttaaaatgaaaacttaacggtgctatgaaaacatggtcaaacggagtgtttgttttaaaaaagtagggtcaaataaacaaactagaaaaaatagggtcatattagtagttaggcttcaaaacatagtaaaaaagcaattgtcccattagtatatgttgatttaggcaccacatttataaattaaactatggtagtttatagaatttagagcagatataagcgcatccttcttctacttactttaataataattttataaatatttctggtgaaccctacattcattttcatatttttaattacatataatttatgcatagaagaatgttatattattttgtgaatatatatttctgttcttattatatactattatatatagcacactcaaaagaaagagagagagaaaacaatatatcatatgcgggcgtgatctattggggcggggtgtggtaaggaaattacagtttgcattgtgttctctccgtagtttttctcaaaggcatgtatatgttatcacgtgaaactatttatacttctttaaaagatctaaatggtggtgttgagtgtggtgaatttgacaccaccaccattatgtgggtccccgcaaatagtgaggtaggtggacttttgtccatttcctaacctcaagccatcaaacatgaagttttttttttgagtgagataaaaatgattaaaataatatgacctaaatattttacaatgagaatagctttattttaattttggaggtttaaagtgtacggtgaggctctcatatttaatttccattgtaacatggaacggagggagtatcattcatggaaattgtggagttggcaacttactgaggatagatgtagatatctgacccattttcactccctactcaacaaactggactgtttagctagggcacccattgagtttactgatgcacatatatatattataatatatataggtacaaattcagccgtggagattttagccgtgccggtagcaagagctttatgaatcgtgctggagacagaagtgtcgttacagtgcttgattgggctatcaggagcgacggatcgtgctcgtcaacatcgcgggtcgctcctgcctgtgtcagccccaacagctactgcgtcaacaccaccaacggacagggatatctttgcaagtgctccccgggatatgatggcaatccctacgtcaccggtgacagtgggtgtacaagttagtctttttaatcaattatgtttagttagtcttttaatttccggctctatattgatatgcatgcatgcatggactaatattaatttccttcattggcatgaatgaattagttactacttcttgtatgtaggagtacgttgtaatctttgctgaatttgctcgtatgggattggttaatatgtttaattatactatttagtatttcatcaccaattattatatgtgcagatattaatgaatgcaagcttagaagagaagaccctgccaagtacagtgaactttatccatgttacggtggtagcaaatgccatgacacagagggtgattacaggtgcaaatgccgtttgggacgtagaggggacggcaaaatcgataatggatgtcaacccataattcccccacctgtaattgggattcttggtgagccatgaccattgttcatacttatagcgttttttaatagaaattagagtaaattttagaaaacctcacgcttttatgatcaaggttaaataaagccacatatattatgatgcgtgtcacataatctcacaggtttaatgtatgatctttgtgttttataataagacttcacctttattaaaatcttgattaattacagtatatatatttgaaacaattttttcacagtagcgaagagataaactatatatcaaccatactcaagaacataataatttaaagttttatatacaccatatgttttcaactttaagtaaattcatgctcaacatgcataaagatagggttttatgaaactttagagccataatacatagagttaaagtgccacaagtcataatacatgtggtttcgacaacttcagctatgtataaaacatgaagtttttgaaatttactcaaataatcaatgtattatgacttaagttgtagctagttactccctccgtcccataatatatgggattttgagtttttatttgcactctttgatcactcgtcttattcaaaaaattttggaattattttttttatgacttgctttattatccaaagtactttaagcacaacttttcgtattttatatttgcacaaattttttgaataagacgagtggtcaaacagtgtaaacaaaaactcaaaatcccttatattatgggacggatggagtagttagttaagtagttagttaaagcgtcatcatttaatattgcccctacttaagtatagctagttagttatatatgtatgtaacgtagctaatatattgattaatggtgctttctctaatctatactttctatagagttaaaaggccaataaatctaaagctcaatatgcaaccataccacaccatcatccactagcaataattacatatttaatctcatacaagcatacaacatgatctacaatttttttaattctagaaatcaaaatacaagcatattcaatcatcacccctcatatcatttgcataatattttaacaaatctatctatcaactttataatatttaacatgtacttatcaatatcaatatgtttcacactaaagcacgggtatcatttgactgataaaccttgatgtttcattattttcttttcttttttacacctaggttgattgtcaaaaaaaaaatattgagaattgcttagtaattcctgcagcaaatcacggggaatcacctagttacttatatgtttaattggtttgtttgcatttgcagtgatagccggtgttgtgctatttggtttggtccttgtgtgcttacgtaagaaatggaagcttaaagggtgctatgaccgtaatggtggccaaatgctagagaagacgagcgttaaaatctttacaaagcaggaattggacaagataactaacaacaaaagcaacaagatagggaaaggcgccttcggtgtggtctacaagggaacccacgacgatcagccggtcgccgtcaagtactccatcgaaaagagcatatcgcggactcgtggcaaggatgagttcgtgaaggaaatcacggtgcaacttcaagtcagccacgacaacctggtgtgcctcattggttgttgcctcgaggtggaggtccctatgctggtcttcgagttcgtccctaatggtagcctcgagagcgtccttcatggggcagagcggtgcgctctcccgctgctgaaacggctggatattgccattggctctgcgaaagctcttacctacatgcactcgcattcccgccgctgcatttttcatggtgatatcaaacctgccaatattctccttgacgacaaccttatgcctaaagtctccgactttgggtcatcagagtccgtattgaaaaccaagcaccgaagcgtgtgtgccgacatgggctacatagatcctgtgtatatggtaacaggcaattttagactgaagagtgatgtctacagtttcggtatcgtggtcttagagctcatcacccgaaagaaggccgtgtacgatgggaaaagccttccgatagaatttaccaactgttacgaggatgataatgccagaaggaatatgtacgaccaggacatattgtctgcagaggctctacaacctcactgcatggagtgcctcgacagaatggccggcattgctgtccagtgccttgaatacaacatagacaagaggccgactatggcggaggcgctacaggagcttatccaattgagagcaaaggttgcaggaaaatgaatgcaaggtccgatgttcagacaacccgtatgttgatagtttcgctttgtatcgtcgttaatttattatcatatcccccagcaaatgtcgacgttggtttgagttgaccaacgggtcattttaatttatctttttggcggggaagtgtcgttttaattagtatgtgtaccatttaccaacaaagtggcaattaaaagcaaaaataaattaagcagcatagtaagaaagttttcatccgatcaagcatatatatatatatatatatatatatatatatatatatatatatatatatatatataggcaacatatcctatgcacacaggccatcacgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgcataggatacgctcccatatatatatacctcccataccaaaccatggcatatttcatttagtggaatgttacggtccttcatatatataaaaggaggtctcaaattaatactgtacgtccatttagcaaatcatttttgatcgttagatctagcaatgactatcctgtccagctaaatccaacgatcggaaataccttgagatattttttgctagaccagatcaaatctcataattttagctatagcgatagctgatgcttgcatcagctgctggacctgacttggcccgcccagggggtaatgggcaacagacttgggccaatgggccgaaatcttctggcccaagaaggaggatcagcaacccaattagccaacttgctcgagcatgcatatgcatgcaaagtaaattaacatctcaatcaacaggacacatttaattctgtcaacttattattatattgatgtcattggccacgatagagatgctcgctctgcgtgcttcagatttaactacttaattccacaccatctactagctttgacccccaaagatcaaagacagccaaagcttgggagtacagtattcgaagatctgagatgtcctatatgaattaatttagtcttgccttgtcgccttggtgtaatatcatgcatggctacttacacttctttacttaatggtatgttcaattacattaattgatctgcttgttgtctcataaaaatattcactgctcttcttatgcatgcatctgcttcaattactacaaatactatgatttaagtgtatctagatttctagaattccccgtcttgtcaaggttgatagatggatactcctcattttagaatacccgtcattctagcgttcaaattatatatcaaaatacttgtcattctcatatttcatcatagcatgtttatatttcatcatagcatgtttagagaggtgaagttcctagcttccttgcttttcatcttgggcaattgcaaatttaccgctactttaaatcgttattacaagactgtcactacaaaattgcaaaaatgacactagaactgttattcgagtggcatccttacaacattaaaaaaacggtggcaaatttgcaaatgcccctcatcatcatcaaatgtaaccatgtgcagctgttaatcacaattgacagctactgtaaagaactattcggatgtccttaatgagggtaatgatgtaatttgtcatatcccctgtttgatctgtaacggagaggtatctgttttccttactcaacttattaacacgggaaaatgtgttctcacggcatagtttcgctgaatatatatacacacacacagtaataagcagtttccagttcttgtaaggtctggagtgttatgggtcactttttctttccaattggaggcacgttcaagaacacatgggttcttaatatagtacacttaatataatgagctctagatctagatagacggacgatgggcggacctggagcacagcgtcataaggggataggctagcagcagcaggcaatgtgtggatccagtggccatgattggatttatattgctgaattggtgaattttagggactatattggatttcgattttattttatttttgctccaaagatattagcgaatgcgagtctcttatcagggccgcgtacgaaaatcaattttcatttgcgtcgagggaggcacctatgaaaaagattgattttcacatgcggtgtgtccatctgctgccagctgcaaaatccattttggccgtataaaaataaatttgatagtagccggtactgatataaattaaacaccataacaagatcttaggtagctaacacggactctttttatatatatcttggacagtactgtcatttaattaatccaatcgaatgatgaatgaatacacaagatgaataaaaggttttaaaatggaagtggtgccgctagtgacgcacgcggcagctcctgttgctgacggaccaagattacgcaataaaaagcaaagaaggactcagacctagactgggttggaattaattaaggtttgtaacagcaataatgcaataattaagtaagtttttctttgatgttaaccatttcgacggaagtcggtcaatgatgaggttgaggtcttgggttgtgaagggacaaattgatgtacatgtacttatagagagaggcacgttgggtaaataaccagctagctagttgcaatagtatagaaaagtaagttttgactaattaattaacttgcgattaattggtgcatatgaatctggatcgccaacagctagcgtaacatgcatgtagattccatccatcgtgtgccccggccgcatatatatagacatgcatgcatgctagctgatcagtatgtgcagatctgctataagcttaagctcagcttaattagccacggtacgtagtttgtacagaaatggcggtgaagaaacacaacgtcgccatgcaattacaagtggtagtactgtggcttgtaggagtagcattattttctgtgatggcgtcgtccgctccggcggccgtagcggcagcaccgccgcccgcggagtgcccgagcaagtgcggcgacgtcgacatccccttccccttcggcgtcggcgacgactgcgcatggccgggtccagatgacttcaacgtcacatgcaaccatagctttacccctcccagaccctactacagcaacatggagatgaaggacatctcgctgccgaagggggagatgcgcgtctacacttccgtgctgcaaaactgcttcgacttgtccaacaccagcagcagctccgagtccgacgtaggctcgccatggctcgacctcgccgggacgccgttccttgtgtcgccggagaggaatgagttcacggccaccgggtgcgacacgctggggatgatgtacggcagggaggacgggagctacttgaccggctgcgtcacgacgtgcgcgagcttggatgccgccgccaacgacggtgaccactgcgcggggctgggttgctgccagatccagtccatccctacaaaccttaccttgctaaggattgtgctgtcggccaacatcaccgacaggaagattgctgcgtggaacccatgccgctacgcctttataaccgaccgagacgggtacgtgcttactacctccttcttagaatatactccctccgttcctaaatgtttaacactgttgactttttaaaacatatttgatcacttgttttattcaaaaacttttatgaaatatgtaaaactatatgtatatataaaagtatatttaacaatgaatcaaatgataggaaaataattaataattacttaaattttctgaataagacgaacggtcaaacatgtttaaaatagtcaacggcgtcaaaaattttaggatggagggagtagaatgtattttgtttcgttagtatatgatatattatactttatgacgcaaaaatgaatatattagattatcaaaagtatttacttaattatgatatagtattatactttattagcatataaatgatatcctcatagaataattgttgatcaaagtcacacatacctatcaatatcttaaaatgtattttaataaaatcgtatatttgttgatatttctatatatattggaatagaaaataatggtcaaagtttttggcaccgtgttcttgttcaagacaataattattttttaatctggagggagcatatggattgagaagttcattcctcaaaggttatgcacatacttttccgtactcgtaaaggaagtcgtttaggatagcaacacggtctctaaaacacaactttgacttcttgtttctacaaaaatatttactgaaaaatgatatatgtatacttttataaaagtatttttcaagacaaatctattcatataatttttacattttcaaactcaacaacttaagagttatttatgatttatatttctaaggtttgacttaaacattatcctaaacgacttcctttatgagtacagagggagtatgtacgtttatgacaagttctgaaaacattaaattgatgacccttgtaaaatactatcccaaattaaggactaaaatgacccaggagcgaaactttaaggaccatattaactattctccttatattatgcatgccaatatctctagccatacatatatagtatgtagctattcatagtatgttatgtttactagtttcaaaccatccattataattaggtactatatattatttattaaaaaatatttagaatttaatagtttataagaaatttaactttttttaatgtaataccttattgtttcaattatatttgttaattattaattcaaaattgttctacgggacattcacgacgatggctgacagggatgatcaatttgacggttttgtgccattcctgatgttaaaaaccgtgaggaaaaaaatatctttctggtagaatatacccacagcaatgtgcatatggcatcctgtagatacacacgtatgagtaccgcaaaaaatgacattttttctccctttatttcttaatataattattatttaagtagaattatatataaatatacaaatttagagacggcaagaaaatttgtaccaacatatagcaaaactagctagtgagatgcgctattttctcaagacataatatgcctagtgccattttaattaattaattgactaattaacgaatggcccaccaagatatttgatgcagaaggcaatcgatatctgaaaaatatatatccgatcgagtaattaaacatactatttcaatattaagatctaggattttgtttttaatcaggcaattcaggtacaattttagccggaaggatttgggtcgctcaggcaacaagatatttgcaaaccgggacggcgagatggtcgtccctacggagcttgactgggccatcaggggaacaaataggtcatgctctgtctgcgtcagcgaccaaagcgactgcgccaatgccactaacggagacgggtatctctgcaagtgctccgagggatacgacggcaatccctatctcaaaggcaatggcggatgcacaggttagttcttaattaaatttccttaattctccatcatggattatactcctatatcattactagtacagtatcactcattgacaatataatatgacgattatttaaatttactgttttaccattgatacatgtgctgcatgcagatattgacgaatgcaaggaaccagatcgttgttctactggcagcagatgccataacacagagggttattattattgcaaatgccgttttccacgtagaggggatggcaaagttaatggcaaaggatgccaccttcccaaatatatagtcccgacgcttggtacgtaaataagcgttaattaattattctccgcacttattactatagcattacattactaaagtctgatttaagaaacaccctaaagttctttcggctagctccacaaagtggtgggctagctagtttgggtctgaagctctatccctacagtttagttgatattagatccttccctaacattcgcagtgcagtctgatttgaatcaatggctcattctttcaattgatcatttgatttgtctgcatatatatatacagcgacggtgtgctctgtgatttctcttacggtccttgtgtgcttgtataagagacggaagagaagaatgtttgccaacaacaatggtggccggctgctcaaggatatgaacatcgtcctcattacggagaaagacctaaacaagatgacaaagaataggagcaccaagatcctcggagagggttccttcggcaaggtctacatggaaacccacaagaaccagccggttgccgtgaagtactccaagggaaagcgcaagctggcacagacgacgcatggcaaagacatcaagtgcatgaacaagaacatgttccaaaacgccttttgttggtccaaagttccatcctcgccggaagaagattcgtcgtcacgagtgtccggcccggagttagtggacgagctaagggtccagtcactaatccagcacgaaaacgtggtcagtctcgttggatgctacatagagacggaggaacccacgttaatccttgagtttatcccaaacgggagcctcgagaaaatgcttcatggagatgaccggcgccccctctcgctattaattgcagcgccttgacatcgccatcggctctgcgaaggctctttcctacatgcactcctctagccttatgcatggagatgtcaagccagccaacatcctccttgatgacaacctgaaccctaaggtctctgactttgggtcatctgagctcatattgaaattcaagcacgtgtgtgttgacaagaactatgtcgatcctgtgtgcatactgacgaacaagtatactatggagagcgatgtctacagctatggggtcgtgctcctggagctcatcacccggaaaagggccaagtacgacgatgaaagaagcatccgagtagaatttgtgaaccagtacaaagacaacaacgaaaggaggaagatgtatgaccaagacatgttgtcgtctacggattccctatatccttactgcatggagtgccttgacaggatggcggccgtcgcggtccggtgtctgaaaaacaaggtggacaagagaccgaccatggcggaggtcgtcgaggagcttaagcagctgagagagcaaataagcacgcgtatgtcctagctagccggcttgctgcaagatcagctcgtgtagaagatgaatgcttttctctgcctcgttcttcagtctctctattagttaactttcctttgcctctttgttaatttctctccaccccagcagatatcacgtactcacgttggtttgagttatgtactatattccaccgtacgtttcaattgttatccatgtagtgttttggtactatgttgtttaaaaacaagtgttgttgtgctgttttttatcttttgctataccttttgtagatgtggtctgcatataagcgatatatatatataccagctcctgtaatcctgttatccctccttgtgcaataataaagtacctcatttaagtatttattgtcctacagaaaaactgaggtgccacgtaacggtactgcaaccggtgtacgtggcatatcgaaaatgggccgttaaacaaaacgtcacctgagccaggccgttaaatgtgccaaaaacgagagaagcgaccagaagaggaataagtctgcttatgtaatacttaaaaaaatggggttaaataagaacctctgatagtatgcatgactgttttagctaatgtgacatcctagtcagcaaagaagaaactactcttttcgtttcaggttacaagacattttaactttggtcaaagttaaattgttttaagtttgactaagtttatagataaatatagtaatatttatcatactaatttagtttcatcaaatcaataattgaatatattttcataataaatttatcttgatttaaaaatgatactattttttttctataaacttgaacaaacttaaagcatggttaaatcgtcttataacttaaaaaaacatatggagctcacgtgtaagtgagttatctctctcatccttcttgagctgaggctcgtcggcgccggatgcaccaacgaataggttattttcaaaaataaattacaaataggtcctcagaagctaatgatagcgcaaagcaagtcaatcttccagtgctgcaaactgatctcaatcttattttcgccgttctaattccaccggcggattgtggcgacattttgatccaactttaaaaaagaaagctcaaacaaggttccaatcaaaaccggtgcgtgcatgattggtcaacagtcaatatattcgactcatatgtacattgtatctatcaaggtcttgattggtcaagagtttgaaagaaaacaagtttcacgccccacatgtggagagaaaacatccaagagctcattgattaccgtcagtgagccaatcaggaggagcgaaatacatgtaatgtaatgctttgttagttcttagattgttgccagttaattgccacaaaagcatcacttcagcgtcgccatggcgcctggatctccagtatgcatcagcgtgtccgctctgctgttgatcactttgtcccctgcggttgctgctgctgctgcttctcctccagggaggagcaagagcaatggcagcgacaccgatctcgctgcgctgctggctttcaaaggcgagctctccgatccctacagccttcttgccaccaactggactgctggcactccgttctgccggtggatggggatcacttgcagccggcggcagcagcagcgtgtcaccggagtggagctgcccggagttcccctccaaggaaagctgagccctcacatcggtaacctatctttcctctccgtccttaacctcaccatcacaaacctcacgggctcaatcccagacgatatcggaaggctgcatcgcctcgagctccttgatcttggcaataatgctttctcaggtgtcatcccagcctccataggcaacctcacgaggcttggcgttcttcgtctcgcggttaaccagctctctggacaaatcccagccgatctgcaaggcctgcacagccttcgcagcatcaacattcggaacaatggcctcactgggtcgatcccaaacagtctgttcaacaacacccctttgttatcttacctcaacattgccaacaacagcctttctggatcaataccaccttgcttcaattccttgacttgcaggtcaatcgtctcaccggaccggtaccaccaggcgtcttcaacatgtctatgctaggagttattgctcttgccttgaacggcttaactggccctatcccaggcaacgaaagcttcagactcccgagtctctggtttttctccgttgatgccaacaatttcaccggtccgataccacaggggtttgcggcgtgccagcaactccaggttttttccctcattcagaacttattcgagggtgctttgccatcatggctgggcaagttgacgaatctcgtcaagctcaacttgggtgagaatcacttcgatggtggttcaatccctgatgcgttaagcaacattaccatgctggcttccctagagctcagcacgtgcaacctaacaggaaccattccagcagatattggaaagcttggaaaactttcagatttgcttattgcaaggaatcaactaagaggacccattcctgcttctctcggcaacttatctgcattatcacgcctggatttgagcacaaacctgttggatggatctgtcccagcaacagttggcagcatgaactctttgacatactttgttattttcgaaaatagcttacaaggggatctcaaattcttgtctgctctttccaactgtaggaagctttctgtccttgaaatcgactcaaattatttcaccggaaacctcccagactatgtgggcaatctatcaagcacgctgcaagcattcatcgcacgtcgaaacaatatatccggtgtccttccatctacagtttggaacttaactagtctcaagtatctagatcttagtgataaccaactgcacagtacaatatcagaatcaatcatggatttggagatactacagtggcttgatctcagtgaaaatagcttgtttggccccatcccgtcaaatatcggcgtgctgaagaatattcaaagattatttcttggaacaaaccaattctccagctccatatcgatgggcattagtaacatgaccaagttagaatacctagatttatctgataaccaactagcatccactgtaccaccgagcttatttcatcttgatagacttgttaaactagatctgtcccacaatttcttaagtggtgcattaccggctgatataggctatttgaagcaaatgaatatcatggatctctctagcaaccacttcactggcatcctcccagattcaattgaacttcaaatgatagcctacttgaacctatcagtcaatttattccaaaattcaattccagattcttttcgtgtgcttaccagcttagaaactttggatctatcccacaacaatatttccggtaccatcccggaatacctggccaattttactgtcctttccagcttgaacctatctttcaacaacctacatggtcaaataccagaaacaggtgtcttctcaaacatcacgctggaatccttggttgggaactcagggctatgtggtgctgtccgtttaggattttcaccatgccaaacaacctctcccaaaaaaaaccatcggatcataaaatacttagtccctcctataattatcacagttggagctgtagcttgctgcttatatgtaattcttaaatataaagttaagcatcaaaagatgtctgttggtatggttgacatggccagacatcaactactctcctaccatgagcttgctcgtgctactaatgatttcagtgatgataatatgttgggctctggaagctttggaaaagtttttaagggtcagctgagcagcggtttggtggttgccataaaagttatacaccaacatatggaacatgccattagaagctttgatactgagtgccgggtgcttagaacggctaggcatcgcaacttgataaagatacttaacacttgttccaaccaggacttcagagcactggttcttgagtacatgcccaatggaagcttagaggcactcctacactcttatcaaagaattcaattaagtttccttgagcggttggatattactccctccgtcccacaatataagggattttgagttttcgattgcagtgtttgaccactcgtcttattcaaattttttttgtaaatataaaaaatgaaaagttgtgcttaaagtactgtatataataaagtaagtcacaaataaaataaataataatttcaaaaaaaaaatgaataaaacgagtggtcaaacgttgcaaacaaaaactcaaaatcccttatattatgggatggagggagtatgctagacgtttcaatggcaatggaatacctgcaccatgaacactgtgaggtggttctgcactgtgatttgaagcctagcaacgtgctatttaatgatgacatgacggcgcatgtgtcagactttggtattgcaaggctgctgttaggtgatgatagctccatgatttctgctagcatgccaggaacagtcgggtacatggcaccaggtaagctagtatcatctgttcttgctgaatccttgctgatcttttatagagtaattatcaagtggtgcaactaatgtttggtggtcattttttcttgagaagagtatggcgcccttggtaaagcgtcacggaagagcgatgtattcagctatgggatcatgttgcttgaagtgttcactgcgaagagaccaacagatgctatgtttgtgggagaactaaacatcaggcagtgggttcttcaggcatttcctgcaaaccttgtccatgtcatagatggccaacttgtacaggacagctcttcttctaccagtagcattgatggctttcttatgccagtgtttgaattgggcttgctctgctcgtctgactcgccagagcaaagaatggtgatgagtgatgttgtcgtgacattgaaaaatattaggaaggagtacgtcaagttgatagcaactatgggaagagatgacaaccgaacagcagtgttccattgaccctgcttgactgcgtatacgaaagaacgaatcatcctctgcatccatatttgcttctgcattaagaataacagaagaatagcatcaattactctttacttctttatgtgtatggatgaatatgaataaatctcttctgtttcttagttacacaatagttaaattgcgtacatctgtgattgatctgctgctacataaatttgcacgcaccatgacatggcagtaaatgatcttgtgcgcaggtattcttatgtccagaccaacattaaaaaaaaaatctaaactacaaaggactgaagtttgggtgcaagcattcaacataagacatggacttgactggttgcatggcacacctcctctgctcataggtcacaggatagttttctttatattatatattatcttgtttacgatttgaaatgtttgatttataacattgaaatggagagaacaatgaacacactgcctaaacggaaaatggaaatatgattatagttcttatttaggacatacagatgataccgaaatcaacgagtacacgacagttcaagagataatctttagtaagaataaaaacatcatcaaccaatgggtagtagatagataagtgaagaatcacgccagttagctaccacgattacgatgtgaagaaacaggacatggttcaaatcagcatacgagttgtgaaaagcaaacacattttcatggagttgtcagagatcaaataccttgaaatccttcttcagagactgaaagtagcacagcatcttgatttactgttggatgccgcacgccgcgtggtcacttggccaaatatgcatggttaggcaagctgtccagtctcagattccttagccttagatgtgatcttttagctcagagtgtacaatctgctggctggatgcctggattgttaccagcaacatttgtagcatcaagtccttgatgtctcttgatagtatttcagaaatttgcctagcaattgtacagaactatggctactgatgatgattagtaccgaaaaataatttcacagggaggatctccggctgtgcacggaactatggctactccagtttctagtccgttcaaacttcaaaattgtattactgcatatgattggtcagcagtcaaatatattcgacttatatgactagctagttagctatttgtccactatctatcaaggtcttgattagcaacaagttaacaactcacaactgggaaagagaaaaggttgcatgctaatttccatatggaccagcgaaggaaaaactgtggacagttggacttgttcacgtcaggttgagcaatagtgaaggtcttggatgtagacagaaccagatgcctgcacgcacaattgaatggagagctaaatatataaattaacctcaacccgatgattcctgtcttgccaacgcataagagctcagacatggcgtttagaatgccagtacggatatctgttgtgctgctgatcatcgctttgtctgcagtgacttgtgcttctgcagttccgagcaagagcaatggcagtgacactgactatgctgcactgctggctttcaaagcgcagctggccgaccctctcggcattcttgccagcaactggaccgtcaacacaccgttctgccgctgggtgggcatccgatgcggccgccgccatcagcgcgtcactggcctggtgcttccaggcattcccttgcaaggagagctcagctctcacctcggtaacctctctttcctctccgtcctcaatctcaccaacgccagcctcacgggctcagtcccagaagacataggaaggctccatcgcctagagattcttgagcttggctacaattctctgtcaggtggcatcccagccaccatagggaaccttacaaggcttcgagttctttacctcgaatttaaccagctatctggctcaatccccgcagagctgcagggcctaggaagcattggtttgatgagcctccggaggaattacctcactggctcaattccaaacaatctattcaacaacacacctttgctagcttatttcaacattggcaacaacagcctttctgggtcgataccagcctccatcggctctttgtcgatgctcgaacaccttaacatgcaggtcaaccttctcgcaggaccggtgccaccaggcatcttcaatatgtccacattgcgtgttattgcacttggactgaacaccttcttaaccggccctatcgcgggcaacacaagtttcaacctaccagctctccaatggctctccatcgatggcaacaatttcactggtcaaattccactggggctcgcatcgtgtcagtacctccaagttctttccctgtctgaaaattattttgaaggtgttgtcacagcctcagctgcatggctgagcaagctcacgaatctcactatccttgtgttgggtatgaatcactttgatgctggtccaatccctgcttcactaagcaacctcaccatgctaagtgtcctagatctctcatggagcaacctcactggagccattccgccagagtatggacagcttggcaaactcgagaaactgcatctctcacagaatcagctaacaggaaccattcctgcatctcttggtaacatgtccgaattagccatgctagtgttggagggaaacctactgaatggatcattaccaacaacagttggtagcatcagatcgttatcggtacttgatattggggcaaaccgcctgcaggggggtctcgaattcctgtctgctctttctaactgtagagagctttatttccttagtatctactccaattatctcaccgggaacctcccaaactacgtgggtaacctgtctagtacgctgcgattattcagtttacatggaaacaagctagctggtgaacttccaaccaccatttccaatttaactggcctccttgtgctagacctttcgaataaccaactgcatggtacaataccagaatcaatcatggagatggagaatctccttcaacttgatctcagtggaaatagcttggctggctctgtcccatcaaacgctggaatgctaaagagtgtagaaaaaatattccttcagagcaataaattctctggctccttaccagaggacatgggcaacctctccaagttagagtacctagtattatctgataaccaattatcatcaaatgtaccaccaagtttatctcgtcttaatagcctcatgaagctagatctgtctcaaaacttcttgagtggtgtattgccagttggtataggcgatttaaagcaaattaacatcctggatctctctaccaaccattttactggtagcctctcagattcgattgggcaacttcaaatgattacttacttgaacttatctgttaatttattcaatggttcacttccagattcttttgctaacttaaccggcttgcagactttggatctatcccataacaacatttctggtaccatcccgaagtatctagccaattttaccatcctcattagcttaaacttgtctttcaacaatcttcatggtcagataccaaaagggggtgtattctcaaacatcacgttgcaatccttggtggggaattcagggttatgtggtgttgcacatttagggcttccaccatgccaaacaacctctcccaaaagaaatggtcacaagctaaaatatctgctccctgctataaccatagtagttggagcttttgctttcagcctatatgtagtcatccgaatgaaagttaagaagcatcaaatgatttcttctggtatggttgacatgatcagcaacagattactctcctaccatgagcttgtccgtgctactgataatttcagttatgataacatgttgggggctggaagctttggaaaagtttataagggtcagctgagtagcagtttggtggttgccataaaagttatacaccaacatctagaacatgccatgagaagctttgatgcggaatgtcatgtgcttcgaatggctagacatcgaaacttgataaagatattgaacacttgtaccaacctagacttcagagcacttattctagagtacatgcccaatggtagcctagaggcactcctgcactctgaaggaagaatgcaattaggtttccttgagagggtggacattatgctagatgtttcaatggcaatggaatacctgcatcatgagcaccatgaagtggtcctacactgtgatttgaagcctagcaacgtgctacttgacgatgatatgactgcacatgtatcggactttggcattgcaaggttattgttaggtgatgacagctccatgatctctgcgagtatgccgggaacagttgggtatatggcaccaggtactagcagcttctgtactcttgctcaaagtagtggtattttcataattatcgtatggtgcaatcaataagcattgaccaattttattcctgcagaatatggtgctcttggaaaagcatcacgaaagagcgatgtgttcagctacgggatcatgctactcgaagtgttcactgggaagagacccacagatgctatgtttgtgggggaactgaacataaggcagtgggtttaccaggcgtttccggtagagcttgtccatgtactggacacccgacttttacaagattgctcttctcccagtagcttgcatggcttccttgtgccagtgttcgagctgggcttgctttgttcagccgactccccggagcaaaggatggcgatgagtgacgtggttgtgacactgaagaagattaggaaggactatgtcaaatcgatatcaacgacagggagcgtggccctgcctgcatatacgaaagaatgaattgtcctctgtgtccatttctgcttctgcattaagaataacaagagaatagcatcagcaacatgtccagtggtcgattaatctttgcctctatatctttattatggtcgaatatgaacatatttcttctgttcgttagttacacaatatttgattggtgtacatgtatgattgatctgttgcttcatgaattttcactgtaaaaatgggagtaaatgatggatgttgcttgaatgtgcttactttcaggtgaaaataataataatagaaaaaagaacattgtaaacctagaaaaggaatcaagtttgggtgcagacattggacattaagacatgggcttcactggttgcctgacatgcccgctctgttcatagcccataggatatatagtcttcctcatatcctctttccaatttgcacaatcttttttttttttgacaacatagaaatggagagaacaacgaacactacccaatgggaaatggaacgcaacagtccaagagataatcattactaagaacaaagatatctagtagatgaagagatcaagcaatgtgtagatgttggatatgagatggttcaagtgagcattggagttcaataaaagcacatattttcatgggggttcgcagagaccattaccctcaaatccttccttcctccgagattgaagcagcatacccgcagggtgcgtcgccactcagccaactccggcgcacgcggcagcgtcgaggtggtcctggatcttggcggcgatttgcagctggccggagcgaagaggtactggagattggggcggcatgagcagttggtggaggaactggagatggacgaggagatgggagcagtggcggagtcctgggtaggacagggagcccgcggcggcgtcggagagagtcggcggcggcggcgaactcctctccgtctccggcgacaagaaccaacggctcagattggtacccattacccaactatacaaatcgtaatccttaacctcttttcatcaaggttcctttacttaaccaatattaattttcggtactgaaatttacaaaacaacacccgattttgatcgctatgagtagtagtatttccaaaatggtcctttctgaggaccgctgcggtggccgccggctgcctcctccggcggcgcgtgagcatggcggatctgtgctcctggccctctggttgcagtgcaggttccctagatgatcgatgcggctacaagtaaaaacatcattctccccggcactgattcctgcactaaatgtctcatttacccccttttaaaatgggaacagtagaggagctagataagatttatagtctcttaatacaaaagtgcgcaatcttttgcgtattcccgaaaaaaaaaagttcataatgtagtttcctgtaattgttgacctcaggttgactggtagtcaaagtcttggatgttgaaggtgatagatggttggatgcagcatacatgtacagtggaatagagagctaaatactttatccgtcccataatataagggattttgagttttagcttgcactgtttgaccactcgttttattcaaaaaattttaaaattattatttattttttttgtgatttactttattatccaaagtactttaagcacaacttttcattttatatatttgcataaattttttaaataagacgagtggtcaaataatacaaacaaaaactcaaaatcccttatattatgagacggatggagtaaatctcaagctgatcatccccaccatcatcttggcaatgcatcagagcccaaacatggagtttgcatctccaatattatgcatatccgttgtgttgttcttgatcacttcatccactgtggctgctgctgctactccctctctaggtcagagcaggagcaacagcagcgacaccgacctctctgcactgcttgccttgaaagcccagctctctgatcctaacaacatccttcaccttaccggcaactggaccgtcggcacgccgttctgccagtgggttggtgtatcgtgtagccgccgcaggtaacatgcatggcttccttgtgccagtgttcgagctgggcttgctctgttcggctgactcccccgagcaaaggacggcgatgagcgatgtggtcgtgacactgaagaagattagaaaggactatgtcaaattgatggcaaccacccgacccggcaaaaaattgatggcaaccacagtaagcgttgtgcagcagtgattcatcgctctatcgttgtatatgagcgaatgaaatacatatcatttgcatcattttcttcttctgcattaggaatagcatcagtgatcgattaccctttgtttgtatttgtgtatggttgaattgaatatatatatatatatatatatatatatatatatatatatatataaaacaatttcgttggtgtaaatatgtgattgaaccgctggtcaataaatttgcatcacgaaaatgggagtagatgatgtgctacttatgttttcttatttctggccaaaataaataaataaaaaaggaatattatcggcacagcatcacaactccggctcattcagccttaaacaaccacaattaacagtcctaagcagagaaacttaacaagcttttcaggctaacagaacatcaaaaggtccacaagacaacagggtcttcagagagcacatcttcaggctgtcatgcacgcaaaaaagatcagacagccagatgagagcgggtacaataaccggtagccatctcagtaaaactaacgaggctgtaggacagagaagaaaaaaggtagtaggaacgggcgacaatagtcggccagctctacatgagctccaaggtgaaaaagcctacaaggtaggaattttcaatttttaaaaatggccatgggcccacaagtagtgtgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccatatatatgggataagtgagcacagctgtgctcacctaaccgcatttattgcggtctggtcaagcgtgtcgggctgca

SEQ ID NO: 72514 - DNA, 1239 bp, Oryza sativa
tcctgcgccccaattatctaaccgcacaaaaaggattttaacagtattgggcaatttcgtcgtgagcaatttttgccaaagcaaaaaatatgcctaagtccctaaggatcacaaccagccacacctaaagtgaagttgggctgaaaatactgttaaggcccaggcccattagtatttcccgataccctagtgaaataatcgcaaaaatagaacgctacttcgtcttccccgccgcgatctcatccattttccccacttctcgctacagtgccaaagttgcgccggcgaaaactagggttcacaaacacacaccaattcgcctcgtccgaagcttcgtgcttttgcgaaaatcttccgcacaaccaccgcatcaatctcccttccaatctccgccaccctcgctccaaatctcatcatccatctcgcatctatggcagaggagagagaaagctttgagagtcaatgggcaccctccgatgtcacagagaagaacttgaaggaaatggtggcgcacggcgttctcccggcgaaggaaatcatcggatggcgtccagcatatggcgaagccttcccgacccccgacactcatgaggtcgttgtattctcccactacttctatggtggttttgcccttccaacttcgaagttctttgggggattcttgaattttatggaatcagtttgcatcaccttaacccgaactccattgtgcatattgcaaactttgttcatgtatgtgaagccttccagggaattaggccgcatttcgccctattccgtcgcatcttctttttgaaaccccaaccaaataaaaacaagccggctcccatcatatggcctaaacagccaaagaataagccaattttaaaattttcaaacttaattttgagattgattttgagatattttcaacgtagtttctttaacaacattggtttttaaatcaccaagaacacatataaaagttttacctacaaattcatttgtatttcctaataagccgttttggcttattatggataaagccaaacgatgggggttgcaatgtgttatcgggggagcaggtttccaactacggggtaccttgagccaaaaatacttctccatgccttttaaaacatccaacaagggttggcacgcaaactggttctatctccaaaatcctgaaccggcgcttcccgagtactcttgtcttcccccaaaatatcaggaaacatggaactcactttcaatgggaga

SEQ ID NO: 72515 - DNA, 4049 bp, Oryza sativa
ttgttatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcagatgcatgattaatgtaaggggggtacaaggggataataatataggggttaagttttgcagtaaacagcatttaaaagtcacttagttgcccaaagctattttgtaaacacgatcctagagctatacaatattattaatcaaggtcgtgaacccgcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacatgccacataccaccacggtatacggacggaagacgtgacatagttcccaacccatcctagccataaacaagagtaccgacccaaccccacctacggccggaacccccgggacaggcaggcaggattgagccccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccagaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaatttatactagtggaaccacgaatagagtacccactagttggggttttgtttattctagggtgaacaaggtaataataacaatagcaataataatgtcttaacaaagttaaataggcatggctaaataaaacagtgataacgcgggaatttaaataaagcaataatgcaataatttaaatcaaaataattttataaactgggattcaatatgttcaaggatgatgtgacttgccttgctcagagagaacggccttccgaaccttcagcgacgaccgcgaaccacgcttcgggaacctccggaacgacgaaagctacgcgaagcacacaagcaaagctacaagcctataaagaagcaataacaacacataaaaagaaagcacacagttctttaggttataacaaacattaagagacttgaacgggtcgattcggagctcgtatgaccaagatatgatcatccgaagtttgatgctgttatatggagatttgcggattattataattaagctttgcaattataaaacatgtgtaagcgctagcctggaagagacaggaaggctgcgctgttgacatgcggaccccacatgtaacctaaaggaccacggtagaccgagtacacagagacggtccacgggtcgacggaagcggaccccgtgtgtcaaccgaggcgagtggccaacaaacggactccactagacaccacacgggctgcacacgtagaaaccacgcggctaccgagcgggcacactaacacggtcaccacacgcacaagcgaacgactaccgacaccggtacacgggtaccggtgtcgacaaccgcacaacgggtacggggcgacaccgaaaggacgagggcggggaagcgagaggacggatccttaccaccacgcgacgaggcgtgggaacgacaacgacgaacgggcgcggcgaagacagctcgggaacgacggaggcgaacggcgagggaacgacttcggcggcgatccttggacaaggcttgacgacgcggagccgaggacgaagacgaggacggggctgccgcggcttgcttgacggacgcggacgacggacgagaacggctcgacggagggacgaacgccacgacgaccgggaacgacgagaggacgacgacgacgacgacgaccgggaccggcgagtaggcgacaaggacagccggcagcggctgcacggagacgaggacggtgtggaacacgccgcagcgatgatgatgacggaggcggtgccgcgagacgacgagccgggcgaccgacgggacgtcgatcggcgaggacgaacggtgacgaggaaacgatgatggcaggcagcagcggctgagcggaggaggggacggcgtggaacgcgctgctgcgatgttggagaaggtggtggtgcagcggggcgacgagccgacgaggaggaatgggtggttggcgcggcggcggcgttccggcgaacttcgggcgaggaggaggtgatgctggggaaggagacgatgccacggtgtcgaaggaggagacagcggcgtcgatcggcgcaccggcgacgaacagcagccggctggagggagtgggtggcggcaatgccaccggttgccggcggggacgcgcctccggtggtctccgcgcgaaacggaggcgacgccggtggaggggaagtgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataaccggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacatcccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcacataaacctatagtctaggttttaaatgagatccccaatgtgtgctagttgaactaagcatggctaagcaattcctagtccaaaggggctgcaggaat

SEQ ID NO: 72516 - DNA, 2523 bp, Oryza sativa
agactggaggctcttgttcaacacgctcttgtggaacctcaactactgggacagcgcgagcaccatggccggcgaggtggagcggccggagcggacgttcccgcgggcgctcgcggtggcggtggtgctcatcgccgtcagctacctgctgccgctcatggcggcgatcggcgccacggacgcgccgccggagacgtgggagaacggctacttggccgacgcagcaggtacatggttatcaaacagtgctctctcaatggcattataacgacggccagcatgacagcttagaaactcttttcaaacatacaagcaagcattggaaaatgaaaagtacctcaacaaaatgaagatgcaacactagagcatacagataatttgtcaaacaagagaaaagatatatttatttattgccattttaatttgagataaattaacataaataaaaacatccccgcaaaaaaaaacataaagaaaaacaaagggaatataaagacagtaacagaagaagtttgcctcgcggtcacctaaagcctgcgccctgtggcctgtgacatcccgtctccataggagctgaggattatactgacccctttcggtataacgaatcggataatcatttgctcagattcgtggtactgggagaaaacatatcttttactaggtcagaaaccaatgatccaagaatatccaaaatgaatgctctagtgtaatgctcaatttgccttttttcattgcattatctggcatcaacttgaactgatcccgtaatttttttaagctgatggagtagttagaacatgtcatcatcccgtaacttccaagtcaccatcagctgcctttcgcttttttttgcttcatcacatgttttactggagtaattccttgtaaggtctcaatttcatcaatcgatggaccctctgacttgcctatgataggctcaacttaaattgataagcccatagacaactcacatcttgcaggacgccatcattctactaatgctccaattagaaatctgtctatactcattccaaccatctgagcaacttgataaaatctaagcctcttcaatagctgctcacataaataatagtatggaatgtcaacatggtgatacctgacacttgcaccatcattatcctacatacatagggtaaaaattagtcaatcattctttttttggaaacaagtatatgaaacaagctaacgacaacttacattttcccaaactattgagattttgtactggcagtggggcatccacagcagtgcactgaaatgttctgaaacacttttttcagtttgctgaactaaagtttgatctccatctaataagcctagctctccatcagttcttgcagctgaccaacgagcatctccaacagtctctccaaatctaactctctaaatgtctatttggccaactctccatctaatttggcaagtcaaactcattgtttactccaacagcctcctcattcatcctctctattatgagtctatgacaataggacccacatgtcaatctctacaactcttttttcttcttcatctttctccccttctctccaaactccaaaccccctcccctctcccctctgctgccatccgcctccgccaccggcgctcgggctccatcctcatctgccgccgccgcgagtcggcgacggcaaggcggcggaaggcgaggggcaaacggcggagatgtggatcttgtaggggatcccggcgtccttgagtggcttggccaggtcgtcggccttggacacggtgaaggcgttgaagtcgtcctccatcttgcgggccgcggcctcggcgtcgtccttggcggacggcgggttgcccatctgcccgccctcgccgctctggctccgcccgctattgcagctctggccgagcttgggctccatcaccatccgcctgccatcgccgctccggctctgcccccatcagccgctgcttcggcaccatccccatctgccgccgctacttggctgagctcccgtgcttgtgcgagaagagagagagggaggggagagaaagcgagagagaacgtgggtcccactagatgagtggatggccagccggcttgactggctagatttggctagcgggaactcagatttggccaaccagatggcttggcccttcggttggagagcctgttggagcacgatttttatttttttagaattgctaaaatttaacttggccagccatttggccattctattagagttgctctcccatctagagtagtcctcatcttactacttgtcttaaaaaaaattaatagagcatgtccaacaatttacaattggtatatttttttctgcaactaaaaaataaggattgtacgatgattggtcctaaagtaaaactaattcattttttccagattatgtgcacactattgtctccttaatcatcttgttatgttgacaaaacaggaattgaacagacaaatcttctattatatactaaaagttcattaaattttctataaacgctctcaaactg

SEQ ID NO: 72517 - DNA, 15400 bp, Oryza sativa
  unsure (1)..(15400): unsure at all n locations
ataagtgttaagcctaacatgatcaccttaatacggaatccttaggttactgaccgttgtttgaagccattgatgcgattctccctgttcttgtcggtgtagaggtagtagtggtagcagtagcagtgtgagcaccggcttgatcccgaaggggtcgccgccgatcacttgcggggtagcggcggccttctggtcgccacctacgctgtcccggaaacaccacacgttctccctccagcgctcaattgatcggataggtttttgggattttcggggaaaagaaggtcgtgaagagatcgtcatctcaccatgacaccggcctcccctattagtatggcgctgagggagatcgggggtaatccaaaatatggaaagatttggcgctaccgatcaatgcgcataatcacgtaattatggaaattgaatcgcgttaatcccgtaggcaccgggtggaaaacggccatccgagatttcctctcgattttcatgccgagagataaactttcctaacacatatagcatcaaactaggttgtgtttagatcaggggtttggcgtatcacatcaaatatacgggcacgcatttgaagtattaaacatggtctaataataaaagaaattatagaatccgcctataaactgtgagacgaaattattaagcctaattaatctatcattagaaaatatttactgtaacactacattatcagcttaaaacattcatctcgcaatttacatgcaatctgtgcaataagttattttctcatttatatttaatactctatgaatgtgtccaaatattcgatgtgacaaggtataatttttttccagggatctcaacagacccctaatatatgtcgtgctcttggagcgatataatggttctcaacggcagcgccgggccccggctgggaatagcaccgcccagcatctcctcgtctggctggataagaccattcccaacccaagacattaaacatagtttccataaactccacattatcaagtactaaacgctactcttctaatgcaaacaccattattccacacttaaatttaatgctacttatcacacatgatgccttggatgttgtgtagaaatcatgtctcatgcaagacatgatttccttctctttcctcatttattcacttgtcatatcatttttcattctaggtggcagcttatttaatgttatggacaccatcctagtcattgggttgggaatgatctaatagtactagctcagtgcagtgaattgaagtaaccgtacgaactatagctagtacactgatgtctgaacgtggtgatttgtttcaaaattttgctgatattcttcggaattgttatgttcatcaatgttcgtaaaaaaatcatttggtataaaatatctttaaaaaaatcaagttgctaactgcatgagcaaaatgagagaaaattgcacgattactgatgaataaatataggggcaaatgtgcaatagcaagtaagggtataaatgtctttttgccaacaactggacaccatcaacttaaccatccaaagtaggagtaaaatttgacttattccaaacaaatgggggaaaacaaaaatcccaaaaaaacaggagcaaaaccacaattgaatgtgaaaataggggtaagaacaaaattgcccccattatatttttatgtcctcgaactaattagagtgtcataagtattccatattgccatgaccactccacgatcctatgtggcgcttaagtgacatgctacatagacactaaagtgacattccatgtaaacattctggtctcaaattttttttcatctcctccacatttcccttgtcttcttttcttttttctctttttcccacacgaataggaaggaagaagaggagataaaagataaaacaaaatgagtcaatgttcatgtttatctgccatgcgagaggatcctaaatgggtcattgtaatttgggactggaataacacactctcaaaaggttggggacttaaaaaacaatttggacccttcaaatcaatgaatttagggagaaattttataggattcaaatcatataacctcttcgatacaaaggaccggaactttccaaatcctacgaaattactaaggaatggctcattacatatattacatatagattttggagaaaacttagcaaaaacttcaacctcttgaaaaatttcctgagtctattctctcgtcctattcctgtggacaaatcaaacaacgattcatgtgtttttctatattttataatcatttgttttgcacttgtattcctattaaaattatgtgttttttctatttcttcctatttttaatcctgcatttcaaaggagccctcaatgttcgaggacctagacaacacaggcgaacaagtttagggactgttagtgtaatttactttatcgaatatatacgccacctagttggctttttaaagattaggtttaataattcattttattagaaaactatgtgagcataatttattttgttttttttctaaaaccatcattatttattttgtatttatttgttttatcataataggtattttaagtatgccttacttttttcatatttacgccaactttttaataagataaatgattaaacaaattgtttccaaaagttaacagtgtcatactctctattttgatttgaaaataagttgattatttctacctcttaaatatcatcaacccctaaattaaatttttttattttttcaatactttctaattgtccacctatcaatactattttctattaatgaaggatattgtcggagggtaaaactcctttagcgggaagcgtgaacttccccattggagattcggccagagagctagtgagcggaaacaaggcaatggatagaaaaacgagggatgcaagctttattcattgttcgatctccttctgaactttttagagtgaaagcgattatgtgattggagtacagtgagcttgatctgatagccagccaaaaacatttcttctactatagctactctttacaatttgaaaaaaaaagtgtttatcaccaaaaaaataactatgcattacaaccgactcataataatacatgataagagtaaattctttttatgctttcaaactttagtctgtaatacataattttattttaaaatggtattaatagttttcttataatcatccatatcagtggatttagaacaacaaataattgttatgttagcgtcttttttttttcaccacgaagattcaattcacctataataacctcaattaacttggtggctttatgctcccacccactcgctaccactttttttcctttgactgagtgtaacgcacgggcatctttttatactataacatatagatttttcatatctgtatgtcctccgtatgtacgaaagtgatcacgcgatcggtagcgttttcgtggcgatacggcataagtggtgtagatttaaatgtccaaaaactcggcacgatttaaattcagatcgcctcgttaaggtcagatcgtattggccgaccaggttatggttataaaaacacgaatgaagagaacactagcaactaagtaagctcgcatgagtgagctcaccatggaccaagaaatccaactgaaccagaggccatcgccgcagcgacagcaacaagcacaagaacatggcggcgccaccgcaccggcgccggcgccggcgacgccacaagatgatgaacagcaagggcaccaagcagctgtcgccaggcatggctgcggcggcgcgacagccgaacgccaccaccagaccaagctcacgctactcccgctcgtcttcttcatctacttcgaggtggccggcggcccgtacggcgccgagcaggccgtgagcgcggcgggcccgctgttcgcgctgctcggcttcctcgccttccccttcgcgtggggcgtcccggtgtcgctcgtcaccgcagagctcgccgccgcgctcccggggaacggcggcttcgtcgtctgggccgaccgcgccttcggcccgctcgccggctccctgctcggcacgtggaagtacctcagctgcgtcatcaacctcgccgcgttcccggccctcgtcgccgactacctcggccgcgtcgccccggcggtcgccgtcccgggaagcagggcgcgcacgggcacggtgctcggcatgaccgtcttcctctccttcctcaacttgggcggcctaagcattgtcgggtggggcgcggtggccctggggttcgtgtcgctggcgccgttcgtgctgatgacggcgatggcggcgccgaggacgcggccgcggcggtgggcggcgcgggtgcaggtgaaggggaagagagactggaggctcttcttcaacacgctcttctggaacctcaactactgggacagcgcgagcaccatggccggcgaggtggagcggccggagcggacgttcccgcgggcgctcgcggtggcggtggtgctcatcgccgtcagctacctgctgccgctcatggcggcggtcggcgccacggacgcgccgccggaggcgtgggagaacggctacttggctgacgcagcaggtacgtagtacgtgtgtacgtatatacgctgacgcgattacgatattgatgatgtcacagcttcttttatcaacaaacaaaacacacatgatgtctccggcagatcgccgtaccggtaattgtcgccgttgtttattactttatgagttatttactcatcatatgaaaaagatccaaccttacattttcttggtggaagaagtggccattattttctcaattattattatattattatacaaaaattgatgatgttttcgtctaaattttaatacatcatttacatttgagttggttatacgttgctcttatctaattcgacacgagtcagaataactattatacaccccgtcatagcccaacccctcctcgaccctctcagtccaacccaaccggctcacaccatcccgtcaccccatcccacacgcttccacttaaagctgggcgcgttactccccgatcggggtcctttttctctttttttttctttttctttttctcccaatacaaaagacactataattttttaaaaagtatcaatacaaaatgtttttaatattacttaaaatatgtgttcatatatttaaaaaaaatttggcacacgaagtaaacagagccttaatttcctggatagtctgccacaacaggctagccttaacgttggcactgtcagtttccaggataaccggcgtctgaatccattctgctgctagccgaagcccgtttctgcacgcaaacgcttctgcttcctcggcccactgacaactgcgatacatattccatgaagtcaggagcacgtcacccatatgatcgcgaatgacaatgccagttcaatcattcatctattcggctcttcagcgttccattcaattctcaatcttataaaaaaaagaaaggaaaaacaccactctcgacaagatgggttagagcatcaccaatgtatatgtcaaagtgatccatatagatgagacctatataaattgtttttccctatagcaatctccacagtgtatatagatacaaggtatcaatagaagaagagagaggagtagagatagataatataatttattccatatgggtagtccatatgcatatgggtatcttttgttattttttccatatggactagttgcacaatggttatagatggctgaataaaatattctattgcttatgaactacttttacaccacattgtggatgcccttacagcgacgaagcttgtgaggaatctcaagggaccagctacaagtattccactctaccaaaactacaattcactgtacgttgtgtttcccttcaaactttcaacttgtttgtcatataaaatgtttcgacagtacatacatggagcattaaatgtagacgaaaaaaaaaaccaattgtacagtttgcatgtaaattgcgagatgaattttttaagactaattacgccatgatttgataatgtggtgctacagtgaatatttgctaatgatagactaattaggtgtaaatatttgctaatgatggactaattaggattaataaattcgtctcactgttcacacacgaaatctgtaattcgatggttcgaatatgtgtttccattatccatacagtatacagtagcagtatatcgcaaatatcaaggcaacaccacagtagagggcaacaaccaacgagtcaatgccaaaatgggtaaagaacaaacagtaaattctactagcacggaactattccttctgttctgaagcgaccctatttgacgctgtatgttagactttttaaaatacttttgaccgttcgtcttattaaaaacttttacgaatattattaaaaaaaacttgaatagtagtagtatatttaacaatgaatcaatgattggaaaagaattaataattacttaatttttttaaaataagatgaatggtcaaacatgtttaaaaaaatcaacagcgtcaaatatttagggacgaagggagtaaatcataaggagtaggggtatatatttttgcatgaccttaaataacatactttgaacattcatttatttcatattatgtcatcgataactataaaattagtatcacataaaagtatttttaaaaatattaatctaatgatataatatacataatacttgactagatattattagtataactagctaggtgggccgcgcaattgcgcgtctagtacccaaataaaatcatatatttttcagtatgattttacttaaaatttattaaatagatatctcgttctcttaagactttaaaagaccaaaccttatcatcctcgtatttctaattatatagtttttaaaagtcacatcagctgctatgctaccccttacttcagtcatatccttctttatttgcttgctcgatctaccactatttctattcattctctttgaaacctttaaaaattggatcatatagttcttagagtttattgtctcattggtttcgtttttataatttttagaaatcccgtcaaacactgcaattatactcctctatgacccatccactgtcttttctctttattgtcattaggattttaaattttgaacataattatcattcgggtttatttttttactttctagaagtcccgccaaaccgtcagcgactttgccattgtactcctttatggcttgtccgctgcctcccttatttattgtcattaagattttaaaatcgaacatgattatcattagattttttttttactttttagaagttctggacctttaaaaattggaccttgtagtttgtagagattatgatcttattgggttttattttttataatttttagaagtctcgtcaaacgatgccactatacccgcctactgtttattgtcattgggattctaaaaatcgaacataactatcgttggaattcatttttttttattttatagaagtcccccaaccgtcggctgttctactactcctatacaccccgcccgctgcttctcttttttattatcattgagattttaaaaatcgaatatggttatcaatgaggtttatttttttactttctagaagtcccgacaactgccttacccatttgcttcacgacttgcctatcgttcctccttttaatcgtcattaggattctatttgatgttttattaacagtttttatatatcgtatcaaccgccaccgctctactctttataggcctgttacttgaattatctcatcatgtgttttaggtgatcttttctttcaatagtatttattttttttcacgaattttagttatttataaattgtattcctaattgaaatatttcctattttttttcaaatttcagaatttatttttttcagattttaattaataccatatagtgttcttttaatattttttttaattttagttgtttcaaaattgtattcctacttaaactctcttttagtttttctaattttggatattattttatttttattttgaatattaatcaatctcgtattgggttcttatatagattcttctttcaatattgcttatattaaatttcgaattttaattaattttaaattgtatttctacttgaactcttcttttaattttgctaatttcggattttatttttatttttattccgaatattaattaatctcgtattgggttcttatatggacccttctctcaatattccttatttttaattcatattgaaatttatataaatattcatattgtattttatgtacgtgttagttattaattatttttaatatcaacttttagttatttctaaattatattcctatatggactctagactcgtctttcaatattttttttaaattccatatttccgttatctgtaaattgtatttctatatagactctaggctcttattgcaatattatttatttttaattctgaatttttattatttctaattgtatttctatgtggactctaaactcgtctttcaatattctttaatttttaatttcgaatttcagttacttctaaattgtattcctatattgattttagactcttcttcccatgttttttttaatttcgaattttagttatttgtaaattgtatttttatacaaactctaaactctacttttaattttattatgtttattccgaattttagttagttttaaaacttttattatgtttatttcgaattttagttagttttaaattcctatatggattctatactctacttctaatattccttatttttaattatgaatttctataatctcttaattgtatttatatatggactttatactctacttctaatatttcttatttttaattccgaatttatattatttcttaattgtattctatacagactttatactctacttataatatttcttatttttaattccgaatttctattatttcttaattgtatttttatatggactctagtctcctcttttaatattccttatttttaattccgattttcagttatttctaaattatatttctatatagactctgtttttttttctccgattaatatgagaatttctagaccgtgggagcgaacatggagacttttttttatttctttaataagttaatagattaggtgcacgaaccgattgccgcatgagatttttgaggttgtgtgcgagctgacaactctgttctgtcatgtaagcgcgttgctcgagtggaccaaacccaccacacattctcaaacccgttagccagagatcaaaatctaacataccctgcatcttaaaatggtttttgttaaaatatacaaggagaaattgaagaattgcggtattatttcagtacagcacgtaaatagtaagaccccttcccactttatatgttgtgcgcaatccgactgggctgggccggagataaatgtgcaattgatggctgatttggcccaaggatagcattatcaacaggaataagttcatatgagatctcttaacttgttagcgaatccgattttcgtccttcaaccggaaaaccggatacaacaattcctcagctgtcaaaaccggtgcaaaataagtccaaggaggtttggatggcgattacagttgatgtagctgctatgtggttaattttactcggtcatcctctaacgtggcattgacatgacgcttacgtggcaatttgatttggaaaataataaaaaccctgggcccacatgtcagtacccaaggggggtgggcgaagcatgcangggcagcaggcgagagcggcggtggtagacgagagtggtggcggcgaacgagagcggcggcagcagctgctggcgccccgtcgccacccaactccggtgacgcctgccccctgctccgcttcgtgaggagatccacattgacctgctccgcttcccggggcggcgcgaacactacacgagcgtcggccgcgcgtgcccaccattttgcgcgtcatcccctccgcctctcgccgccagcgatgtcatcgtgccagccacctctcttccctctcccacgacaacgacgacatggggccagataaatggaggagcgcgaccggcatcctctccccccctctcccacgacgaccacggtgacatcgacgagaaggcgctggggcagcagggggatgacaccgatgagcaccctgatcccggtgctgccttgtcgccccgccacccctgcctgcttcgcctgccacacgctcgctcgtcgtgctcgcccgctgcccctgcttgcttcgcccgtcgtgcgcttgcccgccgccgccgccatatacatgtgggccccgcatactttattttttttttatttttctgactgggatgccacgtcagcgaaatcaggtgtctatactcttatagacctaaattggacgcttttatacagtctagggatgaagatttttgatattgaggataagggatgtaaaaaaaaaaactcggtgtaaagttgagggacggacttattccccgtaaaatatgaacatgttaggctcgatttaatctcagcccagcccatgtaagttttacagattggccgtctgatttgacgtgattttcgatgcaggcatcatcggcgggcggtggctcaagtactggacggaggccggcgcggtgctctcctccgtcgggttgttcgaagcgcagctgagcagcggcgcgttccagctcctcggcatggcggagctgggcctcctcccctccgtcttcgcccgccgcggccccggacgatccgccaccccgtgggtcgccgtcgccgcctccgccgccgtctcggtcgccgtctccttcctcggcttcgacgacgtcgtcgccaccgccaacctgctctacagcctcggcgcgctgctcgagttcgccgccttcctccggctccgcgcgagggaggagagcccctcctcgctcaagcgcccctaccgcgtcccgctgccgctccccgcgctcgccgccatgtgcctcgtgccgtcggcgttcctggcgtacgtggtcgccgtcgccgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatggacgacgtgtggccgtggctggccggcctggccggcgaggagccgccgccgccgcaggccgttgtcgcccttgccgccttcgctgacggcaccacgtccattgtcctgcaggccgaccacgtcgcattggctgaaggtgatgaggaagagaagactctagtagatttctctctcgccttgaacagcaccaatggcggcgcagcgcgcgtgctgtggacgtcgggtcgatttgaggccgcctccggtgtcgcgttgcagcggcagctgctggcgaggctgctcgacgaggtgatcacgctctcgccgtccgtctcttgcttgagcggaaacctcggactcggagtcggcggcgcaccgaagtcgaagttggacgaggagatcgtcgccggcatcgggaatgattctgccgcctcattcttctcgctgactctccttctgcgcctcttctggctgtgcgccaccgaggcacccgccgacaccgggtttctcttcttccaagctctcggcgccgacatccagcgcgctctcgtggactgccgcccagcgctcgccctgttcctggcctccctcggcccggacgtcgaggagcggttcatgcggtcgctcggctacatgctcgccaagctgtgcttgctacgggagatgcaagcggatgcggatcagccggcgccggcggcgacacggcgcccgcgcgcgctccccgcggcgtgcctgtcgtacgccaccgaggtgcacgggctgtgggttctgagaggatacgcgccggtgctcgccatgccccgtgtcacctgcgcggcatcgacgacggcgcccatcacggcgctgccgcacgaggcgccggaggagccggcgctgaggtacggcctggtgcaccagcagctggaggtcgtggcgcagctggagtacgccgtgcgcgctcgccgcggcgagaggttcatgaccgtcgccgtgcgcgtcgacaacgtccgggtacgcgtcgcgcggctcgggttccggagggacgacgcggacgctgacgccgacggtggcgacgctcacgacgacgccatggacggcgagcgccatttcccgtcccgtctccgcctctgggtcggccctaggttcggcgcgtcgtacgcgaccggcccgagcctcggccggtcgacggggaacccggagcaggacgtcgagacgacgcgcaccgtcaagggcgccttcgccgccgccggcgccacgaagctagccaacggcggcgtccctccgaggatcaaggccaagacgcggtcgtcggcccgggcacgcaaccggagctggcggtgggagcaggaggcggagggcagcgccggcgtgttcgagggcgtgctgtgcgacccggccaccggcacggagatctcggcgtggcgcggcgacaacaacaacaacaatggcggcgccggtgacccgcgcaacgggatgcggcggcggtacggcgggccgggcagggcgttcagcaagatgcgggggctggtggtggccggcgacgagctgcccgaggaggtgacgtggagggtggggagggaggcggaggggagaacgctgccgtggcgcgtggggctcaaggcctggttgacctaccttcccaaccaggtgaggagccaccatttcgagacgaggtgcgtcgagtgggcacacgaggtcgacctcccgcttgccgccgttaatggcgacgagaggtaaaaaaaaaaaaagaaaatctctctttatatcacctatgaacacatactagccaaaagaaatgaaatgatcttatgcacgtattgtgtatatgaaatgaacagctaaaataagaggttaagaatctaaattcagatgctgtccatttgcaccgatttttctttttttttcttttttttttcgcagggcatttgcaccgactttaagatagatcatcttaatacctgatcggagaccaaatcgtaatggatgcaaaactatttctataagggcacaactattataccgccgtaatggtataaccccccatttcaaatgctcatgcgtccactcactctcccactccatgcgagcacgcaactcccgacacgtgagcgcctgacacacgccatatgcatccattatgtgtcaagccatcttgatatgtatttatcgggctgaacctactagtcaagtttggttggttctagagaccaaagggtgggaggtttcgactccattcggctgggctagttcggttgttccatctagctcttttctcattatcaagttctcaccacacatatattcatagtcttgaccagtacatgtctatgatacttaattgatgcttaaaagtatcatcacatatataccttccaaatggtactcgtgtcgagcgatactagtcggcatcagacatcatcccctgatacatatcgataccaagactatactaatcagcactaggtccgataacgtttagtaccactctttgtaccctctattggtaccaggccggtattaggggcctgtttggtagagctctaactcctaaatttatctccaggagttgggtctaaagtggagttgtagagctacctaaacctaactccatctctctagttcattttgtgagagacctccacccaagcccactcccattttaggtggagctgaaactgtttggctgagctccagctccagaagaggtggagctggagttggagctgtgacaaacaggccctaggtctaatacccatcgatgctacacatggtactcctgatacccatcggtactaagctaataccgatcggtactaggtagagtatattggtcagtacaaacttgttacccttattagtaccatgtcgatatcgggtctgatactcgtcgataccagagttactactcctgatacccgtcggtacctatgtgataccaattggtaccaagtctaataccaatcaatacaagacttagtagccctgatacccgttgatatcagactaatacatgtaggtataaggtttgatacatatgtactagcctaatatttgtacgatattaggtcctatatcttaggacaaagatatgaacctccatcggaaataatatgtatataccaattgaaaaaaaagaagaaatgaactctatatagcaaaagaagtgaagaaaaatgttcacttttacacttgacaccacttaagaaaagagtatataaattaaaaagtactagctataataagttggcaagaaggtcactaagctcagtcttatcgcatgattagggtaatggttttattttttcatacatctttctcttttcttctcattttgttttgccgccccaacatctgcagtgaacagttagacagccatagagtaggctgatcgatagttgcacgttctgacacatgtcatctgtaccgaaccacgtgcaaagttactaaccatatatagacttgtgtacccacgaagtctgtatgcaagaaggaatataattccataagctcatgtagtttcttacattaaacttttacagtcagtctaaaagcaagtttaataatattagagcaagtttaataatattgtcaactaatatctttaaaagttaacacatatcatctacagccaacctaatagtatgttcactcatacaatagttagttgcaggcccggccacaggagaggagggggagggggttgagatatgccaccgcacagggcccacaaagtgaaggggcccaa

SEQ ID NO: 72518 - DNA, 4642 bp, Oryza sativa
ttctgaccactcaggtcatccatctgccacgtaggctgattctggtgacaattcccaatccacaacaacttttcataaagcacaggcaaacagatctacgtaacgggaaccacctcacatccgcccatgaccgtgggcacggctgttagaatagttagttaacctctgcagaggggcacactttacccacaagatacgaacttacttcgaacacccgtctgtatcggaggttcgcaacaaagcctttcccaagccgacccagggttacctcatgccacatagaaggatcaaatcctcacataaatataggccatttagttttcacaaatcaaactccaaccacctcgatcggtaatctggcaagcttcgcgttcttgccttaccaggaacccgggttggctccaaccgaccccacccccgcgttcccaactattggcatgcgaggtttccctgaaccgactagttacttagctagggtgtcccataccaccttgtggttgcactttgttatgcttgatgagtttcccacaggaatcgatccttatatgcgaatacgggacaacgccacgcaggcacaacccccgtatcgcgagttttcataattcatttattttcaaacacaccgaatacggggcgactgctgttttataggcgcggggtggggcgtcgaggagaaggaaccggcattggggcgatcaaggggagcgagctggcggttgtgctcggagctagcggccaaacggcagtggaggtgcggtggctgaggttggaaaaagagaaaaagaagggggaaagaggagcttgatcatgtcgtttcggggagggagagaagcgggagcgagagctctggctcccggttttggacgggcgcgggtggagcggcttgggcacgcgctgcagagctcgcggcaggcagcggggctgagcggcagggcggcatgggcggttgcgcggcgcaggcggccagggcggacgcggcggcgaccgggcagtcggccgcgcgcgagcgcgcgcgcgaaggtgagttcaaacggcggtggcgggagggagtttgacaagagggagggagagagaaacagagagaacgagcgacgctccctctcgactccgacagcgtgcaacgcacgtggtgggggaagagatgatgggctgggaggggagatgggccgtgggaggaaatccggtccacaaaacttgagggaggtaaaatagacttttccagagaatttgatttggagaatttgagtaggattttggaattgcaaaccttgaaattttaatttggtgaaatgtgaggaagccaaggatgggattcaaagcgggatttatatatatttcttttgaaatatatttgtatctagcgactccggggattatttgagagggattccaaaggaagggaaaatcaatattcgaagatggatcaaagggagatagcgatggaacgccatggataggtaggtaggtcaatcgatggacatacatatagttggatttgagaaactgatagttagatcgagtaggtagatagagcgataggtagataggtcgatggatagatagatagatgggtagatggttagataggttagataagcggatagatcgattgatggacatcgagggattcaaggacggatttgacattctccgaatccggagaagtattggcaaggaattcaaggacgggattgaattccggtgtttgatttcggaagttgaatcggaattggaatcttcaggtggaggattttgatggcgatgagagggaataacaggatttgaattgagatccagggcatgacttagactcacactcaaagaacgaaaattttcgcaattaggattttctcaaactagtttttaacgtctcacgaaaagcggagcgttacagatccaccccccttacaagaatcttgaccccaagatttgaaggtggaccacacacacgaaaccaaaaaggggatcttcagacttcatctcagcttcaactctgttggtctttcttcatctcatggttgcacactagccacaaaacgatctggtactctcactcacttaacatgcttcatcttactgtgggtttgtttcttcctgcggattctgttcttcagcttgctcgagattcataacttttccttttgtttccacttgcacatggttcagatgactttgtccaacaggcggtgaggttagcgagacagatccactgtttggtgactttgagctttttggtccgggtacgctagggaggctcgctgttggttgaacttgctttgacttgactttctgagggcagtaccatgaatagtgtcccatctcatggcagatgaaacattcgactcctgccttatgaccacgtcttttcggaggtggagggcatgacacggagttacttccttcaaggcttttactgttgatcactgtggtttgctgactagattctgacattgtcgagcgagacgtagaaccgaaaccattggaatactgaaatactctctgatagtactgtgctggcgagtttgttttttttgacacaaaccttcttttgcttgaatctctaaggatattactttgcgtctcttctattcttgcatctcttattctgcatcttctagtaacaaggacttatcgaccatttgctgaaacatcgagaagtcgtgagccaaaagtttcactcgcagtttcgcatccattccttttaaaaatcttctgatcttctttttatcagtgtctgcatcttctagggcatatcgggccaatctgttgaagcgactcaaatactcgttgataccagaggatccttgcctgatatttgcaaattcttccttcttcaaatcaattatgctttcaaggatgtgtgctgagcgaaagacttatgcaaattctgcccagacgatggtaccagcatctgtatggttagcacaatagttatcccaccaatctgcggtaggtcctctcaactgatgagcagcgtaaagggtcttctcatacggagtacactgtaccagatttaatctcctttccacatctttgatccaatcgtcaccttcaataggctcagttgtttgagagaactccggcggacgtgatgtcaagaaatcattcagttttgatcgcccattatcttgaaccatatggggttgacgctcttgtgtgtgttgttgttgcatagcaattatattctgaatcattccttgtaatatctgagtttgcatggctaggatttggtgaaggtccatgggtgggggttgattacctcttgcattattaactgattcggaagcaaccgtatgatcactctcagcttcttgctcatctgcttggttaactggttgatcgggaatctctgactgaactggctcttcttcaaaaccaaagcgattaggagcacgggtttgacgggtagaacgacgagccatctacttcaaagcgactgagatctgaccgaaccagaaatgggataagaaaaggaggaaaacaaaaacactagatcaaaacgtttttcgaaatcgcagaagacataggtggtgtattccagccggtaacccaactggtctaacacctgaacacgggctaccaaacaaaactcacacacgcactagttcaccacaactcctaccgagcgggtgacggagctagggttgcctaccaacaagggcttaactaagacgcctagaggcttgagcacacctttcttcaactgggcgtgaagacaggtttactctaggataacatgtcaaaacaaacgactagcttctacttttggacacaaaaacatttttcgcaaaactagagctaaaggggacaacgacaccttagctttcacaaatagtttttgtactcaattaatgccatcctattcaggggtttcgatcctagggccaactaatgctctgataccatctctgtcacaccccgatccggcaccgccgtacaacggcacctgacaggagcgtgtcgtaggaaaaacggcgtgaaccgcttcctacgaaaccgcgattacagtaccagtcccaggacatagtgctggtacccacggtgacaaatatgaatcattgcaatccttaaaataaataaatgacttatttaccttaacttaggttgtagctcagaacagcccgagaatgcaaccgacgacgcggacgaggaaaacaccaacagcagcagcagcagcggaaccaacggactaacacccaacaccacaggcgacggctgggaaccaggacgaaaccctaatcttcacttcacatcatcttcacttcacgacggaggaactatatatatatttatatagagaaagggtgagtactttcgtactcagcaagtcacgggaattaggtgtttaatgcaagcttggaagagaggtaaggttgttttacaaatcctttgtttgaaatcatttagaaatcactaagtgatttatttctttctaagtttgggtcgaaaaggagacttgcgtcttgattcgacttaagagatgcttttcaacaactcaattggtaatgtattgacctcccgggtcaaatcattacttcccggctcccagagccatttcacttgattaagcggctcccagagcctttttcattttctcggactcctagagtccagctgcccagcagcacaacaatccgcttcc

SEQ ID NO: 72519 - DNA, 8490 bp, Oryza sativa
ttgattccattgacatctgagagtataatgtagctaacattagaagactcattgtctaaaaaaaagctaacattagaagactatgaataaggagtataatgtagctaacattagaagactcattgtctaaaaaaagctacattagaagactatgaataagtaataggtaggtaactcgcgattgcataactacataaggggggacaaacaaattattgattaaaaagagcattcaaagccaactacataaggggggcaaacaaattattgattaaaaagagcattcaaagcctacatgggttacctgattattaactataaacagaggaatcaatgtaagatcgtaacaaccaaaatgagaatggctccaaagtagaaaaagggaccacacaccatctgattacttggttacattaccaccagcatctgacatcattagcagcattcacgtgatggccccataagactaaatagaaatttctatcaagcataacataacgttcacattctcttgtgctacaaattttagttgaagaataatttcaaatgtgctttattcatagttttgggagtaacatgggtttggcaacataactgttcaaaattacaatgacggtaggaagtccatacccacatattactgaaacagaagggctacgcttgacgcattaagacctagtctgatcatatttcttaccttaactaatgaaataatagaagtacaaataaaacgacatcgattacaaaactacccaactctacccagatcatcagaacccatgaaatacaccatttcacctccccacccgaaccgcagcggcagcagcccaaacaatggaagaaacaccctccgaagtccgaacccacacattacagcataattaggcacagcctagtaggctaccgcataattagacacagatgcgatccgcaccaggcgagctccgatcgaacggaaggatccagcaggcacgcgagggggcaaacggagcagaagaggaatcgagacggagaggcatggtaccttgggccgcacgggctcggggcgcctctcgggcgtcgtcgtcatcgcgagccgcggaatgcggatggggcttcgctggagcctcctcgaggtcgtcgcgggccgcccagtcgtcgtcggcgggttggagggaggtgatcgccggcgccggcgcgggcgcagggtcggcgtcgtgctccatctcccgcgagcacgaggaggaggaggaagcggtgggggttgggttgtttctgccccttcgcctttgtgcccacttggggtttttcttggcttagcggaaaatttccgctcttttcgctgttttagggtttttcagtttttttcgtagggggattttggcctggggaaatggggaggagtggggggctacggcggcaggccgagaacggtggagagggcaatacacgagatggtgctgctttggcgacttgcggccccgatcttttcccaaacaaaatttttacagattgttatatcgaattttttgacacattaagtattaaatatagaaaaaacaattacatagttcgttagaaaatcgtgagacgaatcttttaagcctaattgcgctatgatttgataatatggtgctatagtaaatatttgctaatgacggattaattagacttaataaattcgtctcgtagctttctggcggaatctgtaatattttaaatatgtgtccgtatatctaatgtgacatgcaggggcaaaaaaattttccaactaaacaggccctgcttatcagccaaaatttgaattttcaacattaaatttggagttgatttggggtttttcatcgaagttctaagaacacgtatataaaaattttatttacaaattctttttcgtttgcaaatatgcagtttcacatataagcgaaacgttgaggcctttggcgtgctcccgtgcctcggcccgcaaggcggatcggcctaaccgagtaataactgggcttctgggtttggcctttcggtgtctggtcagggttgaacgtggtatttatgttgactagtaatcatgcaatgcagatgcaatatgaggaaatcaatgcttgcatggtaatgctcatacatcttgacacagtaaatttagatatattccaagttcatgatcagaagataatatggattttataagacagtatgaacttgtaaagagtaagatcggtccttaattagacggtacagtgtagaatatttcttgcacacattgcaaagacaaagtcagttagaacttagaaaccttgcatccgattgtctttatatggcgaatttgtaaagtttcagtacttgctccataagaattcataacaattagctcagatgaaaaaaaaaacattgaatgccatgcacaataggatgcctcctcttgtaaagaaggaaaaaaacgaacgcctattaggcatgtacaaaggaccaaggcaaaaaaaaaaatagctagtcatatatagtacatatggttatttctgagaaaaatacttttccacatattgggggttatcttgtgatgtaaccacagggagaggagaggaactttgtttgctagatagatgaatatttctgaaacaattctgtctcctggaatgcatagaattttgatcttgcagaagtcttcttaaccggctctggttgctttggtgcacatataagagcatcttcaacagcctttccaaatattcatatagctaactctctatctgatttggctagtcaaactagctacttgctccaaccgcctctccatctaccacccctattataagtctatgacaaatagaacccacgtgtcagcctcacttcctcttcctcttccccttctcctcctcctgtgtgcatcctggcttcctttcctccacccacgatgccaaccaccaatccgccgcttccatgccctccccttcctccctcacattcgattagcttcaccgccgcgcccaatcgccccgacgtgctgctccaggccaccgattccgtccccgtccaacgccatggcgccaggagaacgacgacggcggcactgggtggatggcgcggcaggtagggatggggaaaaagggagagagaggagaaagggtgtaggacccacaccgatggcaagccatatcggctggctaactttggctagtctggtggggactttagccagctggatgtcttggagaagcatttgactagtctgttggagtagaatttttgtctaagttagccaaattttggcttggagaaccatttggctaggctcttggagatgctctaatgcatggtcattttttactcttgctgagttgatctggagtgtttatgttgtttctgagtataatgttaaaacagagggagcatattgggaaggctatttgactagggctgtgtttagttcacgcaaaaaattggaagtttggttgaaattggaacgatgtgatggaaaagttggaagtttatgtgtgtagaaaagttttgatgtaatggaaaagttggaagtttgaagaaaaactttgaaactaaacatggcctagatagcattggatgttttggtttccgaagttccttaaggaaccacatcaggcaaattagaattttactgaccagcactgatgtatttttcggacgtgataaccagctaccactccatctatgatagacactattcatctatacttcaaatacgattttctcttaaactactcatccgatctacgatccgattacaccgttgtgttcgtaacaattaaatctttataacaagatctcacatgattatactttaatgaaaaaaatataaattacttttataacatatctaaattacttttagatttcactaagttacttattagacatataaaagtaattcaataaagcctaaaaataatttacatatactctagaagtaacttataacaaaaagaaagtaacttctataatatatattaattactttaaaactttattgaatttacttttatatgtcgaagaagtaacttagtgaaatctttcactaaaagtaatttagatatattataaaaatagtttgtgattttttatcaaaatataatcatgtgagatcttgttgtaaagatttaattgttacgaacacaacggtgtaatcggatcgtagatcggatgagtagtttaagagaaaattgcatttgaagcatagatagtaggaatattttttctatttgcttgatcaattagtactatagtaaagtaatattcttcaagacacatatatggacaatggctgatagcgtcgctcgttatgactaaatcgagatcgctctcgatgtagattttgcgtttctggacggctggatttctggttgtcacgctagttgagtttctgctcattatctaatctaaatatagtaattatgtagaaagtctgttatctttgatgggaggtcgtgtccgtccacaatatgagcaagattaatcggtttctgtaactgaaacaagcctgcacaactctagctcactactagaaaaactatttttcccaacgtgagggttttattttcacaggcggatatgacccttagagtcaaatgaccgcctacaaaaatataaatcggggtgaaatttaatgcccaggcggaccatttaagcggcgaatgcgaaaataaacttgaatataaataggcttgcgggccctaatttttttctaagtccttacacctctcagtcctcccctcgctccacacctctcctctcttcctcaccggcctctcccctcccctcccctcccctctcctcctctcccctcccctcacttctactctccctagcggcggctcccggcggcgcggcgggcggtgacggtggagggcggcagtggcgaggaggcgcggccgaagtccgggaggcggcagcggctcccccctccctcccagatctagccggaggagggaggggggaggctggtggcggcagcaacggcgtggagcggccgcagcgtggtccgggcggctcccctcccccctccctgtcagatctggccgaaggagggagggggaggccagcgggggcaacggcggcggctcccctcccccctccctctcagatctggccggaggagggagaggggaggctggtggcggcagcaacggcgtggagcggccgcagcgtggtccgggcggctcccctcccccctccctctcagatctggccggaggagggagggggaggccagtgggggcgacggcggcgacgacggcacggggtggccggcggcgtctccccttcctccctccctcgcagatctggccggaggagggaggggggaggccagcgggggcggcggcggcgacgaaggcacggggcgacgacggcatggagcggcgcggctcctctcccctcttagatccggccgggggagggcggtggcggtgacgacgacgactgcggcggttcccctcccctctcagatccgcccgggggagggcggtggcggcgagccgcgtgcagcgattttttttgttcgttttttttttttttgcattttcacaggtgggccgttgccccgactgtcgttgtgatgcaggcggatctccctcccgcctgcgaagattagttttggctgcctgtgaagattagttttctagtagagtggctggccgggctagctactgctgaaacattaaactaaacaaagaaaaaggaaaatattgcttatatcttcctcgaactggtagatgactggagcatcttagtgtaattctcacatagtagtcagggctacataatccggcttaagtaggttttatacccatataaaaatatgaatatgatcacgcatatcccggatataataatgccctgcaagaatatagagaagagtcagtatagttggtaattaatcatctcattttggactattctaagagcatgtgcgcgcatggtgtctaataacggacgctttctattgccctgcaaataaatttggtgatgtggaagagagagagggaaaaggaaagcaaaatgtctaaacgtttattaacggaaattttgtttcataagggtggattaaaggaaagaaggataataaaaattatttagtgcattaatggttaagaggttttgttgtctctattattgtagcatgatagtatctagtgctacaaagagctcgtattagactctacctttatatatgcctaaaaaactaatttctcaacaaaaccaatcattagaaaaaaccgaacaacttactggattcaaatcctctcagtaaactgaattaaaaaaaaagttacaacgcaccggcctgtaactaacacctagggaaaaagaaaatatggaaacacttgcatacgtacccataagcaattaatcgccggctgccgccaatcgtcgacgtcgcctccatcatcacccacaaaatcgtcgtcgatgcttttcgtcggcgctcgcgggaggagaagaggagccgcgggatcgtcggcgtcggcgtccttgcccttgatgatgcgtatggtgatgtaggtctcccctggacgcagatcccgcgagcggctaggcggtggcgagtcgtcgtccgacgaattttttttatttttaattttttttattaaaagttttaaaaaataatttttcattttgaaaattgacagaagtggtcgcctaccgccctctgggagggcgatttttaaaaatcaccctcccagagggcggcgaaagtgacgtggcagacggtcgttcgctctcgggcgacggccgtcaacgaaatttgcaggcggcccccttgccaccctccgctagggcgattttgtactgtgcggggggccgcctacaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcattcgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaaatcaccaccataattaaacattgtaataataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgcatcttcggtttgcattgaaatatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggctttatagggggaggcaaaaatcgccctcccccagggcggcaagggggccacctgcaaaaacccatgccccctcgccgcccatttgcaggcggccccccgcacaggacaaaatcgccctagcggagggcggcaaggggg

SEQ ID NO: 72520 - DNA, 4480 bp, Oryza sativa
tacccatcataaggctggtttattccaacgattcctccccaagaccaccccaaattatagagcataaaaaaatattccaactctgggagatcgtaaacaggaaaagaagaaaaataggcaccgcccacactccaatagctctagcttaaaacccgggaaaaggctagcattcgttccgaccgcttgctaagccaacaaaggaattcaagtgagatcgtctaaaatccattcctaacaactgacaccaaactctactctagccacatcttcgagattgagggaaagagtgacagagaagaatggaatggctctccaccagggccctctgacgtggccatcttgcataagctacggcgccgacacaagaggacataagtttaaagtgagcttgcaccggttgtctgtaggttcttcatccacggcctaccaacatgacgtctctagggagaggagtgaaagaagccctcccgccaccgttgctgaaggtgccgcctcccctcctgatcccccaccatttccaccccctccccgctaccgccgccgccgccgcatcgacgcggattggatggattcgccccggccgcgcgggtggatggctggtcctcctcctcctcctctctctctctctctcagtatcaaggaagaggaagagacgtgtggaggcgtccgtctcttcggcggggcgaagcggtgcgtgtgccgtctccaccgtgctactgccgctcgctaaatacacgcggctcgtacgggttcaccagtgtagtgtactaccagcccagcctcggtgcgccggtctacttctggctcaccgcaccgcaccgcaccgcacattcgcatcacccgggccttttttggcccgggtcgccggcacggtgccgagcccttttcacacgctggccctctccaccttcctcccatttttcctcctcctcgtggtttttttctccttttgttttcacaccttttttttgggtgtttatgaagggacattcgcgcggtatatgcaaatgtgtgtacagtgtgtagtgtaatgcgcgaacgtttaaacatttacgcgggaatggtgcacgcaaatgtgcgcgctgggtgttatgcgtggacatttgcgcgggaacggtgcatgcaaacattgtgtgtgttatgaggtgtagcatgcaaacatttacgcgggacgtggtaaatatgcaagcgtgttccgcacggcacatgtgtgtgcgcggttcatgtttctatggctgtgttttgtgtttagttcagcgcaaagtttaaattttgtttgaaattggagatgatatgactgaaaagttgtgtgtatatgataggttgatgtgatggaaaatgactgaaatttagatccaaactttagatctaaacacagcttatatgtaaaaatgttctatgtaaagaaaatgtttgattagaaataaagttttgatgttgaaattggagccatgtcgaaattagatgtgtcttctgtgtgtagaaatactattttaggaaaaccttatgtatataaggtttcaatgtggaatgtttctttgtataaaatggaaccaagtttgatttagatattgaagttcatatatataaattttatctatataaagtttatgtgtataaagtttcacactagaagtttgatccgattcaaaaatgggacatttgccctcgggggggtacgcatgaatctttttgaccctttttagtgccttccgttcactgcctgcttagtttatccaagttaagccagggcaaaaataattaggcaccaaattgaaatggcatttggttttgatagtgggttaataaacaataaacctttttataatatcctcactgctgctaattttgagcgaactttctaataaccgtgtagatgtactagctgggacggataatatagagaaaagcaagcatatattttccttttttttttctgattggcagcggatggtacacagccacgccgggaaaaaggggttactacatgcgtctccatggctgtcaaatcatgctgttcctttcaataaaggttagtttttacaggatttgtccagctaatatgttgattgacagattctgagactgaaaattaaccctgacctttggtctgatgatgcacccatgcgattctacagctgctacaccactatatatatacatcagtggttgaacaactgcaccgtaaattgtttataggacaattttgtataagagcatgtacaatagaaggctgtccctctcataacctatggctgtccctctcatctcaccatccctcaactttctccctcacctacagtggtcttcgttcccgctttgaagcacacggccgttcaacatcgaaccacagcatgacatgcatccaaatcttgttgcaaaggcaagtgatttcatccataaaacttatgatgtcaaaaaaagttggattgatcttgagttgagtaccagtgccagtgtgccaccaaatctcctccaacttttgccttggctgcatcagggttgtcaccaattagggaaagggatctcatgtttgtgagcacagtaaaagatggcataatcagatgttggtttgaggtgaaaaaggaagaagggacattattgtggatctgtccatacaatctccaccgtccctaattgtggttagcaacaagaaaaacgtggatatcactacaaatctcttgggttggcttgtgtagttgtgtagtaggaggtcaattgctatcatgggttttggtttgagtccttcatggcatgtgaccacgagctttaatagcggtgatattgtgagaaattgttcaacaaaaaaatgtagtatatgtattatgagtggtttaaaggttaaatatgaaaaattgacctcaacaaaaaaaactctatatttaagttttctttcttttcggttgacaagtcaacaagtataaaatacaaggcgtaagcaagttcttttagtttcctcctcacataagggtattaaaggtgtttttatttgctcataccgtctccaacacaaggtcgttgagatgtttacttatctaaaccatgagaccaaatgatttttgctgtttaataaatagatgcaccataaaattggtacggggatttgattgacgcgatgaaacataacattcttatttctattggtgtttttactctgcactttataggaggttcttagcattttagcaacctttatatcaaatgcatgccttgataaaaacatcaaatatgtaaaaccacactagtttttatcactacaagaaacaatagcacacacatatatatgattatacgttatgtggttaaatccagcatatgcttcgatgtcttccctctaaatctagctcagcggccatggctttccgtagtcgagctttgtaatccttcttccacatgcaaaaatttgacttgagcttctcgaggtcatcaatggaattcccaccttgagtgcttggctgccatggctcccttgactccacgagtgcttggctctgttgtcggaactccgtgcatgtaccacgagcaatgcccgcataatggcgagagctgtgcgccaacctcgccgatgtttccttagacatcttcacgtaggattccgaggattcttggcggtcatatagtgataacatttcacgtgatctcttttctacacattcttgagccacctgtgagattcagacaatcaatcgaggttagttagattattgtcactttgtcacgtgaatggctgcaaaaatggtttgattaattacgtagctggtgatagtgttatgatgctgacctgtagagaaatcatttgttcatcaatggtttccttgagagagctgagcctaatctcgtgttgcagccacctaacatggtaaccctcaaacttccgtttcagttcagcattctcctcctctttttgcctcaatctcgcctctgccatggccgccttcccctcaagctcctcaaccaacgttgttgttttgtcctttgcttcttcttcctcctggcaatccaagccatactgataacttgatttgcacttattattatgattaattcatcatataattcaaatgatggaaccttgagatgtgatgatgaccacggttgcagtgtccatggccctgagaattcgacaatgacatgcctttgtggccgcgatgaatgtcgtcggcatcgtggggtcggccgcatgggaagaggtggcaatggcaatgagtcgaggacattgtcatcgattaacacattgtcgcctcctcctcctcctccttctcctgatgatctccccatcatcggattcaacatcacctgcaaggagcttagagccaatgtcgctatgattgacgggctctctaaaggatcccaaggccggcgacccctatgacatggagtatgaacgattgatagattattgtattagcatcaagaatcagagacatgcgatcaagcattgcatgatcgttggataaagaaagctagaaaaaaatgtaga

SEQ ID NO: 72521 - DNA, 10512 bp, Oryza sativa
tttgatgagttcaatggggttatcaaaaaattgtttgatgtttatgctactagtgcgtgtgcaacatcaaagaagaaaggtgctgaaatgcatgtgcatcaacttcaaattcaatctgatcctgttcataatactgatgagtttgatgatatctttaatgagaatgacagtagccatgatcatgagcaacattttcaaagatttttgcttgagagaagtcagccaatttgtagtgataaaaccgagttacaaatttacatggaacaaccactgttactatggacttccaaagatccatttgatattttgtcttggtggaagctcaaacaagcagaatttcctatcctctgcaaacttgctcgtgatttcttatgtattcaagtgtcaactgttgcttctgagtcggcatttagtgctggtggccgtgttgttgatccatttcgcacccgtcttgatccagaggctgtgcaagctttagtttgcaccaaagattggattaaagcagctaacaatggtacactttgtgtctgtgttcattgcttatttggccattccttcttgtatatatcaatatatgtatagctgatccatgatctgatctggcatcattcttaggttataagactcaggctatcatcaatgagttggacattgaaagcgtagagaggcatctggcaaacttattgatagtggtgagctattttcttattttacctctatgaatatttttcttaatataacaataatattattcgactcctgtaggaaaaagaggagaataatgatgacatggaacaggatgatgttctgatggatgaaatggatgaataatgatgttgcaattttcattcatcggactgcaagtgtactgaaaattgctttgggctgattactattttgatcttatctgtgttacctatagaactcgaactcaatatgtgttgaacttttcaacgtgtttcgatttgaacacgatacactttgtttaatctgtgatgcgtcctacaacgatgatatttatattaaattagataaatatatgtggtgcatttgtatctacgagcagtttgagtggtctctatattccgagaaatattcgttttcgtattcgtgtccgatcatattcgatccttattcgtatccgcgataattcgtattcatttctgtatccgagttattcgtattcgtttccgtatccgcctaacaatatgaaaacggatacggtaagagcattatccgtccgtattcgctctgttttcacccctactgggtagccctcctattggctgggtacgtagcttgtcgaggaattatgggatctccatcttcaaaaaagttgttttcctttttttttatcgaggctatcgagagagactaattaagatattgcatacattcatacagaacaattgtgctattttataccctaaaatcggtactataggtgccggaacagctaaacccaccggtaatgccttttcctcctccgcggattaaaaccacataaacccggcacatttaaacaaaccataggtgctggtttttaaaaaccgacacctttaatataggtgtcagttaattacaaacaaacaacattcataaattcataaattataggagttggtttttttaaaaaaaccgacacctacacccaactgagccgaactggtgagctaagcatcggccttatccattccacacgtctttatctctctcttgtctctctctctcacctctctcgcttttctctgtcacggcggcggcccaaggaggtgctagcggtggcggcctcaccctccccttcgccagatccagcttgaggggggtagcgggatgggaggcgacggcggcctctggtgatgacggtggcggcagccgtgccctcccctccaccagattcggtgggaggggaagcggcggaccacggtgatggcagcggcagtggttgtgccctcccctctattagatccaacaggaggggaggccacagtggtctccagtgacggcggcggcggcgcccgcactctcccctccgccagctccagcgggaggggagacggtgcaccttggcgacggcggctgcgccctcaccatgttgcaacgatggcaagggtggagaaggatgtcggctgccatcgtcttcttgatgttaatctttttaatgttcatcgatgttgttgatgtttatgtgttgatgtgtgctttaatcttgtatgtattctttgatcttgtcgagatgaagtggagctgctcgatagatcggctcgaatcgggccgatgcattgagtcgttttttctttgttcatggaacctcagaggtgccgactaatgtgtaccggttgaaaaaaccgacacttttagctatttctgtactaatgaatattcatcgtatttctaatgaggtgtgagacctaacaaactaattagatgaagatatagtgccttctagtctcccatcttttcatccctatcaaatagccttccttctaatcaaactggcacctcatatgtatgcatgcagtgtggtcataaaataaggttatattctgataatttgtgtatgctgctaatccgcctctaatcttctagaaatgtaactgttctgggatggaggtagttaataaaaaatattaggattcagaaaataatgttagtatgttaaagcactttcacatatgcaatgtggtcataaaataagctcataatttgtgtatgttgctaatttatctctaatcttcttgaaatgtaattattctgggatggaggtaataattaataaaaaatattaggatttgacatcagaaaataatgttagtataaactaaagacgatgtgggatgccgtagagacaagacggtccggggtggcacctaagagtgagaaggaggagacaggcgggaggcttgtgcgatgaggaaggagcggggagccgatctgcaagggtgagtgggctgacgtgatggggccacggcgtcatgtagcgaggttggtggttggcaaaagaggacgtgtgaaggaaaaggtgtaggagattgatttgcgtatgtgtagatcgaaactgagtgatgagcacgtgcgtgattttctacctgggtgaccctgtgatggcgtcatagtggagaggtggggggtggtagtctgcgaggagcagcgatggcagcatagtagagagcggcgggcagcaaggtggagacagatttgtgaggaggcatgatggcggcatggtggagggtggggtgacgtggtttccgggttggtgcaatggttactgctagagaagatatgggagtgaggaggggaggccgagaaaaaacatggctgaattgttggatttggtgattttgggatgttggatttatttaatgaatggatgaactatacggatacgtataagatacagtgtatgtaagatgaatgatataatatgtaaatttaaatctctcatattatatcatgatagcacacgagcaccggaatgaagactacaaaataacacaggagcagaaaaaataacgtgtatatacattcacaaatataatttaaggtcattacatgtaaaaaaaaaaaaaagccattctcatttcaaggctccccacctcaaacctgaacctctggactcaaaacacgccaaggggggcattataaatacgtcctttgtacaaacagctaataaatagttaatttacaagcgctaaacaagatagtaaacatattaacttagagagcaaaatgcatacttacaatatgaaataattgcaaggcgtcttgcagacagtgggcagtctcctccattatggatacgagtgatatgactatgcttgctcagcttcatccggccttgaccacgcgcagtcttgcacgatgagattgatgcctctgacccatagctcgacgctggacgcggaggtggcctcgaagtggatctccctcccggtcaccgtctccaccattaggatcagctgctcctcgctgcccgtcctgatgatcctcctgttcctcctgaacgccgcgctgggccccgcccgggcctccctgcaggccacgttcctccggcgggtcgccccccacgtcagcacgccggaccgcatcatccgcaccgccttgcggtgcggcggaccccggcccccgcgcgtgtgcttcgtcagctcctccccggcgagcacgtgggcgcgcgccacgtggtccagcagccactcctccgtcgccttgttcgacctgccgctcctcctcgccaccgacagcgccgtctcgctccccgcgtcggcggcgccgccgcgcgacaccagcgccctgcacgcctccagcttgcctgcggcggccgcgtgcatcagcggcgtgtagccatcctcgtccatcgcgttgggatcgtggcccatcttcaggagctgcgtcagggaggaggtgtcgccgatccgggccgcgtagtgcaggggtctgaaagatggctgctggcctgcgatcgcatccgcgagcgaagcctggagtaagatctgttcgaaccgatcttggttcaggagctctgcttcggatgatcgacatcgcggatttcccttcggcactcgtggcagcgatatctgcccccgccatcactagaagcctgaaaatgtcagcatggcctgactctgcagcaaccataacaggagtgagccctgaaccatcaggcctgttcagatctgctgctgagtagtgtagcgtcattagaagagcttctgcactgtcacttgcagcgaagaagtgcagcggagagaagacggtgatatccgatgaagtgatgcagcctccgcaactcaatgctctggaaagaatgtcgatgatggttgagctaaatgagcttttcttagcaagcattattgctgtgtcacctgcattgttcactatcccaaggtctgcccctgatttgatcagttcaagaaagcaatcggagtgtccacacctcgcagagaccatcagaggagtgtccccagtagaagtctgcgcattgatattagccccatccaacatgagttgtttcagtacgggcgcatgacccaaccttgcagcaaaatgtattgggtaggagacgtgtgtgccgtttgtcatcattatgggaaatctgggattggcaccagcatttagaagcacgcttactgcattcgggttctgacagagtatggcatggcaaagaagatttcgacccttgcgtggggtttccagcaaccatggtgctttatcgagcagcaatttgaggatttcaccactgcattcgtagtactctactgcacaccaaatggcgttgtatttttccccaaggcatgcaccaacacgaagttcttcacccgttgcagagtcccaacaccaagaaccaacttgcacaagacagtccaagtaagagccttcctgcacacaaattttgatacaagtatcattctaagaatgtggaaacattctaaattagcatagtactcataaataatgtggaaaattagactgcctaaaatttcgtttactgaaaaagggacggccagtgcgtttagcatactggagtggaaacaaatttggattgcttggcatacagaacataaacttaatgggaaagtagtcggagaaacaaaaatcatccagacataatgcatccccacttgtcatatatatggctgccttgaatctacagaaatggttggaattgttgcaaataaaaaaaaatgggtattattagataatgagtttttcttcaaataaaaacagtgagttaagtaggaatggcaatgcacaactaagcattgtgaacagagtactacatccatctctgtacctagactaataagaacgcttaaaagatattcagttattgcagatacctcaatcaagagtttcacagttgaaatttgccggctcattactgctgccaccagtggagtgcaattcacattagcatgtagtgcaggcttaacagacctcaagaggaccctagccatggaattaacgtcaaccccattctgacaaaatgaaagtgaaccagtaaacacacacatatatatatacacaagaaaatgttatctttgtaactggctgtatataactgatatcatttgatcagacctgcagtagtatgaccacaacatcatcaaagcctcttgaagaagcagtcaccaaagcatgtgctgcagcttcaggctgtatcatctctgaacagactaatagccgaacggcttcagcctcagcaaaaagagcagcctctgatagggaatcttcacaagcttcccgagtgactccagcctgcagaagcatctctagaatatggatgtttccttcacgtgcggcagctgttgttgcatagcctagaaataacttttgattaacatcagctccagcaacctgtattcaaatatcaagtcaattactccatgaacacaattttagagtatacataattcataatacaatatatttactaagatactgaataattcccggctgtcctgttaagcacaagcgtcttcttttcgtcttctagatcttatctccttatggctcactcgtgccggcctatacatcattcgatcagtttttcgtcataattttcgtgagaaagcaattgtaatgttatcagatagtttgaacaaaccaactctagttagcactatgcaatattttcatcatgacacttctcataactgtttagaactgactgactggctaggtctgttaacctgataaacctgtctttaggcatgtctatgtcacatatatctagatactaatacggctccaatatatatgcaggaaacaatcgaatatctgtattatatgaaagaatctaatggtgcatgtggcttctaacgatgccatttatggactgatgaacctaaatcaagacaacgagagtacgagacaatatcagcattatgtcctcagtgcgacctcgttaaacctctacactgaacctagctatttctgtacctcaaataccgagcagtatacttttttacaacttgatacaccagccacctttccaccacctccactctaataatcagccttaaaattaaagctactgtagttagaaatattccagctatttatctctattagaaggccgcttaaaattgccaggtttgacattcctatagtatgctagctatctcgctctagtataaaatctcattgcaaacttaggtccctttttttggcttatcatgtgaaggttttcccaagttcttaattaatggtacgttttcttaaaagtttttctttaccagcatttcttagaaaactttttttagatgaacattttaatattcaattcattcatttgtgcgctggaataattgtcataaactcaggtttagccatcatccatcaactatatcaaacggaaccgtgcacctgatacatatcttattgtgcggttcctgtattagcgtataaaatatacatgcatgttcaatatacgtgtaaaaaatatatctactattatacttcatatgccaaataagaaagccttaaaaccgcttacatggctaccttccccatgagctctacgaggtgaggtgaccacacgggactccgcttactacctttttagaacattatcatctataatattaaagcacatggataacaaaaaatatttccctctaaaaattgggcccactttctcagtaaaatcagcttagagttaacaacagtaaaatctgataatttatatatagcaaagcttggaaaatatactactgagaaattgcttagcttcccaatttccaaatttcgagaatgtgctcaaggtgagttgtgatgtatctcttgtgggcattggacctgtggtaagtcaatagcaagatctgccatcttctcaaggacactgttgaatgcaactactaatctacctaactttgtaaggggcttcacagaacaggtccaaggaatcccatctgttttgtatcacatcaaaggtttgaagtccacttcaggcacttgtatagtgggggcactaggaaagatttgagcatcggaacaccaccaacatgaaaaaactcataaaacaacatagcttgtgatgagaaaaacatttttcattaggcactgcagagttttagccaaggagtacatgctagtcaaattaataagtgatatagaagtttcaaagtggaaccgaagccatcacattcttgtcttgaaaacaaccgaagaagattatccatcccattccagaagggagagcagttgccatcacaccataccaaaaggtgtaacaagattacccatgtccctaatcctaactcaattcagtgatatgcattggcaaacctgctaatattctataaaccaccattagaatagactgataaatctctccactacagtaataattttaacaggaaaagaaggggatctgcaacagccattcgtttgaatggttttagtttattcttaataatttagatcagaaaacactcattcataatttgtgcgaatttattttggattactatgaaagggtacaagtcatccagaatgtttttttactaatcattacttccaatttattcagaattccctccgaacgtacctactgaacaaatttgaaaattttgtcatgacagacaatgcgcacaaattatttcgctctaaaaatatttggtcagatgattaaacccttggagattgaatgcgaggggattcaaatcttggaaagtgagagaaatgaccagtctgttgacgaaaatttggttacgatccttaccaggagggtgcgaacaacttcggcatgaccggcgtgcgcggcggcgaagagcggcgagacgtcggtcttgagctcgcgggactccacgatcacctccccggccgcctcctcgcggagggccacctcagcgcacctcacccgcaggcgcgccaccccgacgcggctcgccgcgggcacgccatcgtccgtgtcgtcgtccgctgcggcagcggcggcggcggccgccaggcacgcctccatggtcaccacgtccccccgtagggcagcctccacgagacgctgagcgggcgacgcctcctcctcctcccgcgccgccgccgccacagcggccgccctgcgccgcgacatggccgccaagtgtgggaggcggcggcggcagcggcgtctaggtggtggcgctcgccaggtgtttgcggtgtggtcggcgaggagagcgaggaggccgctggtgctgcgtggctgccaacgttcgggtggcgaggcgactggcgagactttggggagtaggtggaattcgaagtttgaaactagtcgcactggtataaaagtgcaaacgcgtgattttctgaagtaaatatctgagtcaaattgtttttgttttttatttcttgaatattatttttaaaaacaagccccgttcaggtctagaagcttttactagtgttttttttaagcaatttggcacgctttattaatctgcaaacataattacatcgttcactataatgttcagctagaaaattggagtctcatcaatccaattataagaattcttaaacttaaaagtataattagctacaagcctacaacatgtgccacacaatttgcttccctattacaatgctcaacagagactttaacaaaatcatatatcaaaatctggcattcatataaaattgccgctgccgtagttgcttaaaaacctccatcttgcatcgtctccaccacctgcaaacaatctgattgagtaaatagtactccctcattccctaaatatttgacaccgttgacttttttaaatatgtttgaccgttcgttttattaaaaaaaacttttgtgatatgtgtaaaactatatgtatacataaaagtatatttaacaataaatcaaatgatagaaaaagaattaacaattacttaaattttttaaataagacgaacggtcaaacatttttaaaaaaatcaacggcgtcagacattttgtgatggaggtagtatcttgacaaccaatctgctgggcgaggatgagtccatccctgaggacgtaggcttctgccattgctgcatcagcaacatgagacaagtacctacaagaactagctaaaaaattcccttgtgaatctcgttgacagctctggttcctcctgtactcgagacgatgtcaaaggaagcatctatgtatacgagaattccttcaggaggtttatgctatccttcccatggttttgcatccgactttttcttcgccatcttataatttagtgttagagcaacaatagatctagcagccatctgaatcctttcaccattcactacttgtcttctttcccaccaaatgtaccatccccctgttaaaatcaattcagcaaagcttttaccagtgtttctttcagaacatgtgccattcggagtgagagtttcaaacttatagtccctcgttttctttgtacatgcttctcaaaatgctaaatgatttttttagaataaaatagaaaagttgctttcaaaaataatattaactacttttaaattattttaagctaatacttaagggactacttattgatcttt

SEQ ID NO: 72522 - DNA, 46825 bp, Oryza sativa
caaacatgcatgttgttaagctgacacgcggtgacaaagaatgacgattttgtgaccggtctggcactgctcatgttgtaagcgcacggccacgtcccacgacgcgcctgcccccgtcaagagtgaaggtaggtgtgggctgtcccatcagaagggctcccggatggaaaccgtactgatctccgcccattaaagagaaaaagaacagtccagtttggaaagagaaaggtgcatgtggtatccccttgagatataaaaggaggaccttgcccatttagagaggagacttcttcccttttgaaaggctgagaggggaaaggaagttaatcttttgtaacttgtccatacacaaatccacaaaaacacaggagtagggtattacgcttggcagcggcccgaacctgtatacatcgccgtgtctcgtgtgtcttgcggacgggtgatctttccacatacagagagagagagagcttgggattgcaccctaagcccctggtcgaaccggcaaaggggggcttgcgcagtctcccggtgaggggccacgagctccgtcatctggcgcgccaggtaggggactcagtgtgtgttttctgagctctcagactcttccgtgggcgccaagtttttcttgttcagcctaatggccgagcaaggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccggtcgcgggtgatgtaggagaacggcgagatggggagcgtcgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccaccaccaagacttccggcgccgccaccaccggttccgtgtcatcaaggcggagggcgcggcgagcggcggcggctgcacggcattcggctgccactccctcgtcgacaccttcgactcgggaggatcagcatggggagccagatgcccgcctcaacatcgagcgccggcgtaatagccggcgtactccccgtgcaacggagggcgcctcctcgtccagagtgtcacctcgacatggacgtgaggatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaaaaggtcggtccattccggcgacgagggtcacgtcctcgccatcgagggcgctccgcgggccactcgaaaggggaggcctgcgagcgacaaaaagaaagaggctggtactcccagcagggagcgcccagccagcaagtggtgctccgtccacaacacctccctccacgatctcgcggactgtcgtgcagtcaaaaacctggctgagcgaacgaggaagtgggaggaggacaggaggcaggaacgccgtgagggcaagtcccggcggttccttccagcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgagccaatgcgtcgggccggtggtcgaaggttgctctcactttcgaccagaccgaccacccaccgtgcattgcccggggagggcaggttgcgatggtggtttcccccaccatctgcaacgtgaagttggggcgtgtcctcatagatggaggagcggctctcaacatcctttcccccgcggcttttgatgccatcaaggccccggggatggtgctccgaccgtcccagccgattatcggcgtgacgccggggcacacgtggccattaggtcacatcgacctaccggtcaccttcggtggacccgccaacttccgcacggagcgggtaagcttcgatgtggcggacctcagtctgccctacaacgcggtcctggggaggcccgcgttggtgaagtttatggcggcggtccactacgcctacctccagatgaagatgccgggcgccggtggccccatctctgtccgtggcgaccttaaagtcgcgctcgcttgcatggagcagcgcgcggaccacctcgctgctgcgactaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaagaccggtccggcagaaagtgcggcggcaggccccggaacgtcaagccttcatccgcgaggaggtggcaaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgttgactccactgcggggtgcgaccttttgtgttttctagatgcatactctggttaccatcagattcgcatggctagggaggatgaggagaaaactgcgtttattacccctgtaggaacctattgttatacatcaatgcccttcgggttaaagaatgcaggtcctacttttcaacgtactactcgaatttctttgggtagccaaataggacgtaatgttgaggcttatatcgatgacttggttgtaaaaacgcgcaaccaagaaactttactttcagatctagcggaaacttttgagaacctccgctccgcccgcataaaactgaaccccgataagtgcgtgtttggtgtacctgcgggcaagcctctcgggttcttggtctctgcccgaggcattgaggccaactccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagttcccccccggttctagtcgccccggagccaaatgagcccctgctactttacttagcggcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgcttgtcagacggtgccgggtgcccccgaccctcaggaaggccccgaggccactgcgggaaggccgcacctaccaccctttgaccccgaggctaaccctgtgctgattcgacccgggagagagcagggagaagaggcccccgagccgaacggaggcctgaggcccctgacgaccggagctggccctttgcccgcttgtctgacgacaccaggagcccccgacccccgggacggccccgaggccactgtgggaaggccgcacctgtcatcttcggaccccgaggtcatcagcgcaggagacgagtgtgccccgagaggccacttggacgaagagcaccccggggatacggcccctagcgaagaggatcggccccgccgaaaggtgcagcggcctgtctactttgttagtgaggccctccgggacgccaagacccgatacccacaggcccagaagatgctttacgctattctgatggcctcgaggaaactgcgccattattttcaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaattcccgaggccagcacggacccctcacagctgcctcaaaccgcccattgggtgatgcagttcgacggttctctgtctctccagggcgccggtgcaggggtcacgttgacctctccaaacggagacgtcctcaaatacttggtccgtctcgactttcgagcgactaacaatatggcagagtacgagggactccttgccggactcagagtggcagctggactggggatccgccgcctcttggtgttaggcgactcccagctggtcgttaaccaggtctgtaaggaataccggtgctctgacccacagatgaacgcttatgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgatcccttaggggagacggatgcgcctgaccggcccccgaggcccgtcggagtccaggcctcgggacccgaagggagcgctacaagctcccttagattgattgcttggatctctgagatccaaacatacctcacagataagactctacctgaggaccgcgaagggagtgaacgcgtacaacgcatttccaaacgctatgtgttggtagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgtagcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactctttggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaagacggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaaaccgtggaacatcgaacaccttcgtcgcttctacccctgaggaggggggggtcgggtgtcaggttttggctcaggccaaccccgcacccccctcgggtgtgcagggttggccgggggctaccacacgtgcattacattcttatttctcttttttcaacatttcaatagaagcagtttcaatttcctaaaggttgtgtctgtgctgttctttccttttgaagaatcttgacttaaaataaggtcactcgtactcaaccttgccctcgggggttcggttcggtcagctaaaatcgtcaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatgacacagatacatcctcatcgcgtatgtatagcaaaataaaactaacacaaaaattttttcatcatttctgattgcagattaagttaatttgtacaaaaaagaggcatgaaggccttagaagaaagaaaaagaaaaaagttaagattggcgggggcctgggcgctcattccaatgcgcccgggtcgccggcctcgtcgccaccgtcgtcctcgccgctggcatcgccctcctcgtcggagctgggggcgaacgcgagccgaggggccgagccctcgaagccgttgacgatgtggtcggcggcatcccggacgcgcgcgcgcgcgtcgttctcggtcccgggagggaactcctccagcgccatccagggagagaaattggggtcccgggcctggtaactcgctagcacgagttcgaccgccccccgggcgaggtccctcgaggatgacttgatggtcttctcgagctcctcggggagtcgttcaaggacccaggccattctgttaaggtgcggagcgaggccttccagattggtggggcgcatcctcgtctggcctttccagaggcccgcttgccgaccagcgcgatccatgcgggagaccgagtcccaaagcatgtcgggccccatctcgcccgccaagcggagggcctcggcctccccgatggaggaatctagtgcgcgctgcatgtcagcgacggtgtgttcggcagccgcgaggcgagcggctaagtcgctttcgcccgcaaccgccccaccgacgcgcacccttgcgtccagctctttctcccgcgcctcgaggtcggcagcccgctgctccagtgcggctctctcggcgcggacgcattccagattgcggcgcgcctgctcctcctgcgctgcctcgcggagggacaggctgtccgccagccgttgcgtcgtggcctcggccacctcgagagctcgctcccgctcagcgagtgcatcctcgcggaggcggagcgcggactcctcctcggcgcaggcggcctcatgcgccgccagcgtcgcctctcggagaccagcggcggcctcgcggtccgccaagcccctctccacggcgccggcgtgttcttccagcgccatggcacgggcctcaagggcctcctcgcgccgccgagacgccgcttcagtcttcgttacccgccgctctcgggcagcggcggagtcaaggaccccttgggcggcgtcgagctttttcttcagctccgcctcccagcttgcgtgctgaaggcggagggtgtcttgcgcctcgaccattgcggtggtagagatgagggcggccgcccgctcctcctccacctcacgggcgacctccgccagcgccgctttccgggcttcaagctccgagacatgacggcggtgagccttacggcccacctccaccatggcgtccaccgagcgccgcccctcctcaacacgcgtccatgcggcctcgagctccgctcgttccgcacgcagggcctccacttgggcgttgaacccatccagcactgcggtgtttgcggcggccagggcttgcagaaggggctcggcgctcagcggggcgacagaagatgaggagaagagccgccttggagaaaatgcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggacgtcgcctgagggccgcccgagggagtgggcccaagtgacgcgccagcagcagctgtcgcctcagcctggcgagcccggtcggcctcctccttagcagcttcctcagcctggcgagcccgggcggcctcctcccgagcagcttcctccgcttggcgaacccgggcggcctcccgggcggcctcttcagcttcccgaaggcgatctgcggcttcacgccggtcagattctcgcctccgctcctctgcggccgctggatcttcggcctcggactggccggacttggggtggcgggaggaatgtgacggggcatcgctgaagcagaataaaaaaccagaagacaaacaaaatgagtaagaaaaaacttctttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggagaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagaccagcgccgggggctggcttggaagtcggaggcgcgcttcgttggcgaggggggtgtagaaccagtcgctcttccagtcgtcccacttcttgcggaggacgcaggggatgtagcggttcagcaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagttgggcgtagcagagaaagagtttgagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcgtaacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccatatatatgggataagtgagcacagctgtgctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccatcccgtcaagacgagaacctctaggcactcgtccccagctggagctagcgtgttacatcccggagatggcacgttagccccgatcgatatatgccaggcttcatcctaaccattacaggcaagatgttgtgtgaagaagggcaaacatgcatgttgctaagctgacacgcggtggacaagaatgaccgatttgtgaccggtctggcactgctcatgttgtcagcgcacggccacgttcccacgacgcgcctgcccccggcaggagtggaggtaggtgtgggctgtcccatcagaagggctcccggatggaaaccgtactgatctccgcccattaaagagaaaaagaacagtccagtttggaaagagaaaggtgcatgtggtatccccttgagatataaaaggaggaccttgcccatttagagaggagacttcttcccttttgaaaggctgagaggggaaaggaagttaatcttttgtaacttgtccatacacaaatccacaaaaacacaggagtagggtattacgcttggcagcggcccgaacctgtatacatcgccgtgtctcgtgtgtcttgcggacgggtgatctttccacatacagagagagagagagagagcttgggattgcaccctaagcccctggtcgaaccggcaaaggggggcttgcgcagtctcccggtgaggggccacgagctccgtcatagtgagatgcatgcaatgaaagatgctagtcagttgggtcccacaagaaaaagaaatacatctcgggattaactgctagcttactctagttaatatggacatggatggagccggcagccagcaatactattgaacctgcttaagagcaagtgcaatagtaggctatataccagctataaacatactttaaagagataaaggaagagagagaggaacaacagattacatatctgtagtcagctgcagcacggattacaagacgtaatatgtgtataacatgtgagaccagatattaatagtatagtaagcaactattgtatgaactaggaaggaagcccgcgcagatgcgcaggcatctaatttattgttttatgatttatgaaataatgctaaaagatgtcatgtctcatcttttttatgctgtgagataaactgactttaatatacttagtaaatgataagaatgtctccaagattaaaagaaaatcagtctgtcccgattacttataaattctcctattgtcaccacaacttattattattgttttaaaagttatgatctataaatagataaaactggatatgtaccaataaaataagcctaatacatcattgatacactaaaatattcactacttatctaagtgttcatgtttcacttatttccgaatcaatatataaatattttaaaaataccacttataccaattaatgaaataacaccgttaaagataaacatgaatgcccctctaacgggtgaagcccatcgtagccaccaagactttctttctctgttgagttttctaaaaaaaacgaaaataaaatttttgataaattaatccaaaaaattaaaactaaattggatttacttaaaaaatagactaaattgttttttatcattttttacatttgtagatttaaattagtgttgtatatttatcaagtgatattagaaatcctaaaatataatgtgaaactatttgaaaattaccacaacattaattattatatgttggtcccatgtgtcatgatgtatttaggaccataatataccttttataagacataagtatttcatttaattaaagcatgaaactaatcacaaattgaatataattgttgcttactatactattaatatatggtcccacctgtcatacgcatattgcgtcttgtagtccgtgctgcagctggctacaaatctgtagcccgctgctcttctctctcatcgtttatctcattaaaatatatttgtagctggctaatagcttgctattttacttgctctaagataacagtcctaccaatttaaataaaaattaatgatgagattagacaaagtcacagggtggcctacaagagttggtagaaatggcacataagataaaatatgatatagtagtaaaaatatagctaatatagctcaggaattggtgatttaattaaaaaaacctacagctgctaaagtgtatgcgtagatcgtctataaaaataattgtttatttacaacaccagatcacttctattgtaaattcctagcgtttgcgcattcacactaagattactctctatgaaaaaactgatctaataatttatgataataaattatgatgtacatgtatcatgtaatttgaaaaaagaagaaaaaaaggagaattaggatctggatggcatcaatcgagctcgccgaggcagatcagtctccatggaaatgataacaaattatgatgcacatgtattgtgtaattagaaaaaaaaggagagagggagaatccagatatggatggcatcaagctaacagaagcataagtatgtacgtacgtacttatgggcggaaaatctaatgggcgatcaatcgctaccgcgatctggtagcgatcgcatcccctcccccctccctccttccacgtttccttttctggcaccgcattacttttctattttagtaaaatttatgcacctaaagtttatacacctaaagtttatagacccaaagtttagagacccaaagtttataaatcaaaagtttatatatccgattcaaatttaaatttgaattcaaatattttttatatatagtatttatatacatctaaagtttatacacctaaagtttatagacccaaagtttataaatcaaaagtttatataccctattcaaatttgaatttgaaatatattcgattcaaaatttgaatttgaattcaaatattttttatatatagtatttagatacatctaaagtttatacacctaaagtttatagacccaaagtttagagacccaaagtttacatacccaattcaaatttgaatttgaattgtatccgattcaaatttaaatttgaattcaaatatttttatatatagtatttctatacatctaaagtttatacacctaaagtttatagaccgaaagtttttagtaaaaagtttatatacccgattcaaatttgaatttgaattcaaatattagtttatagatccaaagtttataagtcaaaaatttacataaccgtttcaattctgaatttaaatttaaatatttatggtgtagtaggaagagaaaaaggaaaggaggaaggggggagaggagggagcgactggataggaggggcgggtgatcgcctgaggggcgggagctatcacccgcccatcaggcgtacccacttatgggtccggagagaaagggtgagaaagatttagttttgatccaacggttaatattattgggtccaccactttaaataaaaacttacggtcagatatttttctttttctcagaatattatttaaattattagagcgccatgtggcgacttaggagcgtttatatataggagtctcacgtggtagcttgagagcgtacgtagaaagtttaatgaacttttagtatataaataatagatagatagatttaggattttctctaatttgctagaacgccacgtggtggcctaggatcgttattggtccaaataatatgtaattacttatttatataaataatatgtaatttagaagtatacttattcaatatgtattgttgcagaacatagtaaagagaggaaggggaggaaaagaaacggagaggaggtactcatacatgacgcacggcaggattccttctttgttttttagaaagtaagagaataaaccaatctaatctaacggcttggagtaacgggcccactaattttaatgaaaattaatggctagatgttttgctttttttatagaatttctagtacacgtggcgtcgtaggagcgtttgtaggaagtttaatggacttttagtatataatagaagatagataatagatagatagatagatagatagatagatagatagatagatagttacatactacactattaatatctagccccacctgtcatagacacactgcgtcttggagtccgtgctacagctgtctacaaatctgtagcccgctgctcttctttctcctgatttatctccttaaaatatgtttgcagctggcttgtagtctgctattgtacctgctcttatacaggcaataatcactgccactaaatacagacaactatatttcttcatttataactgtatactgctttctaataataaaaatatattacattgccgacctctgcctgccacacgattaggcttgcaggccctacgtcatgttatttgtaattgatacagtttttgtatttatcaatccgtctcaacaagattgatcgattaggtggacattaattgatttattcaacgactaatcgatcttgctttgcagcagcatttcacttgctcattgcagtaggcgcctttccagtctaccaaattaccatagtatttgaggcagtaggctccacacattctcacttggcatgcccggagacccgtatagaaacacacatctgtactctctacaaaataaacaacaaactctgtataaaatgccatgattttttttgtaagtggtacccacaagttaagcgcatctacaatcattaatttctagtgatgccatgcttacagtaggtactaaagaaaaacaaatttgtagtaactaccacaacttcaaaaatcttcgcttataaaatcttcaatctgtttggcacaactctgtatattggccttgttcggcacaactctaatttattttttttaagctaggtatttctaaatgtagaaattctgtgcttatgttggtaatatttaaataaatcattttatttatattttagaggaaattaaatattttaaacaattgtagtttaacatatatacaaactttaaatttgacatggatctaagatttggagcaatgtttaaatttgtagcaaacattgtagagaggaaattaaatctaaccgtccgctttgcaggatgagagagcgacagccaagatcacaaaagccaccaagcagccgagggccattgtgttatttttcttggaaatgattgccatcacaagatcaggctacagtgttttgttctcccgatgatttgataagctacttctacgaccttcactgttgccggtgttcatataggggtacaataacccaccataaatgacatatattaatgcaaacattatcttactcatatcccttgcatttatgctgagcaatttattagctgtttattttataagatttgatgttttgggccgacacgtacaccttaccggctgggctcaaattggtccaaataattcggcccacggttagattgtaggtgtgaacatttgacattttttttttgcggggaaacatttgacatatttatcagagctgtcagtgcttccgtgactaatacttgctaatcgagcttatcaacaaataatataaagtcctggttcgttctcctgatttattgttcactcttaattactttctctagctatgagtgagttaaattttataaaacatgtaatccataggtttacactttgatcgttaatacatatttgaatagttcgcttcatgaaaatggtaataaaagacatcttttaaaatatatagatttgaaatattattacgtactttgctatcttttcttatatattttctattaaaagtcaataatgaagtcgctaccgacttatggaggaagagagaaggggtggagagtgggaggagggcctagtcatctctcggccagccagcgaggtcagacggtggtgcactaaggcgggggacttgatcgcgcgaagaaaacaactagttactgtggggataaggagttgggggaagaataaaaggataagcgggttgcaggaatcttgaaggcatcctcgccgtccaaatttgattgtttttatttatttatttttttcatttctatggaactaaaaagagaagacacagtccctatcaggttttatcgtacttgaacaggctagagatcgatcaaataagagtttatttgtgtacatggccagtgccaactccatggccaaggcgagttccacagcagcattgatcagaatcgctgtcgcaattgcctccttcattatgattggcttgacagagactcgtggtgcagcctcgtaggtatgtgcatgtatcctttactccctccgtttcgaaatatttgacaccgttgactttttagcacatgtttgaccgtttgtcttattcaaaaacttttgtgaaatatgtaaaattatatacctacataaaaatatatttaacaatgaatcaaatgataggaaaagaattaataattacttaaattttttgaataagacgaacggtcaaacatgtttaaaaaagtcaacggcgtcaaatatttcgaaacagagggagtatttcgtatgcacctgtgtacagaatggttagacccatgatcagatgcttgattttgattcatccattggccattgcaaaacgaagaaaattaattaagctgttatattcagcatggtgatggagaaattgaagatgtatatatatgtgtgtaccttgggctgcatgagaggatgagaaagcaatagccatcaccataagagctgccaagaacaccacagccttactattatccttgccaagaagtgccatgatagggagatcttttcagaagggaagggcgcagctgtattattgttgtttacctagctatccccttggtttgataggtgtttatatagccacaaaggcaaatcttggatgatacatcattagtttcctccattattatgcgacgcgacatcgacatttcttgatcgacgtggagacggaggagtgggagcaggtcgacgacaagagccttccgagggccgggccatgcatcccatcggtgagaagagaacaacctgatatcttcgtctcccactgcatcaacaagtcaagtcgtcgtcggcacagggcaatgtcagcatcgatcgaggagctgtctgttgtcctcaagatgccaacggtataaattctcggccggggtcttggggatatggcaccttctgcagagatgcttcctccggttgacagccaggaaaaatccgtcgtaaatatctgcacacccttacagcagcaccgcacggttttcttttacgaatttatattagtatactatataagtataatattactactcgatctgattggtccatttaaacaagctagtacatataatggagataaatttttcggtactacctcgaattcaggtacttaatgtagctgctagtatctggtagtatcaaactttacactacaaaatttcacacctccccatactttctcaaagataataaaattacactatcaggaaaccttgggagctttctttgccactcgatcaataaaacacaagcaatgcgtgattgttcttccttgaatatatataagtttttagatgtagtgcaatgcgatagactcaattttatgtgtgtacaagcaaactgcccgtagactcgtacgttttaacaagattttaattaatgaaaattatgaatatgctattaccattatttcttattcattatctcctaatcatatatatttgttattgatatgttggccgtttggcccacatatatcctttcttaattcgttccaaaatgttacttagcaagttgatgccttggtggtgggagtggtgacaaattcacccctcaccactgccactacttatctctttttaagtgtagacagctggtttcgtattttgggtgggtcggccatgcacggcactcgattataacagatggaatgtccagatgtggaagactaggacatgtgcaaatgggacatcagatgctcccaggtgagtttctgtcagaggaaccaatatattgtgtccattccttccactgtccttacatgttagtccctggaaatttgaagtctttgattacgcaggctgtgtagcactagttccggctttaaaaacatcctatttaaaacatgttttgaatcaaattttaaaaacctaaaaccctgatactcttcattccaaatctttctgcatgccacacccgatcccattcacagattcaagcaaatcaagcgagagagagagagagagagagagatgcacaaattcatacacacaacagattccattcacagattcaaaaagagagcaacaacatcgatcaaggcactgctcaagctgccattgtggcgttgtcgctgtcgccgagccaccgaggcacccctccctagttccaagcaccgccaccagatctggatctagagtggtgggccagcaccaccaccaccttagggctttctctcctctgccgtcaccagccctaccatttgccaccattggtagatctaagagcatatccaacagactctccaggctaaaatttagccaatttgacaaaaaaaaaagctctccaacagccttgccaaccgaatggccaaactagggcatcctgcctggctgaccaaaccaggttgccaaccatgggtcccacgctgctagacacccctcttcccctttatctcttcgcacctatcctaaacccaaacagaggagtgccaccactatctttgtcgtcaaggtcgccatcgccattcgccgctgctgccaaggtagtcattgccggatgccgctgtcatcgtctgcgccgtcactagctgccaccgccgtcgccatctgctactgtgccgaggtcgccatctgctactatgccgaattcgatggggtgcgcgacgcccgccctgtggatttggccatgtgttcggcaccgtctcctcgtgtttgtctccgttccccctgctctgcgtccgttgtcttccctgtcaataccgtccctagcgccaccggctgccgttagtaggatcgaatcacaagaactaagccaaccagagggagggtgaatggttggtatacccaaaaaccgaaaacttttagcggaaataaaagttaccctcgaaatcgatggaaaccggtctgaccgagattgatctgtcagtctgaccgagtggatgccgccggtctgacatgtgttgaatctccggtctaaccgccgaagtcgcctgccgcgcctgttgccgccgccggtctgaccgccgcaatgccgtcggtctgaccgccggtgagttgccggttagaccgccgaaacccggtgaaacacaaatcgaagaactcttaaagtgaatgacgactttattacttctctctgtgtttacaaagtgcaccaacaacactccttacaaaaatttcgactaaactcgaaaccctaactcaaaaaactcaactcaattgctctctaaagcgataccgggaagcctcatgctccccctctatttatacccgaggtaggcagcctaaagccacgaaccaaactcatattaggagtcctaaacaccttaggaaaccctctagtacaagaaagaaactttacatcaccaatcgtaccaaatttggactctttccaaattcgactccgcatcccatacgcacacaataactccatcgtatgccatatggaaactccatcaatccacgtgcatcaactctagccatagtatctcgcatgatctctgaccaccacgaatgtcatcttatccccaagccgactcccggtccatcaccgcaaatactctcccagacatcgagtcacctacacatggaacaaacaaagaaaccatattccgagaccaagctatctccaacttgactcattagcagcaaacaatagtattacatatgtatagtatccatctagaagtcataatcatgaaataaactcggatatccaaacaaacaacccgaaaccgaaaccgacacagtgtcggccggtcagaccgcgggctggccggtccgaccgctcgatcactgccggtctgaccggcatgcacagcccggtctgaccggtcacataaaataatgaatcctgcgatcacctatgaaaccaatcatctccaaaaccacttcgtgaataaattccaaataacaaaaccaataatctccaatgcccaattgtacatcacagaataataatcaaaaacacctttgattttacaatctcccccttgatgaacacattggcaaaccctttaaaaatgttttggtgtttggaaaaataaaaacaaaagtggtaaaaagcacacttcgtacaaatgtacacatcgtgctcaaaaattcaaaagaaaacttctccccctttttaaaagaaagaaattcccaattgaaccaaaaacatgctcttctcaacaactctccaaaaattcatcttgcttctccaaaatatccaaaaaagttcacattacttccccttttgacaatgatttcatcaagcgcttaatattcaagagcttagcatacatatagcataccaagtcatgtgttgcaataaaaagaagatgaacccatctataacagaacaagcatgcattagagtataaccatgaaccaaagattttacaattaagcttgaatcaacaatcaaaattcatgatttcatacgatttataatgcaacatcttaacaagcacataggttgaagaataaacactaaacacatatacctatggcatttatcactctttctcaaataaacctttagcccaaaataaccaagaaaatttttttaactttttcttttcttgagcctttttgctcataatttttctcttttattccgagtacgtccctgtcgtcaagactgtttccagggattcggcacccattattttgctcacatcgaatacgtccttgtcttcaagactgtttccaaggattcggtattcatttttttcatatttttattctctttttcacaatgagcaattaaagctatttgaggaataacatgtcaataaagcatatatatagggcatttaaaaatcaaaccatatgctagcatcaacattgcatatttgcttaattcaagtagaatttaagtgtcatgcatcatctcccttaaaagcaaaatctaaatctcatgaaaagactagaatacatacaagctatgctagagacaaataaaccttcaaagtattgcgagcatgcacaagaaaataccatatgcataaacaaaactctcttttctcaatttttctcattgtcatattgttgcttgataaaaccatgaggtacaaactccccctcaaaccatgccaaaaggatgaattatgcccaattcaccacgaagaaaagcaaagcgattagaatccaaaggtttagtgaaaatatcagcaatttgcaaatttgtgtccaaaaactgcaattcaacatctcccttctcaacatgatccctcaaaaagtgaaaacgaatatcaatgtgctttgtgcgtgagtgttgtacaggattcttagcaatattgatagcactagtattatcacaaaagagatgtactttctcaaaagtaagaccataatcattcaaagtagataaaagccaaagcatctgtgacagcgacgatcagcagccacatatgtagatccagcagttgcttgagcaccctgagattgtttcctagaagaccatgcaatcaatgatgtaccaagaaaatgacatgttccactagtacttttcctatcaattctacaaccaccaaaatcagcatcggaatatccactcaagcatatagaagatgaagtagaataccaaattccaaactcaagtgtatgattcaaatacctcattattcgcttgaccgcttgacgatgtgaagcacgaggagaagcttgaaagcgtgcacgcaaacacacagcaaactgtatgtctggcctagaagcagttagatacaacaaagatccaatcatacttctatattccttttgatcaacagctttaccatcttcatcaggatccaacacagctgtagaaccaattggtgttgaaattggcttgcaattctccatcttgaaccgtctcaaaagatccttggtatacttcgtttgatgcacaaaagtaccttgaggtgtttgcttaatttgcaatcccaaaaagtacgataactcacccatcatgctcatttcaaattccctgcgcatagtctcagcaaaatctacaaccaaagcgtgaattgaacaaccaaagatgatatcatccacataaatctgaacgaacagttgattatcaccatgcttaagaacaaaaagcgttttgtcaaactttcccattgtaaaacctttcgcaagcaaaaagttcttaagtctatcataccatgccctaggagcttgtttcaaaccataaaaagctttagacaatttaaaaacatggttgggaaaatcaggattttcaaaacctggtggttgtttgatataaacttcctcctgtataaaaccatttagaaaagcacttttcacatccatttgatacaatttaaaaccttttgaagcagcaaaagccaacaaatgtctaattgcctcaattctagcaacaggagcaaaagtttcatcaaaatccaaaccctcaacttgagtaaaaccttgagcaacaagtctagctttatttctcacaatcaaaccatcctcattttgtttatttttgaaaacccacttggttccaataatattatgtccaaactttgtttcaactaaagtccaaactttgtttctctcaaaattttcaagttcttcatgcatggcgttaatccacgattcatcagttaatgcatgtgacacatctttggattcaaaagaagcaacaaatgcagaatttgcacaaacatcatgagtcgttaccttagatcttgtagtccgctcacctatattaccaataatttgttccggtggatgtcgtcgttgaatgtgcaaaggagtagtgacgtctgaagttgatccacgttctgtaccagtactggttgaagttgaagtctttggaggtccatctcgatcagcatcaacagtaccagaactcgacgaacctggccggtctgaccgctcctcctgaaccggtctgaccggaggtgtgccagcggtctgaccggcctggcgcccggtctgaccagccgagccgacctcatcatcgtcgtcgtagtatctcttgtcttcaaaaatacgaccatcctccccctgaacctgtgacagtgtacctgcaatatcgggtctagtacctggactagcctcattaaaagaaacttcgcaagtcgcaagtctcgatcactgccggtctgaccagcatgcacagcccggtctgaccggtcacataaaataataaatcctgcgatcacctgtgaaaccaatcatctccaaaaccactttgtgaataaatttcaaataacaaaaccaataatctccaatgcccaattgttcatcacagaataataatcaaaaacacctttgattttacaccgttgtgtcgtcctgcgtccctaccgccgcctcccgtcgccggctagtccatagccctagtgggaaatgagaagaggtgtaagggaagaaagagaaggtgctagtagaggctgacatgtggctccctttgttattttggagatggtaatagagattgttggagtgagaatctagtttgactacccaaatcagttggcaagttggctatatgggtatttggagagtctaatttggataagttgttggagatgctctaaggtgatagagggcaggataggtgagggacgttcttagaaagagaacttactcaccgccctctcatcccatcatcacccccaaatccatccacctcctccaccgccactgcctctagagagagggaggcctcccatggcccctcccaataggggtgggcacaaaaaaacaagaccgaagaccgataccgaaaaaaccgagaccgagaccaaagaaaccgatctatcggtcatcggtctcctgatcggtcatgtgttccaaaagaccgatcttttttttcaggcttctgtattattcctcggttacccgatcagaccgatcttggtcttgggccaatactatcagcccacctactcaacgagaggttgagcccaacaagtctaccacaatagtccatttatcttcttttgcatgtattatatctaataatatatattatttatttattgtgagtagttaaacgtgcacgcaaacaaatatagaacaattcaactctgtactgcacggaattatcaaaatcctagaaataacaaaatcgtgtaagtaggtaaaagtagcaactatattttacccaatcaactcaaattgaaatataaaagttatagccaacatgcatgacataattgtgcatgacataattgtcgaaacatgaattcggcaataataaaagggggtaacgcacgagacctaaaagtggatggatgcggagacaaaggatttagacaggttcaggccctctcaatgagaggtaataccctactcctgtttgacgatcaggttgtctcatgccccctagagggcctcctgcccaccttatatagggtggggggcaggattacaagatagaaaccttaaccaatacggtatcggtttcctaaatctactttacaatattatcaaaccaggactttaggccggtccgtaacatacaaggaaacgtaatacccaagtcatgatctgttacatattccatagatataagttatcccctatagccagtcggataactatgccatgtgggtatggggtacccataatctgcacagtagcccctgagaccttcacagtcgaaaagataatcttctctcgaactagattactccaaagctgagtgcttcaatcatcttcgccatggtctccgaagtacttttaccaaatatgaagactgtggagggctgaaaaataaagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgaccgctttgtaaaatatgatgagtgtaacctaaagttggttacatcattgaaaattcacatagcaaaacagctataaagaagcttgtatgttgtgaataaataaatttccaaagtattgggcatacgctatgcgcacactgctttaacagacgtgctttagtccctaaaagacacatggtttcaccacagctggaaatatatggcatatgtggtgtaaaatccgagtgaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattggacacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtaatatagaccaagtgtagctcatatgaatagcttctgatctgaatgattatcccttatgggatactccaaagtaggtgtaacaattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcgtagtcacaatcgtccattgatggtagctgacgcagttggcatatagacaagacgaccaatatagagataatattgcccaccagaggtggcaacaatactggtggtagtgaagatagtgataccaatctaaagtaatgaagtcgcatagccatggaggcgaagaaaccagtcggcggcagacagatcaactaacaatgaagatgaaggaacccagcgataaaattgtgtagccatggcagcaaaataatcagtcggtgacagacgaggtagatcaaaggtgatgacaaaatccaccaatcatgaagatgaagaaaataattgacgacgacaaacgcaaccgacatgatgaagaagacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatccatcaaattaatgttatagctgttgtagatgcttcacttggaggagagttgatgttgttgtccaactcgttcaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgtgaagtagcagcaatagagtttgctggttccgaagataataaagatgaagtcgctccaccatgatgacaaagttgtgttgccatgatgaagtgaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaacacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcagcataataggccagccgtgcaggcggaaacaccaatcggcggcggtcgaggcggctggtcggtgaagacgtagacgcccaacaacggcggcataataggccagccgtgcaagcggaaaacaccaatcggcggcggtcgaggcggctggtcggtgaagacgtagacgcccaacaacggcggcataataggccagccgtgcaagcggaaacaccaatcggcggcggtcgaggcggccggtcggtgaagacgtagacgcccaacaacggcggcataaaggccagccgtgcaggcggaaacaccagtcggcagcggcgaagacaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacactagtcggcggcggtcgaggtaagccggtggtgatgttctgactgatccattcctggagcgtaagagataagcttaaagccatgaatcccttttatgcatatctggatctggattctgcagaacaaacatataggatgagtagtatctgatataaatataatactcgagaaaaaatcaagtattttaaaatatttataaatatgtatttctcctcttgtcaattttgatttccccgagcagataattcattacgtttaaacgctctgtccgactagtcatagcccccaagcaccgggagtcggcctaggcacttcccagacatgcatatgagtgacatgagttcgccattaatggaacaaagtttcacgaatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacgacgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtgaaaccaagccagtggtgtagatgatgaagcccattaacggcggcgaagtccaccaaccgtataggcgaaaacaccagtcagtggcggcagaggcaggccggcggtgaagtcgtagacgcccaacagcggcggcataataggccagccgtgtaggcggaggcaccactcggcggcgacggaggcaggccggcggtgaagtcgtagacgcccaacagcagcggcataataggccagccgtgtaggcggaggcaccactcggcggcgacggaggcaggccggcggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtagacggaggatccactcggcggcgacggagacaggccggcggtgaagacgtagacgcccaacagcagcggaataataggccagccgtgtaggcggaggcaccagtcggcggcgacggaggcaggccggtggtgaagacgtagacgcccaacaacggtggtgtgaccaaccaaccatataggcggaggcaccagtcggcggcgaagtcgtagacgcccaacagcagcggcataataggccagccgtgtaggcggaggcaccagtcggcggcgacggaggcaggccggtggtgaagacgtagacgcccaaaaacggtggtgtgaccaaccaaccatataggccagccgtgtagacggaggcaccaatcggcggcgacggaggcaggccggcggtgaagacgtagacgcccaacagcagcggcataataggccagccgtgtaggcggaggcaccactcggcggcgacggaggcaagccggcggtgaagtcgtagacgcccaacagcagcggcataataggccagccgtgtaggcggaggcaccactcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtgtaggcggggacaccagtcggcggcgacggaggcaggccggcggtgtagatgacgatgcccatcaacggtggtgtgaccaaccgaccgtataggcgaggacaccagtcggcggtgacggaggcaggccggtggtgaagtcgtagacgcccaacagcggcggcataatagaccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagcgaaaactcccaaagcgaaagcgaagtcggcgactcatgaaattgattccatcgcgctcgttgataggaaactcgacgcaatccctacctggcgcgccaactgtcgaaacatgaattcggcaataataaaagggggtaacgcacgagacctaaaagtggatggatgcggagacaaaggatttagacaggttcaggccctctcaatgagaggtaataccctactcctgtttggggatttgaatccgccgagtgtgtattgatctgacgatcaggttgtctcataccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgtaatacccaagtcatgatctgttacatattccatagatataagttatcccctatagccagtcggataactatgccatgtgggtatggggtacccataatctccacaataatataaatggttcacacattataatcagggtttagatggagaaaacaaacagatagagtaatgggccggtctttttgttcgttccttcctgttgtttccttttcttttcctttatttttttcttttctttttttttatatggtaaggctataatggtcatttcatttgtattgttgcatgcaagaataacttggcatgctcatgtggcattttttgtgggtccaaggactatattaacccaaatgattaatttggaggacttatttggacgttttgaaaccttaaggactaaattaagcccgaagcgaaactttagataccgtattagctattctcccaaaaataaaagggggaagttgtgctctcaatgctacatcacgaacacactgtatgtagtgcctaacatggcctggctacttcttccaccattcaacagcattcgtcttctcatgcttgtactgccacttaccataccatatgcttctggttccatcccgcgtgacggtggtagcagcagcaatggcaccggcgacgacctgtccgcgctgctggctttcaaagcgcggctgtccgatcctctcggagtccttgccggcaactggacaaccaaggtgtccatgtgccgctgggtcggcgtgtcgtgcagccggcggcggccgcgggtcgtcgggttgaagctgtgggacgttcctctgcaaggagagctcacgcctcacctcggtaacctctctttcctccgtgtcctcaacctcggtggcataaacctcactggccccatcccagctgatcttgggaggctgcatcgtcttaggattctccgtcttgcccacaatactatgtcagatactattccctctgcactagggaaccttacaaagcttgagattctaaatctctatggcaaccacatctcagggcacataccagccgagctgcaaaatctacatagccttaggcaaatggttctcacgagcaattacctgagtggtccggtaccagagtatctattcaacgccacacaccttgggtaaccgagatacacctcgggctgaatagtttgtcaggttccataccagactgtgttggctccttgcccatgcttcgtgttcttgcgttgccagacaatcagctctctggtccagtgcctcctgccattttcaacatgtctagccttgaagccatacttatatggaagaacaatctgactggccctatacctactaaccggagctttaatctccctatgttgcaagacatagaactagacacgaataaattcacaggactaatcccgtcagggcttgcttcatgccagaatcttgagacaatttctctgtcagaaaatcttttttcaggtgtcgtgccgccatggctggctaagatgtcacgtctcactttactctttttggatggcaatgagctcgttggtacaatcccgagtctgttgggaaatctccccatgctcagtgagcttgacctctcagactccaacctaagcggccacattccggtggagctgggaacactgacaaaacttacgtatctcgatctttcatttaaccagctcaacggcgcctttccagcttttgttggaaacttctctgaattgacattcttgggattgggatataaccagctgacagggcctgtaccatcaacgtttggaaacatcaggcctctcgttgaaattaaaattggaggcaatcacctccaaggggatctcagcttcctgtctagcctttgtaactgtcgccaacttcagtacctcttgatatcacataactctttcaccgggtctctcccaaactatgttggaaacctctcaactgaactcttaggattcgaaggagacgacaaccacttaactggtggccttccagctacactgtcaaaccttactaatctgcgagcgctaaatttgtcatacaaccaactcagtgattccataccagcttccctcatgaagttggagaatttgcagggacttgatcttacctcgaatggaatatctggtcctatcactgaagagattggtacggcaagatttgtatggttgtacctgaccgataataagctctcaggttccatacctgatagcattggtaatctcaccatgctacaatacatttctctatctgataacaagttgtcatcgactatcccaacaagtttattttatcttggtatcgtgcagctctttctctccaataataacctcaatggtacattaccatctgatctcagccacatccaagatatgtttgccctagatacttcagacaatttattagttggtcagctcccaaattcatttggataccatcagatgttagcctacctaaacctgtctcacaactcattcacagattcaatcccgaactctattagccatctgaccagcttagaagtattggacctttcttataacaatctttcaggcactatacctaagtacttagcaaactttacctacctcactactctgaacctctcttctaacaacctaaaaggcgaaataccaaatggtggtgttttctcaaatataaccttgatatctttgatgggcaatgctgccttgtgtggtcttcctcgtctaggatttttaccatgcctagacaagtcacactcaactaatggtagccactacctgaagtttatactccctgccatcacaatagcagttggcgcacttgctctttgtttgtaccaaatgactagaaagaagattaaaaggaagctagatactactacacctacttcttataggttagtatcatatcaagagattgttcgtgccacggaaagtttcaatgaggataatatgttgggagctggaagttttggcaaggtttacaagggtcatttggatgatggaatggtggttgcggttaaagttctaaacatgcaggtagaacaagctatgagaagctttgatgttgagtgccaggttctacgcatggttcagcatcgcaacttgataaggatactaaacatatgctccaacacagacttcagagcactgctgcttcagtacatgcccaatggcagcttggagacatacctgcacaagcaagggcaccctccactaggattcctaaagagacttgacattatgctggacgtatcaatggcaatggagcaccttcactatcatcattctgaagttgttttgcactgtgacctcaagcctagcaatgtgctgtttgatgaggaaatcacggcacatgtggcggactttggcattgcaaaattactgttaggtgatgacaactctgcagtttcagccagcatgcccgggacaataggatacatggctccaggtacttgcacttactattcatgagaattttgctttaccatttgagttatgtaagagacttaatttagtttatctctttctttcttttaaaaatcattcattgaacagaatatgcatttatgggaaaagcatcacgaaagagcgatgtgttcagctatgggatcatgttgctcgaagtcttcaccgggaagaggcctacggatgccatgtttgttggtgacatgagccttaggaagtgggtttctgaagcatttccagccaggctcgcagatattgtggatggtaggcttctacaggctgaaacattaatagaacaaggtgttcgtcagaacaatgctacctccttgccgcgttctgctacctggccaaatgaaggccttcttttgccaattttcgagcttggcttgatgtgttgcagtagctcacctgcagaacggatgggaataagtgatgtggtcgtgaagctcaagagcatcaggaaggattatttctcttttacaggagcaatataaaattagcatttgagtgcattttgtttatctattatatgtggacactatctcactagctactagccacaattattctcaagtaagactcattcgagcctaaagtactgtatcgacatataaatgaagagaatttttaccgtccagcaggtggaggcggtaccaaatgcgtccaatgggacagatctaatggctgaaaatcgtcggtatcgtgaggtaccgtaaatcctgtgcgatggtacctcttctctgtctgcatgaattgagcaggtggaagggtagaaccggattttcaacttaaatttggagttgattttgagggtttttttatcgtagtttatttttcagtctttgcttttacatcgctatgacacacatataaataaaagttttatttataaattatttttcgtttgcaaatatatcgtttcgcttattcgaaacgatggtcctgagtttttttcgaatgtgaaactagattactttctactacaaataaagagcatcttagttttttttcgaaaactatactttgatctaatttctttgtaatgttatcaataactacaaaattagtataacatgaaagtatataatgatatgatatgcatgacagtaagcatataaaataaactagaagtagaataaaaaaaccgtttgttcgtcccacttgcatcagtacttctcgtagtaatattgatttgttaccttaacttaggtggtgtttggatccagggagtaaactttaatccctgtcacattgaatgtttgaacactaatttgaagtattaaacatagactacttacaaaactaattacacagatagaggctaatttgcgagacgaatctattaagcctaattatgccatgatttgacaatatagtggtacaataaatgtgtgctaatcatggattaattagtcttaatagattcatctcgcaaattagtctctatctgtgtaattaatttttttaaataatctatgtttaatacttcaaattagtgttcaaacatccgatgtgatagggactaaattttagtctctagatccaaacaccacctaaggtacagagcatgtcgttttaaacacgcatgttttaagtcaaaccccgactgattgctaccttttcatatgtacatggaccaacactagaggagccaaggcatgccaacctcatcatcattaattaatttttgctactgagtgaatcggtacaattaagcatcaactgcaagagtttactatcgaatctctgcttcatcaatcaataataagattgccgttgattatacaaccgtcgttgttgatttggacaagagaaatctattatttgtgcgggcctcatcagtacagcagcagtggtcgttcgactcgccgtcgcacaggcctccgttgaaccccttgatttggcagtcactcatgcacttgttcatatcgcaatttacaaggaccatgcacgaatccatttctccatatccacctatatatatatatgcacatgtaaaatacatatttttagaggaaaaatcattatattgttaatgaccccgacttttacagagagccgaaatagttcatacagaaaatgtaaaatgcatatatacttgtcaggctatatatcagattattccagcatcattgatcactaatcatttcatgcaaaagagaacaaattaaactgtttttgcatttggatgtgatcaatcgagaggtgtatatatatatatatgtataccttgtgtagtatgaccggatgagaaatttacggtggccatcaccataagagatgtgaagaagaacactgctgcagccttcttgttgagaatttgcgccatgatgagatgagatgagaggagatccttttgacaaggaagctactgcatatgctggctactacctggcccctagcttcattttgcagctgtttatatagagtcacaagagcaaatcttggatgattcattagtaaattacctccattattatgcattaatgacgtgtgtgaggtttcattaatgaccgtttctcaaatttattgcatgagcatatcgtttcaattaattttgtttctatatcattttacctatgtcgtcgtttagtgtccacctctacaaaatattccattgttcaaacaggcctaaatgtacgttgagtcattcgaatgaaacaaaagcccattacaaacataggcccatgggctataaagcatgtcaggctaccagagaagtccacgacaaaggcccaatgtttacaagcaaaccacattcctttttcaggtcagaatattcctttttttttttgtttcagccagaaataagaaaatacaaggagcacatcatctactttcattttcatgatggaaatttattgaccagcagttcaatcacatttttacaccaactataaattgttgcagaacctgaagcaccatagatatattcaattcaaccgtaaacacatagaagcaaagggtaattgatcactgggtatacactgatgctacctaatacagaagaagaaatggatgcaaaggatatatatatttcattctctcatataccacgagagagcgatgaatcactgcgagaaatccccaggtccagatggctacaccgcccttttctaccaaaaatgttggggagtgatcaaagaggatcttcttgcagcactaaagaaattttgtgaagggaacacccaaaacctagaaatgctgaactcggcaataatcactctcatccccaaaaaagaggcccccacgttgttgaaggacttcaggccaatcagtctaatccacagtttctcaaagcttgcaaccaaaattatggcgcaaaggttggctccaaggatggaggagctagtgccacacacgcaaacggccttcataaaggggagatgcattcatgagaattttatttttgttaaaggtctatcgcaacaattccaccgccagcgcaaagagatgattttgttcaagttggatatttcaaaagcatttgatactgtctcctggtgctttcttctcgacatgttgaaattcagaggatttggccccctttggagatcttggctcgctgcgcttttcctgacagctgagacaagaattctaatcaatgggagtgaatctgacccaataaagcctgcaagaggtttgaggcaaggagacccgctatcgcctcttctcttcgtcttagttatggacacgcttcaggcaatgatggcgaaagcaagggcaagaaatctgttatctgagctgaatgctagaaaaagattgcccaacatatctgtatatgcagatgatgctgtcctcttcttccgtccaattcaacaggaagcacaggtgatcagcagaatcctagaagtgttcggggcgacaacagggttgaaaacaaatctcgctaaatgcacaatcacacccatccaatgtaacgtacagcagctggaggtagtaacagaaatcctgcaatgtagagttgagcacttccccataacatacttgggcctgcccctcgccatgaggaagccaaccaaggcagaaatccaaccaatccttgacagattggcgaagaagattgctggctggaaaccccggttgctatcacctgacggccggctttgcctcatcaaatccactctaatggccctccctgtgcatctcatgtcagtgttacagctacctaaatgggcgatcaaagatattgagcgcaagtgtagaggttttctctggaaagggcaggaggatgtaagtggaggccattgtctagttgcttggaaaaatgtatgtatgccggttcaaaatggtggtcttgggataaaaaatctggattactttggccaggcccttcggctgaagtggcatgctattaaacttgaacagaaaaacaggccgtggacaatggttgattaccaactaggaaaggaggtggatactctgtttcaatctgcagcagagttcattgttggtaatgggaagaacaccaggttctggacagcaaattggctgggtggggggagcatcgcctggagatggcctattctagcaacttatgtaggcagatcacatctcacagttgctcaagctctatcgaatcacagatgggtcagagatttgcaaggctccctttccaacgaagctatggcccaatatttccagctctgggatgaaattcagagatttcacctaagtcacgaagaagacacaatccgatggaaattatccaccaatggtcatttcagctgctcctcagcctacagtgtattcttcttggcaaaagaactctgcccaatcagcgaattaatctggcaagcgaaggcaccggcaagaatacgtttcttcatgtagctggccgtaaaaggacgttgtctgacagctgataatcttgaaaaaaggggatggcctcacgctgattgctgtactttgtgccaacgagaacctgaaaactgcttacatctgtttatcaactgcgactataccatcacagtgtggagacagatgcggcaatggatcagtgcttacttccccatccctgggagcgaaaacacatgcctgacagagtggtggttgcaggccagaacatgttttcggaagtgctacaggacaaacttcgacagcgcttgtatgctgatttgctggcagatttggaaggaaagaaatgcgcgtgttttcgaccaaagatcgagaagccctaaccagttagcagaggctatcaaagaagagatcttagtgtggaaagaagcaggctatttcgcgaattgcagttcttagttttctttctgttgtgttgacgtttccagttctttagtttgccgggctgtggttcctgccacagtctaattcgacagcctcctgtcgttgcaagcgagaactacttgtatttgattttttttccctcccaatcttaatgaaatttggtcgccggttccttcggccgacccggcaaaaaatcactgctgcacaacgctcactgtggttgccatcaatttgacatagtccttcctaatcttcttcagtgtcacgaccacatcactcatcgccatcctttgctctggggagtgagccgaacagagcaaacccagctcgaacactggcacaaggaagccatgcatgttacttgaagaagaagaagaaccattctgtagaagttggcagtccaccacatggacaagctctgcaggaaacgcctgttgaacccactgcctgatgttcagttctcccacaaacatagcatctgtgggtcttttcgcagtgaacacttcaagcagcatgatgccgtaactgaacacatcactcttccgtgacgcttttcctagagtcccatactctgctcaagaaaaattagataccaaaaattagttgcaccctatctactcaataataataaaagatcgggcaaagtttgagaaagacaagaaaaactattaagtacctggtgccatgtacccaactgttcctggcatgctagctgagatcatggagttgtcatcacctaacaacaaccttgcaataccaaagtctgccacatgtgccgtcatatcatcgtcaaatagtacgttgctaggcttcaaatcgcagtgtaagaccacctcatagtgctcatgatgcaggtattccattgccattgacacatctagcataatatccaacctctcgagaaagcctaattgcttcccttgttctgagtgcaggagtgcttctaagctacccttgggcatgtactgaagtaccagtgctttaaagtccaggttggaacaagtgttcagaatctttatcaggttgcgatgtcgagccattcggagcacgtgacacttggtgtcaaagcttctcatggcatgttccagatgctggtgtataacttttatggcaaccaccataccgttgctcaattgtcccctaaaaacttttccaaagcttccgaagcccaacatgttatcatcactgaaatcatcggttgcacgaagctcatgataggagagcaattgatggctgataaggtcaggcttaccagcagaagtattttgatggttagctttctttctaatcattacatacaggcaacaagctacaactccaactacaatgattatagtaggtagcaagtattttagcatatgaccattatttctgttgggggaggtggtttggcatggtgggaatcctaaacgggcagcaccacatagccctgagttccccaccaagtattgtaaagtgatgtttgcaaagacacctccttccggtatttgaccatgtagtttgttgaaagataggttcaagctaacaagggtcgtaaaattagccaagtagtttgggatggtaccagaaatactgttatgggatatgtccaaagtttgcaagccagttaaattaccaaaagagtctggaacagaatcatagaatccgttagctgatagattcaggtgtgttaacatctgaagttgtcctgtcgaatatgggattctaccagaaaagtggttgtcagagagatccatgatggtaatttgcttcaaataccctacatcaaccggcagtgcaccactcaagaagtttcgagaaagatctagcctgacgattttatcaagatgaaataagcttggtggtatagttgacgttaatttgttatcagacaatagaaggtgctctagattagtgaggttcctcatgtcctttggtatggagccagaaatttcgttgctttcaaggaacagttttacaatgttccttagaagtgcagtactcgatgggatgaagccagacaagctatttccacttaggtcaagccattggagattctcaatcgtcatgattgattctggaattgcattgcgcagttggttatgtgaaagatctatcacctcaagagcagttaaatttgaaatggtagctggaagcgtgccagttaacttgttgttagataacgtgaaccatttcagctgtgacgacaggttcccaacatagtctgggaggattccggtgatataattcaggtccatttgaagggtagaaagctttctacaattggaaacagtagaaaggaagttgagatcgccgtgtagattgtttttagtaacatcaactgccgttagtgagttcatgctatcaactgtcgatagtaatgatccatccagcaagtttcctttcagtagcaggattgccaacgatgaaaggttgccaagagaagcaggaataggtcctgttagttgattcatcgcaagatgcaaccatgaaagttggcctaggtgcccaatatctgtagggatgtttcctgttaggttgcacgtcgtcaaatctaagactgtcagcatggtgaggttgctaagtttagttgggatggggccagcatcaaagttattcccacccaaggagatggcatcaagattggtcaacctgcccagccatggtggcaaaacaccctcgaataaattataaggcatggcaataacttggaggtatggacacgctgtgagccccagtggaatctgaccaaagaaattgtttttactgatggcgaaccatcgtagaactgggaggctgaaacttgtattaccagggatagggccagttaaaccattcgatataagagaaatggtacttaatttagacatgttgaagatggctggtggcaccgccccagttaagttattggcctgcaagttaaggtgttggaggattggcatggaaccgatgcaacccggtatcagtcctgacaggctattgttaccaacgttgagataagttagcaaaggcgtgttgttgaacagatcgtccggaatcgatccagtgagttaattgtgacagagattcatgctgtcaagactgtacagcccctgcagctctgccgggattggaccgtatagctggttaaactgtagattaagtagctaaagcctcgtgaggttccctatggcgattgggatgccacctgacatggcattgtggccgagatcaaggagctcgaggcgacgcagccttcctatttcgttgggcaccgagccagtgaggctggtgttggtgaggttgaggatgaagagaaaagaaatgttaccaaggtgagagctgagctctccttggagaggaacgtttggcagttccagggcggtgacgcgctgccggcgccggcggtggctactgcacgagacacgcacccaccggcagaacggcgttccggtggtccaattgccggcaaggatgttgttagaatcggagagctgggctttgaaggccagcaatgcagcgaggtcggtttcgctgccgttactcttgctcgcgatcggacctggagaggaagcacaaggcacagtactggacgaagcgatcaacaacgccgcaacgaaaatccatactggcaatcgaacaagcgccatgtctggttgtgtgtgatgcattggcagcaagagtatgcatcatacttcacagtgacgatcaagttgagctttgtttagcacagtagtgctagtttgctttcgacatgtaggacgaccttgactgttgctctcagaaagcgaaagaaacttaaatgatactccttccggtcataaatatttgacagcactactaggtaaacgctgaaaaataaagacatcacaaaatatatattcagcagatcgcggtgtgcacgacacgctagatatgatagctgtgtcgctccgtcatcagccatacgctcactgattttttttttctgtcaaacaatttgacggcaacggccttacgtactcttttgttgattgggtggttagatcggcaacgattgtatagttttagcaagtttaatagtatagcccgctactagctccaaatcatctatagctaacgtaatagataatctatctatctatctatctatctatctatcttctatctatctatctattatatactaaaagtccattaaacttcctacaaacactcctacgacgctacgtggcgttctaataaattagaaaaaatactagaaattctataaaaaaaagcaaaacatctagccattgattttcattaaaattagtgggcccgttactccaagccgttagattagattggtttattctcttactttctaaaaaacaaagaaggaatcctgccgtgcgtcatgtatgagtacctcctctccgtttcttttcctccccttcctctctttactatgttctgcaacaatacatattgaataagtatacttctaaattacatattatttatataaataagtaattacatattatttggaccaataacgatcctaggccaccacgtggcgttctagcaaattagagaaaatcctaaatctatctatctattatttatatactaaaagttcattaaactttctacgtacgctctcaagctaccacgtgagactcctatatataaacgctcctaagtcgccacatggcgctctaataatttaaataatattctgagaaaaagaaaaatatctgaccgtaaagtttatttaaagtggtgacccaatatattaaccg

SEQ ID NO: 72523 - DNA, 16316 bp, Oryza sativa
gatcctctagagtcgacctgcaggcatgctttaactggttaccttttgacatcactaccagggaactcccattatttgctccagcaagtgcacctatatagtagttcctttcccattggtccataatccattccttcaaatgaccagaaaaccatggaatcacatttgacaatgtatacaagagcttccttatatgtaactttgccttgaaaagttatgtgattagtttgctaagattttccaccagttaaacaaggagcaagctactcaccttgtgaagaaaatgtggtgaaagttcataaacctgggaagtgaacccagtgccagcatccatgattagagcccacagatttgagcaagatgttatgcaactgataaacagaccatcttcattccctttgtcaatgtgttgtacaagccttgaatctgcaacgttgtagtgatacctgcaaaatatagaacatgtatgttgcattgtactgcattaacaaaggtggatcatatagctaactataaactaaaactttcgggcctcataagaaaaagtacctttgtttcataggccgtctggcattataaacactaatccactgtgttgcaggcatacccatcctgatcttcttctttggttgttcatctgtctcttccatcaataagcgacctctcttttggccaactagatgtataagctttagagaaattacaaggaagattagtgcaaccaaagtcatgatttttaagcagtataacagattgcaatatatgattgtattgtaccttctgagcaccatcggtgttaattggcctgatatctggatttgggcccactacagtatcgaaaagggatatacactttgcatagttaggttcttcatcaaacttcaagttgaccacatactctacaaactccctaaagggttgtgggcaaaagcagcacaatgattctggagacgtagccattttctttttgcacacaaggaaacccttgttttcaccctgcaggcacacactatcaattatttaaatgtattactacaatcagaataaatggaatggtgggtccggcgaattacctgataaccttgccaaggtagacgcccccgtagaagaaaaactagtgtgtaagctagagattctaaatcatcccttcggctaccgattctccctagatgtgcatgaacactagcatagcgaactgtccccctgaaatagcagcaaaagcaaggcagagttactgatttgctataagcctacaacatgaagaatgagttggcattcaagacagaaattagggctctatttccatgcagaaacagccagtcaccaaacataatagtgaggagtgattgaccagcaccagtgccagccgcatttagtgctgttgagaagtaatgaataatggttgtacaggaacaagcagaatgcggggaaaaaaaagataaaacaaaatttaagtgaatgaaaataattgttggccagaaaccagtacaaagggtgacctgatttggctgcatcctaggactcaaccaaaaacaggaaacagaacctacgaaggaaatgccacagagcattcaatattatccataaaagcactagcgacaatgtaaatgatgcctattgattatcataaaatttccatctggtcacctgaaaacatcaggtcgctggtcatagtcaacgtggaggccagttgaagcatctctccacttggtagctgccatttaaagatagattaaactcaattaattcagactcctcaatctgctgctaccttaaaacaattgaatagacaatgatcgagcagttggttaatctgtgaagatttagttacctaaaccaagatcgacaaggaagagtctcttttcttcaggagttccaataggccctagcaagaaattttcaggtttcacatccccatgaacatatctgcgattgcaaaacattttctattacaacagaggaaataaaatgtattttggtggggaggggataataataattagagagatggcaaccaacccttttgaatgcattttctcaagtatggagatagcttcaatagcgatgcacgcaaccatctcaacagacattctgaaaaccaaaacaaactatgttagtgataaattagaagtctacataaatgttagctaaattggaaaactcacgtgtgagaattattattccaaacatcccaaagactgggtcccagcatatccataacctacatttttcataaaccaagttaattaaaattttggaaagggcaaaaagaaaacagtttctctcgtagtagtcaaaatgaggtgtcattactataacatagtattcgccttgacgtcctttatagtggactcgaggaaccccatgaatgccaccgatggcgctgtatatacgatggccatgataaaagtcaggtacctatatatagcatgcaacttgctatgcataatggcagatcatgaggcacatacttgtaaacctgccattcgtaaggaggcccatggttgcatcctttactggttctatgttcaaactttagcgccacctaccattcgaaagcacgatatttattttcaaccgttaataccatccacggttacaagtacagttttacaaataggctggcactaaatacctcagaagcacctggaccgttagctaacatgcggcggccaacatatacttggccaaatcctcctttaccaagctttttatcaactctatactttggtgaactgcccacctggacctgcacaaagccaaaacaaacagattagaaaaaaaaatcgttttgaataaatggagacaactgaagctaggatcttttgggatacaaacacgaaatggctaccgatcccaatcataactgtcgcttaacctctggctttacaagatgaaaacaatttagcttcgtggatgacgggtgaatctactgaataaatgttcaaaacggctaccaatcccaatcataaccgtgaaccgtcgctcaacctccggctttacaagatggaaacaaattagcttcacggctgacgggtgcatctacgtgttcggaacagctatcaatcccaaattcccaatcataacccttgcttagcctccggctttacaagatgaaaacaaattagcttcacggatgacgggtgcatctatagaataaatgttgtatgattgttgtatccagtccacgcacaggcctggttgatgattgctgcatccagtccacgcacaggcctagtaagcacaagtatcaaataagagaacatctcaccgtatcaggtactggagtggtattcccctcgtcctcgacggcctgcttgtcggcgctgcgcgccccgctgtccgggccttccatcttcttctctccgccgccttccctccccaaatccgcgacctcgatctcctcctccctcccctcttccgcctccggagcagcctcgacggcgacttctggctccttcctcctcgccgcccttcgcctcctcgccggcggtggggccggtgccgccgccgccgccgccgccggattctcctgcgcctctcgggccctcctcgccgcgctacgcagcacaggcatcctcagccatggagccccatatgccccccgcgcccccgccgcctcctcagattcctccgccaaacaccaggaacgccgccgatctcgggggagtgggtgggaagcgagcgatgcggcgacgctcgggtcgcggcgcgcggcggcggcggcggccctagcacggagacggctagggttggggtttgtatgcggatgcgatggaatgggggaggagacgggagggagggagggagggggaagcagatggtggtggtgctgacgtcacccgcggctagacgcggagcggagtactgtgttagttctacgggaagggaaaaggatttagcgcggcggccaccgtgtaaaatctggctgtgtacatcatttcaagtttttctatctcaaaaatatgctgccacttgcaagactcgactccgatttcgcttggaggaccttaatcagctacttctactattctcccctctataaattactctcctctagatgtttggaggatgtatgtttgtcttcggtcaaactaccaaaattataaactaacactagataacgagatacgatttaggtttagttccacgtcaaaattgaaagtttgaagaaaaaagttaaaagtttatgtgtgtaggaaagttttgatatgatggaaaagttagaagtttgaataaaaaagttgggaactacacaagcacgtagtgtctgatgaaacagaaatttgcggaactgaaattggctaagaacgagtacagttagtgatgcaagtgggctctaaaaattgtcacattatatttgtgcttaggtgaaggagcgagagaaaaaagtgagctacagagttaatatatcatgggttaaaaccatatgtgtatgagtatatatttatatgtaactattttatggaaagattgttaaattggttacatatgacgtattaatttttagaattatggctttataagtaaacttgttctaagtgtaagaaatgaggtggagtacataggcactatcttcaatgtgcataatcacctatattagtggtagaactacatgtatgttttcccctgttaattctctcacgttacatattttttttatattgacttcaaagtgttggtagtagaaagtaaacagttaaaaatttctttgttgacaataaaattatgcttagtttacatgtatcaaataagtcctttatcttctattggtataataatatttatctccatcgagttaaaaaatagagcaatcttgttccctgccactccttagtttcataaaacggtttatatgttctagtaacatcttataatcttctaatggaagttgatcatcgtcaatgggtttataagcttttctcattaacttggggattcctattttacgcgcgcgctggctacggaagtagcacgcagccgtacccccctcaacgccctgcagcatcgtaattagcggtaatgatggtaattagcaatattttccttttctggaaggttttctttttactaatagattgataagaaatctatacgtgaagtccaattttgaaaaactttcaactcgaaatttgaaaaaaaaattcaagtcagattttgaaaactttcaacttttcatctcaaatttgaaaaactttcaactcaaatttgaaacttttaacccatatttgaaaactttcaacccagatttgaaaactttcaacccagatttgaaaactttcgacccatatttaaaaactttcgactcagatttgaaaactttcaactcgagatttgaaactttcaatttggattgaaaaactttcaagtcaagatttgaaacttttcaaatcaaaatttaaaaactttcaactcaaaattttgaaaacacatatgtttaagattaaaaaaagtcaaaaaaaatgtgaaaataaaaggctacaaataggagaaaatcgaaaaagaaaaaggaaaatcgaaaaaaaaggcgtcgcgtggaggctgccagctggcgcgcgcgtgccaaatagcaatcgcgcattaactttaggtatgaaatttattatgctaacgatgcggtagggttttcggaccgactacataagggctttcgacactcttatactgccggtttgttggatggtttggaagaagagaaacgtgcgtgtgtttccagaatcagagccgaagctagggttttcaaagatttaggtgagtaacatcttattgtaacccgtctttctttctgaaagttgctattgtggcaacctccattcacttcagcagcctcttgtcgaagcctgaattctgtatatgtgtatatactctattcttaagtaaatttggtcatgctaaaaaaaattattaggcaaaaaatttactacggtcctatacttttaaaacgagttatttatttataaaattcatgtaaaccttctaataaaaatgcatgtaattgtaagcttcatctgttacgtacacacgagaggtggtgcaagttttatggcgtgaagtgtgaccgcaacgacatggtccggcacttcaatgaattcaaggactaagcaggcaagcacgcggtgtctacgaattcaacaaatccgatcaatcctaaacccagatgctcggccaagaccccaaagatcgattggatcgatgaagagtgatggaagcgctttggccgcccttcccctcctgattcatgcgcctctaactatccccgtcggcgccgttgtctatctctactgtaatatggaatttccttaaagcatgaagaaaatttgatgttacaatcttatcaagttcaattgcatcaagacgcttaatttctcacatgccttgaatcgcacagacttttaagttaatcagtttggcatgctatctacttgttttattaagaaaattgttaaactggcctctacatctaaaatagattacacggccaggctgtcatgctactatgtaactggagttggttgaaaaactttatacatatctagttcccttgttatgtaataatgcgattgattctgccatcattattgaatcagtgactttctaaattaattagggtatcatgttatacatgtaattggcgttggttgaactatccagttctgtgatagtgtgaatatgtaatgagaatcgtcgaatagtattttttttcttctgtgaataattatgtgagctccgataactaaatagcacttgttgactaactgatgcgggtaactgattaatttcctagtgttttgttgtttatagaacaatcccacaacgtgaacatcgtatggccctgtctagatcctccaaaatggcaaaagttttgctattttgtagcactttttgccattttggatctaaacattagtagcaaaagttggcaatttggcatttggcatttgctagtccatagtagcaaattgtaccaaaaagtgctttgggaccactccctctctctttctctctctcactttagtgctagaatggcaaaactttaacatgcatctaaacaccaactagtacttttacaataccaaaacttttgacaccaaaacttttgccattttggatctaaacactagtagcaaaagttgacaatttggcatttgtcatttgctagtccatagtagcaaattgtgccaaaaagtgctttgggaccactccctctctctttctctctctcactttagtgctagaaatggcaaaactttaacatgcatctaaacaccaactaatacttttacaataccaaaacttttgccacaaaaaattttgccatttgtcattccaaatggatctaaacatgccctaaacaggcccttagatcctccatttgccactttgaagcaccttttgccattttgatctaaacactagtagcaaaacttagcaatttggcatttggcatttgctagttcatagtagcaaattgtgccaaaaagtgctttgggaccactccttctctctttctctctctcactttagtactagaatggcaaaagtttaggatgcatctaaacaccaactagtacttttgcaataccaaaacttttgtcatttgccatttgccattccaaatggatctaaacaagaagtaaagtgctcgtcgcgtattgctgtggaagttaagaagaataaagggaaaaagactaattcccctcatcgaatgaggggttggagagtgggccataatgactgttgctactggcattatcgtgtggattcatatgaggatgaaactcacatgtcggcagctataagcttataacggcaataccgttacaatagagactctcagcctatggaatggtggttgtggtagttgagtgagaagagcgtgacctgtggaacccaatttagcaagcatacgcaggaaatatggtgtgccacattttaccaataaatatttggcatcctgtgactttcttccaaacatgccctacgttgttggaacaacggggagcaactgttcagaagcaattgttatcagatcatcactgatcagcaggtcagggcgagcgaggatatctgactgtcatggctgtccgttgtgtgctggagtacaactgtacaaggcgcaaacgatgatcaggtcctggccttcctggctgtccaaagcctcaagctgtcatcagctagcttcactgctccaactccaagcatcacatgcccagtctcgctacacccacacgcacagattgggggaccagtgaggagccacacagacacttgtgcaacccctcacatgcccaaagccctcttgctttcctaccaactggtcagtgcaatccagcaatgcacagtgcatcacacgcttgaattgttattacaatcaggtcagcagcttaaaccaccgtgcaccgggtgggcagcagtgcagtgcggtgcactacaaacttgatgcaagaattggctcaagaggtttgtattgcatggtatattgggtcaagctatccatagtgttgtacattctgtgatcaatataatgaactcctgaagtgtgaaagaatggattgtagcccatggaagcaaagaacatgactttacaaaaggggaggaaacaatgaaggcaaaaaaaaaaaaaactgtggggggttaatactgcatcaaaccaaggggggggggggggggggcaccttgagcgtctagagcgagcgccaggaagcaatgcttgaatcagacagaaagaggagtaccccaaaggctatggcaaatctgagttggccaacccccccatggctgtcggaccttctctggatgcaaaatcctgtacattcaaacacatttgtcgcgattattcaggggaaagaactttgtgcgtcagtgagatattaaaaaatgttctatgcagacatgacccaagcatgaagataaacaaaatgcatgacgacatgacccaagcatgaagataaacaaagcacacaaaagcaaatagcagtataacatagctgacctgcaggcggtgcatcaagtacatcaagaataagtgcacaaacacctggaacagagatatatggattcaattatagatcaaccttcatatgctaaaaaagcaagaatacaggaagtaaaatctttgcagttcttaccagatagaatagaaggctgactcgagcaacggggtgacgccacaaaaatctagttgcacgtacagctcctgaatctagtaacttcgcagccttttgtaactggaaaacagaatatgcaaggaaagtaaggtaaaattcaatattcagggtgcagcccttcagatttccattggtcatgtatacctgctgatttgctgttgccatgtgtcgatgatgtagaggaagaggcctgcaaatagtacacttaattgtctaagacaacagcacttgaaaatataaggaccattttaaacattatgtgaatcatcaggtgtgattgagaacagaaggtttgctcctgtttccctggatgttcagaacaaaagagaaatggtgaacgtactccagtgccttgatatcagcatcttcttcccatgctgatgctgatctgcgagcaactctactcctttctgcttccatctatcacatggagaacataatggagtaagataagaacatatagatgaaattgattgcagcaagaacattatgacaaggaaagaaatttaggaacctgcacttcatgaaactgctttattgatttctccagttgaaactccagtgcagccttttcacttgccatggattctagttgtgtttgcttgtggtactggaagaatggatccatacataaataaacttggtcttattaatctagatgtcaaaggtaaaaaaagaacaatgatttgaatcatagcataccagcaagtcagtgagctcacgatatctcttctccagttcaacatgctcctaaaaataagacatgtttacataaataaatgcgacctgtgagaacaatctggtaataagctgaattactgcagaagttatattaaccaagctagatgttcgattatctaaacacaaacatgaaaaacccatataattgttagatgtattgtatagctagctgtgtatttactcccttcttgagggtgctttctgcatatttgtattgagctttgtgtatacctgtttggcccagttggcccattcaatctaaggtccaatatttgcaacatggtatcagagcatatggtttagggttccacatccgccgtcgtcgtgaagctctctctctcctctcacgcgactggatccctcttctctctcgcgcgagcgtcgccacctctgccctgtgacctcgcctgtggtcgccgccgcgccgccagtgtcgccgccgcgcctctgcctcttggggtcgccgccgcgccgcctggggtcgccgccacgccaactggagtcaccgcccctcttgcgggcgccgccttcctctgctcgcgggcgttgcctgcccctgctcgcgggcgccgccgttcctactcgcgggcgggtggccacgggcgggcgctgcctctgctgccgccgcctgcttctccctcatcttccaccgtctaaagctactgcctctactgtgatggcgccgccctcgggaaaaccgggtgccatttctcttccgaagcctccggtcatcttcaacggactcaacttccgggagtatgcattgcatatgcagatacacatgtgcagccagcggttgtggggctacctcatcagcgatcggccttgcccgccttgtccaaccttgcctgctgagcctgccatcccggcatatgctgatgagaacactaagcgtggtctccttgatgatcttgctgctgctatggaggcgtatcagatagatctctctctatatgagacttggttagagcaggaggcctatgccaaggctattttggttgggagcatggaggttgacatatcactcgacattgcgggccttgctagctctgagttgatgtggacccgtcttcgccagcagtacgagcctcgcaacgatgccatgtttcttgccattgtgaatgaggcacaatctcttcgtcagcttgatgccactgtggatgagttctttcgcaagatgtctgcggtgtggcgtcaaatggacctacagggcgctgatgtttgtcacacttgtacctgttgtcagcgccagagggtccagactgagaccactcgcctctatgagttcttgtctcgtttgaggcctgagtttgagcctgttcgagctcagctgttggcacgacgccctcgaccttcattgttggagaccttgcctgagctacgggctgaagagactcgttgtcgtgaggctggtataggcattgcacagcagtccacctctgtcttggttgcacagggcttgccttctcaggtccatgtctctgcccagcctgttgtggtgccatcacctttacctgttgcggctagtgctcctagtactccttcaggcattgtttgcgggtactgtagcaagacagggcacaccgcctctatgtgctacaagaagaagagagatcagagtcgtcgcacctctcagggctctcgacagggctcttctcagtcaagctctcagcagatcacatcgaccgagcaagagcttgtaaggctccttcgtcgtcttatgactacagcctctacctccacccatgggtctgctgctcaggcttctagtcttccaccaccacctccatcctcttcaggtatattgtcctcgtggtttcttgattctggtgcttccttccatatgacacccgattccacacatctttcttctatgagtcctcctgatacccctctcacagttcagacagctaatggcacctcacttcctgttgttggtcgtggcacactttctacttcttcctttcgagttcctactgtctctcatgttcctaagttaaccatgcagcttatgtccgctggtcagatcattgatcatggttgtcggattatacttgaggctgactcttgttgtgtccaggatcgtcgcatagggctcctggtgggaactggtcctaggcgccatgactctcagcgtctttgggagcttgattggctacatctcccttctgatgcttctaccagccagtcagtcggttccactgcttcagcgttagctacttcatccactactacttttgctcagtggcatcgtcgtttaggtcatctatccggtgctagattatccacacttattggtagtggggtcttaggtcctgtttctggagataccgctctacattgtacgggttgcaagcttggcaagcagctgcaactcccctattcttccagtgcctcagagtctcagcgtcctttcgatcttatacactctgatgtatggggacaagctccttttgtttcgaaaggtggccattcctattatgtgatctttattgatgactattcgagatttacttggatttacctcatgtcttctcgtagtcaatttctttctatttatcagaagtttgctactatggttcacacagtacgattcttccatacaggtttttcgtgctgactctgctggtgagtacatttcggcagcccatcgccgttttctagctgagcagggaacacttccccagttttcttgccctggtgctcatgctcaaaatggcactgctgagcgcaagcatcgtcacattcttgagactgctcgtgccctcatgatctcctcgcatctttcgcctcatttctgggctgaggctgtctccacggctgtttttcttatcaatcgacagccttcttctgttcttcatggttgtactccctatgagcgcctatttggtacacctcctaggtacagtcatcttcgatgctttggttgtgtttgttatgttcttctttctcctcgtgagcgtaccaagctgactgcccagtctgttgagtgtgttttccttgggtatagcactaagcataagggttattgttgctatgatcctgttgctcgtcgcatgaggatatctcgtgatgtcacatttgatgagtctcgtccttactatcctcgctcttccacttgtgatcagtcctccactgtcaagtctatctcctttttgactcttccggattggtcctttccttctctaccaccagttccgtctccatcaccacacctccctttggtttctacgccatctccatcactgtcaccacctccttcgccgatgccatcatcacccatactaccatcaccacctcctagtactcttttagatgctccacatgagctatcaccttttccgctgcactactctcgtcgttcacgaccccttgttgagttgtcctctccctctatccttggaccagctcctgctcctgcttctcggtatgatcttcgtgatcgccatgctattaggcctgcgcctaagtatggctttactgctgcggctattgttgagcccacgacttaccgagaggctattgcccaccaggagtggcaacaggcgatggcagaggagattgctgccttagagcgtaccaagacttgggatgttgttcctgcacctactcacgtcactcctatcacttgtaagtgggtctacaagataaagactcgctctgatggctctcttgagcggtacaaagctcgtcttgtagctcgtggttttcagcaagagcatagtcgtgactatggtgagacttttgctccagttgctcacatgaccaccattcggaccttgttagctgttgcctctattcgtcagtggtccatttctcagctcgatgtcaagaatgcctttctcaatggtgagctgcatgaggaggtctatatgcagccccctcctgggtattctgtccctgatggcatggttcttcgtctgtgtcgttctctttatggtctcaaacaggcccctcgtgcttggtttgagcgcttctcctcagttgtcactgatattggcttcaaagccagcgaccatgaccctgctctctttgttcacacttcttgtggtcggacccttcttcttctatatgttgatgacgtgatcatcactggtgatgactctcggttcattaatcttgtgaagaagcgtcttagtgaccaattcttgatgtctgatttgggtcctctcaggtactttcttgggattgagttctcttccatgtcttctggtttctacctctcccaagagaagtatattcaggatctccttgctcgttcgggcctcactgataagcgtgtggttgacactcctatggagcttgggatacatctacggcccaatgatggtgagcctcttcaagatcccacccgctatcgccaccttgttgggagtcttgtctatcttggcgtcactcgccctgacatctctcagttcacattctgagtcagtttgtttctgcccctactcagctccactacactcaccttcttcgtgtcctacgatatcttcgtggcactatctcccatcgccttttcttcccttgctccagttcattgcagcttcaggcgtactctgatgcgacttgggctagtgaccactctgatcgtcgctctctctctgcttattgtgtctttcttggttcctctctgattgcatggaagaccaaaaagcagactgcagtttctcgttcaagtgcagaagctttgttacgagctatggcagccttgaccgctgagatcacttggctgcgttggctcctggaggattttggagtttttgtctctcccccgactccactcttgtcagacagtactggtgcaatcagcattgctcgagacccagtgaagcatgagctaaccaaacacatcggcgttgatgcctcgtacatgagatcgcaggtgcaaaatgaggttgtggctcttcagtatgttccttcagagcttcagttagcagatttcttcacgaaggcgcaaactcgagctcagcatagttattttttgtccaaactcagtatggttgatccaccatgagtttgaggggggggtgttagatgtattgtatagctagctgtgtatttactcccttcttgagggtgctttctgcatatttgtattgagctttgtgtatacctgtttggcccagttggcccattcaatctaaggtccaatatttgcaacaataatttggctagtgttaacaaaataacatcaatgaccagcgagacaagttcacctgtctggaataatgctctgcatctcgtttcattccagccatttcaactctcatcttctgtaactcagcctacattacaaacataaattagtaaaatgaacaagtttcttaaggtaaagcattatatattactatgccatgtataataaatatattgtaatataatatcctccaatgtacttggtcagcatattaccagttctattaccttgacctggttgcaacttaacaaatttaagctatgcatatccaatggaacatcatgaattgatataattctctattattctttggcatcttatgaaataatagtacctccaaagatgatatcttggtttctgcctctctttggctttggcgtgcacgctcaacctcctcatgccatgcttgcatctgtttttcaaaccgcagtggtaagaaaagaacaaatacccagaatgttatatttcaggatataacttgactcaaaaaatgcagttagccatttgcagggtaagtaacaattatatttcccttgtgcaaagagcatttcaaattgaactagagtacgctaaaagcacagctcaatatcaagctgtggataacatgaggcgctttgattctaacctgaataacttgattagcttcttcagaaggctttttctgagcacggcgattacgagcttccatctcctgtagttcttgttgcagcgatgcacattcaacctatgacatatccagagtactgacaatgactagcacaaacaaaccagttcacatttcacacgaaatattaaaaataacttacctcaagcacagccaccttgtgttccaattccattgctctagatgagctttgatcagcagctctctggacggcaacaaaacagtagagatactaaatttgctatctttttataaacacgataaaaactgcaacagtttatccagagcaatgatagtgctggaaggttagagatcaatggaaatacaattttagtagaatataaacaaattagcttattataaagtataaggctgtgtgatttgatggaaatatatcaaaatgatagatgctgaatggcgcacatcatgggaaacatataagttgccaaactttctatctgaagtcctgaattactgtttcttacagtaactgttctgatcctcgctttaaggataaaactcttaaataaaaataagtaaataacgt

SEQ ID NO: 72524 - DNA, 1476 bp, Oryza sativa
ttttattgtggaacatcgtgatgattcaatcggctcggttgaaattgtgcccttgactttattcgttgatggatcggtttgtactcatgattgtggtatcagcttggttataatctctcctcggggggcaagttttgaatttgcttatactattaaacttgtttgtatgataatttggcttatagttagtgcatgtgtgaaggacagattggtttagaattgatgatacaactgtcaaatgattcacttggaaaatctactccgtttacaggtgtaggaaattgtgatgcatcggtcatatgtgatagtattgactaaatgaatatagaccgatgtagtttataatattgtggcctgtgcaagctgattacatatatatgcatatgtatatttggtttttatgcaggctacagaagctatacagggcgtggtcacattacgttaatcacggaggcaggtgattatccctaattgggtgattaagtggcaagggaatccttcgttgctcctgcagatggaaagtcaggtgtcgtatttactgagccaaagagtctacatcgtcatcgagcgagcaggggctcagacgtgcggctgtgatgggagtgctgcttgcatggatgtgatggtattcgctggatccaaccatcacgtggcatctgcgttgagagcagggctgcggcgaccgagccaagccgcgtgcgatattatttatctagttagaagataaagagtttgttggatcgaattgtttcaaatattccggtaaaccatcattgcatattgcgtgggaccgagtagacatgccaaaagatcagagcaattagctatatatattggtccacggtagaatagaagggaacccaatttcaatctaatattcatctcttttactttttagttcttttctattttgtttttatggctgagttctagcaaccctagaatttggttaatctttgccgttttgcgctgaaaaacggtcgtgcttctccatgaaagcgagaaggttatcctttgctagtttgctcggaaactagtcgttcgtcgtcacgtaagtacgatattatcttctttactaatttgctcgtaaattagtcgtgtgattccacgaaagcgaattaatctcgaaatcggtttcactagccaattttgatttattgattttggcgactctgtttaatgcaccgcaaatcattaggtgatcttgtgttggcaaaaaaaaagcatcaacaaaaccttatgcaactaacaatcaagctaagtacgaagcagttctcaaggggttgcagttgcttatggaagttgaagcccacgccgtggagataatgggggattctttgttggtgatcagtcaattggcaggggaatacgaatgcaaaaatgatgcgttgatgatctacaacgagaaatgctgggaattgatgaatagttttcggctggtgattttgaagcatgtctctcgggagcagaacgttg

SEQ ID NO: 72525 - DNA, 2109 bp, Oryza sativa
tgattagggaccaaaccaagaacttctccaagtctacttctacctcaccacgtcacttttggcccatagaagacaagaaatcaagttgtacacgttttgtattcggattcgggcctcctgacagcatcaacttcaaacggacctagccactgatatagaaggagtttcgaggcccatgagtacttgttgaaaaacttatggagtctactttcagatggttttggtcccatgtcaaaattcctaccaaaactgccgggaatctgcaaaacaagccacgtacctcatccagtccgaatctgatttgggtgttgggccttgtaactgtgtcgtgggcttagcccaaggaggtgtgcgccctaggacaaccctagtacgtccctaatcatattaaatcagtagctgtcatcgtttagagtcgggttttgcttagattaatctgttaggaatagtttcgccgctacatcggtttgtggaaccccaaattcgagtgtttaatcatccatatgcaatttggttgcaatctatcttgttcttgcttgtgttcttcgattcgcatgcagggattagccttctcggcgaggtcaaccgggtttcggcatggttgataaccagaggagacgtggtgctgcgattgcgggactcagtagcatgtttgttcagaagccggatcgagttatgttgcgattccgcccaaatcgactgtttatcaatagctatcggaagatcgggacctaacaccctcatcagttggtaccagagcgtggttgcccgttaggtaatttatcttcccgtaaccagaaaattgccacacaaaaatatttattctttacctagacaatttgagccgttgcattgttctattagattttgcgttgttgaattatagattgcatcgtcgtatcgagtgctggtttagttttagatttaatttttagttttgagtattgcatctgttcatcactttcacttaggtgtagggttcgtctatgagttgtacgtcagttttgggtccagttttgtatttcgtcggttgttgccgggaccttgaaaaattgaatcgtctcgtcatcgagattccgtttttatacttttgagaagttttttgtcggtcaagtttggagttgcggctagggtttgcgcttttgccgaatttccctttggccgtacccctccccatctgcaactaccacctccccctcacgactgaccacctttatcacattgtttggtattttggtggttgtagatttgagatatttttacaaaaatggaacctacatgatgtgagcattccatttttgaggtgatctaattttagttttacactttgcatttgagacccctgtaatatttatatttacatttgagtccttcttcgaggtcagtggttcaattcttgttgaaaaaaagtaaaaaaataaaaaaagaaaagacagaaaggtgcaaagaaaaaaaaagaaaaaaaaagccgcacctaaaaaagaaaaaaaaaggcataaatgtgcttaaaaaaagccgcaccaagaaagaaaaaaaaaccattcatccttggagtatgttttcagagtgcagagttgtgcattgattcatatatagtccttagtgttgtcgggtgcttgcttgagctagagttgagtctagactaggccagcacattgactagtactttgaactattattcaactttgcattttctgattagtataattgcgttcctttgctactatatattgtgcctcccaagctccatatatattcttctggtcagcaccgctttgatccttacaatcgccacatcacgttcttcaaggtgtcacaaactagccactggttgtaccatccttagcattgctggtaagacacttgtaagagcttggtaaggtgctctatttggctgagttgttgaggggcatcactacaccacgtagcagattattagggataaccttcattgtttgttgttgtttttgtgtttgcaatgatatgtatgagtggcgctcaaaatcagtgataccaacaaggtgcacgtgatgatagtactttggtgcaacaagtgctaagttctcaactggagaaagcggagcaatggcagtaccacgaattatttga

SEQ ID NO: 72526 - DNA, 1279 bp, Oryza sativa
aaaaatctttcaagcaaattacgtccaaataaaaagaagtaacagaaccggccatagaatttatgcattgcatcattattagtaattacaaagtcatcagcacacttcaatattcaaaatgccagagaaaacacatctttactggattcatccaatagcactttttcatggatattatgaagctatcgtttcattgtctggagctccaaaattggttggtgcatacaaaggagatactccacttaatatcaagcaattgacaaaattaacatattttcaaaattatggcacctcacaaaagggaaaattgaccttctgctgcagcctacataacacatatcagcagcacaacaattgcagttcaaagagtctacactgatgaataaaaattgatttggttgatagaaagaaccacccaagtactcaatacaaatagaaaattgcaataattgttcagtatttacagcgaaacctaaatctacaggaaataacagcctcaatctgccatggagaaacttttccaatatatttccactaagttaggcactcaggctagcaaaatgaatacaagattccaactaatcaatttctgaaataacatggtgtctagaaatgctaatcctaattttagtgctgttctacttaccctggagagatcttggtcgatgtcaacgattatcatgaccatgttggtggatggggacaaggctctttgaggcggtcttcctcctttcattggcaatgcaaaaacagttctgcaccctccaaatcctactctgagtgggcctcacaccgccggcggaattccattagtatataatataattcaatctgcattcaacaaagaccaagagttattgagccctcccaagtatttgcaataaaaatggaagataactgcatgaataattgtcactctaatatcaatttacaagttcacattatacctctttgtcgacaaggccgaggaactcttgatgctccttgctaacagactgcaatataaggaaatcagaaaaagataacatcacctgttgttttctcaacgcaatgttagcgctcctttcataatataagcattcttcctagagtaacaacagtattcatgctcttctctaattgaatatgcaaagaacactgatttttccttatcaaacaaaggatgctaccatataacatttaaaatgagtagaatcatcaatacaaatttatcaatttatgtgccaattatgatcatcaactaataggcgattagcctaatgaaatactctacatacca

SEQ ID NO: 72527 - DNA, 1253 bp, Oryza sativa
tgttgagcaagtcaagaagtgcgaaagctgtcagcgcctgtagccagtcggcaaccttaaaaaccttatagctgcggccgtttatcactatttcgcaataaacaggccgaaatgggcatcgcaccgttggcaaacccttcaacgccacaaatttcttgtttttgcttcgccgaatacacaatttttggcgaacaccctgttaaactgtgcagaaagggcaaaagacgatttgtatagtaagaattggcgaaagaagaggaaatattacataatacgaaaatgacataatcatatacgccaaaggcatcgaccataaaaagtggctaagatagagtcatacattccaaatacccaaagggacgttttcggctacaataaggagggaagaggccgaatgtacattgttcgcctttcccggcaaacgcaaaaaagaagaagaaaaacttcaaaaatctaaggaaagggcggagggcctcacacctctaggtgatcctgggcatcgcctgcaccccctccagctgctgcatcctcttcaaggtcgatcgcaagggcgatcgggtagcgatcaattcaccccccccccctccacctggttttcttttttggcaccgcattactttcctattttagtaaatttatgcacctaaagtttatacacctcaagtttacacatctaaagtttagagaccaaaagtttataagtcaaaagtttatatatccgattcaaatttgaatttgagttcaaatattttttatatatagtatttctatatatctaaagtttatacacctaaagtttatagacctaaagtttataagtcaaaagtttatatacccgtttcaaatttgaatttgaattcaaatattttctatatatagtatttctatacatctaaagtttatagacctaatgtttataagtcaaaagattacatacccgattcaaatttgaatttgaattatatctgattcaaatttgaatttgaattcaaatattttctatatatagtatttctatacatctaaagtttatagacctaaagtttataagtcaaaagtttatatacccgtttcaaatttgaatttgaattcaaatattttctatatatagtatgaatttaggtagatgcttcgctggttaattaggcaacattaggtggttttacaactctagactttgggaatactcttttcacctggacactatgtaattgttggactattgtggaattggattcacacctgcccctcta

SEQ ID NO: 72528 - DNA, 2353 bp, Oryza sativa
attcctgcagccccgaatagccgcgccctcggttatggcaagccgagcaatgtacccaagttagtgttttaattcttaaacctgcttaacaactaaaatgtggaatggttggcctgagttggcttgggacgagctgggacccagggtcgggttgccagttcggtctgaatcatcgtaggccttgggttaaggcaggttcgtgtgggttgacggccttgtttaataatcttgtatagctctagaatcgtatttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaatttttcctaaactcagaagaggagttcctggaagatgaaggctttggtgtctagctcgtgcctgccgtcaagcgcctgtggtcgtcgccctagtcttccgctgtttgtcgtttgtcttctggtgtgctgggccttcgccgcccatgtaataaattaactatttacgcttccgcttgttaaactctgaattgtatcaacttttggtgtaccttgcctcctgggacaaggaataatgcacgcacgtaaggaacgcctgttgggttattcccggtcgtgacactagcaatgtgaataacatgtttaaactcaacacatggtggctctactatagaactaacatgttcattaactagttgtgcctaaccaacacatcactgggccaaggagttagttgctaagtcccaagaggaagcccagtgctagggaatccggtgttaagagcgaaatttgacaagatagactcagatttggagatgtatatcgacacataatcaaaggagattgaatcttgccaaattcagaacgcgcattggccggaaacagtgttggaaacaatatcgccgaaccatcgaggtgtatcgtcccggcttcgtcgtcgtccaacattgcctaggcgaagtagtcctgttcgctcacgatgtggggaggagtcaccagcctcctttgctttgtcactggctcagcaagggtcacatgctgataatgtttcctctctttgcacgataaagttgatgcaggattagaggcactgaccaagctagctctagatctttaggggcatcttccgcgttctctagggtagcgtcttttacatcgatgatcttggttgcagcgtgtgtcttagcaatcccaatttcaggacaggcattgcgccacctttaagagatgcgcaaaaaccatgtctagcgcagcctcctccaagtcatcaggttgagtttgagtgatgtccataggactggtatagagccaacaccgtcagctccactagttcaggatggccaagctatgatggtggaagtcgttgtcaaccatgttggcatcaaggccggccttgattagcctgtatccagcagcacctcagtccagacttccagtttctttactgtgtcaagggtgaagaggactcgttgtgggtagttctgcaagacactactatcaatataattcccaacaatggcgcagaaatactcctgatatattatggttacagagttcatccacaagcgcacggatataccattgtagcatttcacccgagagtattccaagggtatcgtatttattttatcccgtgggaatatcatgtagagagaacattgactaataatttatatatgactggtgataatcatattctaagcaggggttaagataatccaagggtagagtgacacacaagcgttaactactcattctcatactttataatctaagctaagtggaaagaaaataggaagaaaatctattcctatacttctaatatacatagtatacatacattctagttaaccgacattctatccgatgccctcctggtacttcgagaagccacccctgactgccgagttccttacgacagcccgtcatgaccatacaatcggggctaaatacgaaggaataccctccccatggaattaacttaggattatataccggcgcggaggaatacccgtactgagctgtcaccatcagtggcccacctctcatccgcaatatataaccccaaataatgatatcccgtaatctagacaatacgtctaaactaccagatactactctaatatcatcgttatgacatagagtaattgcataagcaaacattatatccacaccaaagcatctcccagataagctagccgtatatttagtataacatgaacataatgtaaagtaggtgctcatattctcggaaagtatttcaataccataaatgtatttagaagagtatt

SEQ ID NO: 72529 - DNA, 15125 bp, Oryza sativa
  unsure (1)..(15125): unsure at all n locations
ataacagaatctggctaaggtatatggtcctttaggctgtgttcttttgttcaagttctcaactcatctccctcgttttttcgcatgcatgctaaacggtgtgttttttgcaaaaagtttctatatgcaaactgctaatacttaattaattatggctaatacagtaattaattatttgagttgctctgttttgcgtgcgcggagattagttcccagacacaaggaatgaacgcagccttaatgtgtcaagcatgggagattaactagaacaaaacatctgctcaacaccattacgcaattttctggttagtgttgattttttttcggccatataacttgacatcctagcaaaatagattttgctcatgcctggtagttataccttgtaaaattacctggattctagcaagagcatttgatgcttcaacagctcgatgctctaattcgacttctctctcaacagctgcctgcattatagtagagactattaaaactaaacagaaaaaacaatgagtaaacaatgtagcaaatagaatataatttgacaaattaccatctttgtagcattatgtgcaatacgctcctcctcagccctgcgctctaccgtagcaagttcctctcgtaaagcctaaagagtaaccaacacatatgaaggtaatatacctgtatgaaaatgtggggacagaattttctactcgaagaaacctttgttactaacctggatgaccctagtttcagtaagttcacggttcctcttgagaccatccatatcttcctggtttcaacagacaatgagattaatatgtactgagagcatcaattgtgtgactgagctataaaacacaacaaatgttcaagaccactggacagccatttcgtttaaggtatgtttctagaaaataacatattattaagttaactgctgcagaaagaaactgcaagacttaaagtgatatctaacaacatttacatgcatattcttttttttaaaaaaaaacatgcattttagatttgatggctcgccactgcccacactggaacaaaaccagatgaacctcataactctcagacctaaaatacagctagggagcagattttccatgattttgttatgctaaattgcaatcatgacctagaagaatctaagatatgcaagagtggatgatatcaaagcaccaagaatccacatcttgaattcttggaatgactgtgaaatttccagattcatcttattccaaataattgagtatgccaatcttcagaccttattctcaagaaatttaaaagggtactcttttttttttagataatgggtaaatcaggcctttgcttcagtagaagctacagccaatgattacagtgtttgcagcaaccaagttgccaacaatgtcaaaacagaagacaagaacatataaaaaagaaaatcctggatgaaagaaagctcatgttacaaagcaataacaattagatcaagacagccacaacacaaaacatgtacttaacatagcaaacataagaaaatgtaagcactgcattagtttattttaagctattaaaacgacaaaagaaccaggaaagtgtgaaaagtgttgatggaacccatactacaaaatgaactatattatggatttatgataaatgatactaggacacaacatatagtttccttttggtcctagtagtagtaacatggctactatgaagaaatttctaagaagagcaataaaagatgaaacctgtaaagctgcaagcttttcttctgaagctgctgcctttttcttccaagagtccagtgacttaactagagactcaatctcagcgttttttgcagtcaaagcatcaaccatgttagattcagctcgtgaaccttctactctcgacattgacagttcttgctgtagttgcttcatatgagcttcatatgagctacatttctctctctgttaagtgttttacattaatacatagagaaaacaactatagaacatatcagcgtcaaaaactatagaacatatgagattaatgttaatagaaaatgtaatgaaaagaatgttggtaagatgatttgacctcctgaacaagaagttcctccagctgtgcattctcagatttatactcctggaggcgggatgaaagtccagcgcagacctattggtagtaacaaataaatctacaagtcagcatatgaactagccacaacatagataacaggcagggtcaaacttatactgctcttacccgagctaacctagcttcttttgattggccagttttcacaacattctttaacaaaccccgagcctgtcaaggaccagcgagacatggtatagtgtagctgtgcggaagagaacacataacatgcaggatatcttggattactacaattttccacaacctacctcctcaagttggtcttggtctttcacagaaccagaatcaagcttatgttcctgctgattttccgtactctccggtgagtcagacaaaccctctcgtttggaatcttgggattttccagaaacttgtgtgtctggtacttccttgatatttttctcatggataacttccatagctgagtctttctcctccaaattaacagctgaaacgatctcagcatcctggttactgatgcttggctcacatctttcatctggaacggaaggagcagagctttcagcagcaccctctgaatttccagaatctgcagcaccatccacaacaatggctgcatcctcagcacttctctctgttgattggacttcaacctcagtatcaacaacctctgcacctatatcattcttacgatcaacgacgaccttctcttctttctctgctccaccatcatcatccagtcccttaacatcacttgaggagacatcaggtttactggcactagcgtcgacgcttgatgaatcaacaggtggcgaaggcctgatcttctcaatcttaatccgttcccgcggtggttgcctactcttcctctctttctgagcagccgtcctgctaccagcatccccagttgcaagcttcaatggaccctgcgatgcaatttagcacaaaatgtaaaccattggttcccaagcacattttgtatgcacaaggaggatactcagtcacgaccttctccctcagctttcccttcttcgcttgaccttcttgactgcttgaaccttcaccaaacaaaaattagagattagttcgctctctaagcagcaaaccatgcactgactaaaccaaggagaaaactacctgaaggctgagggctagactgctcatctgacaactcggtagccacaatcttcgccctccggtcgacaacttcaagcaagtctgacacaaaaaaaaacaggtaagttgtactgctccccgttaccaacatccaatagcgtattcaagcaagcaacaagacggatacgggttcggattgggtgcaaatgcacgcggcgcgccaaaacgatcggacaaagcacagcgccaaggctagttcgctaggtttagcgactggcattatagctccaggagcaatcgagtaaacggctggcacgagagtagaggggggacaagcgccaagatctcagtcgcggagaagcggtggatctgggcggcgaatcgggaggaggggggaacgaggacaagaaggtgggcgtaccttcggcgaccttgagccaggaggccatggcgggatctgccggatcgccgccaggcgggaggaggggtgtgggccggcgcgagtgacgaggagcttggatggatggatgaattggctggtgagatctccggccgcggcaaggctgtggggttctaatggcggtactactacgggttggtggtggcgggggacggatccaaccggtcgctcggttcggtcgacgatgagaaaactagttcgtgtgtcatatacagaagcccgtctagctcagtcggtagagcgcaaggctcttaacctggtcgtgggttcgagccccacggtgggcgtgtggctctttttgcggggaatttttctttcgctccttttttttctacttcctctgttttgatgaaacggagggagtataatccttctttgagctcgtgtaacaaatatcgttgcacttttttgagcagtgattatttttgagcaataattcttttgctttcctttttctaatccttcaatgatacttcttgttttctctctttgggataatgcccacctgtattttcattcatataaacaaaaggatgagaaaagttttaagttactgtaggaaataaacgtgcttattggcgcgtctgttttacagcccgtgcattcgatttcaggttattaaaaagctatggctgtattttaaattttttatagatatatactttggaaaaacaattgtaaaatacgtgtaatggagcttttgttgattttcgaaatgacattattttaagtacaggggtagtacaaattttgcaaaattttataagaattgaactgaacttaagaaaaaaaaggtatattcaaataaattttattttaacttagtttaacataacaaagtcttgacattcgtctccaaccgttgagtagaggcgcataggggtgtcacttgtttaatttactctgttttatatcaagtttaagctaatgtgggtatctaaatttgtattgaggggtgtagacatggtttnnttnggttnnttatngcttcnnntttttnttntcngnnnnnnaggnnnnnnccctccccccccccccgcccccaatactctagctccgccctggaggcgcggccaaactgcacacgtgacaaagttcagcaccgaccacactgacgctaacatacccgacctcaacaccaagcaatttgacgctgagattggggacttagcccctcaccccctcgcggtgaaggtgtactagagccgaaggtcagcaccaaacgccttggcgctgaggtggcgaagctcaggccgatcaaattgggacccacgtgttctttaattgggacccacgtgaataaaaaaggaaatagagattggccactttatttctgggagcaatgatatctgacatgcgggtccaatatacttttttctacactagcactgatgcctgtcactatgcttaaattcaacagggagaatcttgcaatgcgtagaatcggccttatcaccttctctctctcctatagaaccctctctaaattcaacaatgcacatgctctaagattaatcaggcgccttaacagagaaggtgttcttgctatcatacagcgacattgatttgatagtttaacatatttccagacggtaggttgcagggttcattgcaaacttttctatgtagatgtctcttaaaactggcattgcccttagagggtcagtaagtaccaaggcgtgattaagatggttgttccaatagctgcccggccagaccgtcatacccttgaaacaaatggttacaagaacaatatacagtgccaatataatcaccatgacaattacctgcaaaacaaacaacagacaaaaaaaggttggtaactggaaataaggcacatcactgcaacaacaaaaatgcgaacagacgggaaaaggttcgaagggtgaaaaaacaggactaggatgatgcaggagttcaatagctagtggggtgatagtagtggagaaaaacaaaaagggggcatcaggaagggtttacaaaaccgtgtggttatcatgtatggtaaagtttttaaaattaggtatacctcgcgataaccatgcgattttcatgctaaccacgtgcactagtaaaaaaacaattttaacatacgggccaaaagtaattttcgcgtgcggaccttcatcccgtctgtctgaaaaggtctatgagaatcgttatttttccatacgggtggcgcacccacacatgaaaattgatttcacgtgtgggtatgaatgttgtccctatagaaaaataaaaccgggaaaaaaatcgcaaaacgcccgctgccgttccgggtgggggatggccgccaccaccgaatctgagcgagggagggccgtcgttgctgccatcgagctcctcccgcgttcgctgccagatccgggcgggggagggccaccgtcgcccctcgccgccttcgacgcgtggggcgcccgctggccgccgtgctcctgcccaccacccatcgtgcttctgactaccgccgcgcgcccgagagagagtagtgtgtgtgagagagaagagtatgaggaagagagggatgagaggagctgaggagataagaatagcttgaaaaaaaattgaaatgctaagagggacaagaggaggtaacttaaactttggagcggaccttaagaaaatatattttttcgtgcggctgcttaagagacccgtttaaaaaaatagctatatttttgcataccgcttagatttttcacatttgttaatcggatttgttaatttattaggtgggaggttcttttacgagtcggcccatcatatccctccgtctccagcgcacccttttgttatctcgggccccggccgtatttagcagcatctcttagggcaagtttaataagagagtaagcagccatctattagatgcttacatgtcatttctatatcattaaagataatataaaatttaactgagtcattaatttttctttcaatgtggccaaaccttggttctctctcctaggctatcgaccaatcacagatgctctttctatgtgggccaaccttaattatctctcacctattcttttcacctatcacagtatccatcgtatgcatgccgtgtctaggcgcccgtgcacaggcgtcgttaatttagtcgacggctgctctctctctctccactccctttttcttccagcaatgcaaaaagagcttatgtcagcggctaatagtaggtacattttccactattgcactagcccttagagcatcaccaatagattagcaataatctattccctaaatttgaattttgggtttcctaaactgaaaataggaagtgaaaaaactcattcctcaaagagatagcctaaattcaatcccaaaaattaaaagtggactattctgttaaactaccaacagaaatttcctttttttccttccatgcacacaaaaagatattaccatgacccgcatgctccctacagaaaaattcggcgctcgcgcgggaaggagagaagcgcggagaaggagagagaacgcgcagacaagagattgtgagtcgctctctcaccctcaaatccacataacgaaatatatggagatagaaactccaaaactagtgcaagacttttgggaatctgttggatctgatttttttttcactaaaaacccttaaaatcagttttgggaatgaaataggacgacggttggtgatactcttacgtggccgttgaatggtggccgttgaatggttgaagggctacgtgataccgttcaagatagcagtttcgaaccagacataccaaaataatcagcgaaatttctttaacctgattgaatacgtcatgtacaaagttacacatattctgttagtggaatactgtatttagatgcaacatcagtcaacagtaacctatacaattgagtacaacaatattggtgtaatggcgatcgaaccgtcaaacgtatggcatcgtgcagctctcgaccctgccgatctgcttggaggcgccaccggcggcgcaggcatccgctcgcgcggagcgatgccggctgaggcagttggtccttgcgatgtcgcgcatggagcgcacgagcgacagcgtggggttgagccgcacggtgcggttgaacctgtcgcagagcgacgcgtgcgactcgacggcctcgcccaccgtcagcgccggctcgcgccgccgccgctcgctcacggcctccgcgcacagcccgcagaccagcctcccctcgaagcgcgcccggacgcggcggacgtatcccggggtgcaatcctccgccatgccgcagcactcgcaccgcacgctccgcgcctcctcctgctgctgctgctcatccacctcctgtagatcacaaacgatgcacggcacgatcggtatccatgccaatggatcggaaaagcagtgggataattagaatggcatggttaccacttaccgtatgggcctcgagttcgacttcctcgtcaactaaacgcgccgtataccccttcatcgtctgatcggtcgtcgaatcttccgagctctgccaaccaatcactagtccgttccactatgagtctgatgcactttacggctttgcctgtgttgccaggaacatgtgtgcgcgcctcggctatttatagacccggttttcaggtgttaccgtcagggccctgcgtgtcgagtgcaggagcccctggccaatgcccatcctaggacgtcgagatcgcgccccgtgattggcaggtgaattcggttttgttgcggcagagagcctcttggttctgctattctatcagccacccggtacgtgtaacatgtgaagatcgtgcagcccgtgacagcatgctgccggaaacagaaacaggggacgaccggccggcagttttatctgccgtagattaattctgcgggcgcaccgcgtggatgcaatccatcgtataatccagccagcttaatcatcggtcatgtcacttaactcacttcacgtttcacttgttccggagcaaaggctaaaataggacagctacagctaggacctgcatggcgctgtagggaacgatgagagtgagatgactcggacagaggcacctgatgactgggcgggtgaagtggcatcacttgaatagatgcaaaatttgcactgaaagtctgaaagaaacagatcgatggatctttcatggttaccgtgcgccaaatttctgagtgagtactctcttgctgaagtagtactagtagtaaagcagagtaagattcataacgaactatcgcgagtgcagatgatcaagtgcttcatcatgttcttaaaagagaaaaaatctatgtcaagaacgccttatcatttgcatgacccacataagaaaaagcaccgtcacacatagaaacaacttgacaaaatcacgagattaacttgaaccaggccacaacagtaaaagttccgtgccatgatagcgaagcaaatacctgggtttctcctgatttcagtggcgaaattactgcgccactgtagagggccatcaaacgtaacgagcaggattatatgccactattgaggctgcggcatcgatcggtcgccgtcgcagcttgttgtgaccttaggtcacgaacaagatcggggataggccggaaagaagtgttttcccgcctatccttagaaactagctcgaacagcaaacacaacttttgaggattactcttgtattcaagatgtcttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcctgggaattcgaattcccctttgccttctctttcatccttggaaaacacctgtgaaattgtaacttgtccaaaatatgtgtagttgtattagcgattatgggatgtccctaaaaaggtgttcttcacccgaagaggtattttctattcgaatgagtgttcttcctctgggaaggtattttccctttggaaaggtgttcttcctcttggaaaggtagttcccactcaaaatgagtgttttcccttctggatacttaggtcttgcaaaacctcgtagtgttttgaccgaattggaggaaaaggtgtttgcaccctgctacaacaagcccctcacgggtaagggcgatgtgtgttttcggccgaaaccgtgcctgagtttatggaaaaagggggaaaaccgccgtcctcctattcggtcgaaacacactattcaaatatgcatatacgccacgtttactattcatttatttttattcttattatttttcatttttatttatttttatttatttatttatttatttatttattttttgaatgccacgtgccggtatttcgttggtgcgctcaaggggtcgcgtcgcttcgggtttcgcgtccgctcgtaaacccgcgacccttaccaccctgcgctatataaggccaggaggggtcgctatcacgtgacccacgccaccactcgtttgctctgccatcaactcgaaatcacaaaatactcgaactaaaactctttcttccttcttccatttgagttttggtgctttgcttgatttcttcctttctcactacacagcatggggaaaaacaagaaaactgcggaaaagtcgaagtccaagaaatcaaaaagccacgaagatactacttgtggtattggtgcctcttcgattaaggaaaaaaacttaaacgatcttgttgatgttggttggatatctggtcgaaacgttgtaattcgaccagtgggagaatcaaggccttctcctaagctgggatacactcttgtgtttgaggatttcttctacgccgggtttaaattcccatgcagcactttcttggttgaggtcctgaaattgttcaaacttgagtttcctcaattgactccgaatgctttagttcgaattgggctttttgaatggatgattcgaagctgcggtgggacccctcgagctgaagactttgcatacttccattgtactcggcattacaccaaacagaactcgaagtttgggtgtgtaaactttgctcctcatcccaagcgcggaagtccatggccagctgtgtctgctattcgagcaaaatgggggaacaagtggcaatcgaagtggttttatcatcaaatccctcttagcctgctgaatgataaggattgtcctttttcgttctctgggaagaaaccgaaaactgtctccgagccatcagtctctttgtcgccggagttcactgccatacaacctcgaatcgaagaacttgtttcgaaatttagctgccgagacctggtggaagagtttgttcttctcaaaattagacctctttcgagcggctgggatataactctcggagaaatccccgaaagttgcccttccagtcttcctccatttgtggtttcgtctgatcgtaagtttccttttcgaactgcaaaccttgtttgtcttgaagaagtgatttagttaagaagatttattttctccctttgttatcttcttccttgtagttgtgattccagaggatatggtccgcccagttcggaaatttcttggcccttataccaaggacgagcatttgaaatttttgacacttcaaaacgggaaaaggcaaaatcgggtcttcgcttctctaggctccgatatccctgtccgcgttcatcccgaaattgtccccaaactaaagaaaaagaaatctgtgaagccctcttcctctgatgatgatgatgatgttgaagtggaagatgttgacgaagaaattggggaagaaaatgctgaagaagaagaagaaggcgaggaaggagctgatgaagaagagaacgactcgggtgatgatagcgactcgagtagcagttcgagcgacaactcgagcgactcgtctgattctgatgatagcaaaacagttcctcctcctactgttttagctgatctgaaaaggaagaaaactgccagcagtcctcctcctggaccgagttctaaacgagtgcaacttgttattgataatgatgaagatttggatgaggatgatatccgtattgatctttctgccatccatgtcaccccaattcgagctgatgctagttttgccctttcggcaaaagaagtggcttcactgcaagttgttgccccagccaccacggttgtcgaggaagattgttcgacccaagtggttgatactgttgagacaacaaaccctcttcgagctgatagagacttggttgcaaaaaaggcaaaaacgcccgtcaatgcagccgaaaaaaccgaagcagggaagagtgctgctggtggaggtgttcgaactacatgtagttggaacccaactccacctccgtcaccgccgttcatcgcaaccccttccccagagctgatacaaaacgttcttggtggttttagcgaacgatgcgcaaaagatggacattggcttatgggtcttcctaatttcaatgaactcggggaaagtagccatcatggcccaaacttgtgtttgaatgacctaaagtatcgccaccccctgagttcgattggtgatgaactcgagaagattctgattactcctgatcttgaaaaggagtttttggaagaaaatgatcttatgtcctcttggacagcacttgatgtatctgctgcacaggtatttctatttatttattattattattatttatttacttattattattttatttattttttttgacttaaaaacctattttctaatgcgcagactgcaagccttgctcgtcttcaacgtggtgttgctcggaaagctcttcgagcgctttgcacgcgacggaagaaatcacttgatcgcatcactaaacttgaaaaagatcgggattatcttcgctgcaaacttgatcgaatggccgacgagaagaaaatcaccaccgatctcatgcgcgagttaagcggcgtaaagagagagctttccgaatgaaaagaagttgctgattgagcaaaagaaggtattactcgctcgcgaaaaagcattcgaccgaaagctcattgagtatcaagaggtcgcacgacaacgcgctgaatcagaagacaagatgaaagagcaagttgaggtcttggagaagaagaataaagaactcgaacttgcctgcaaaaatcaaaacgagaagatatctgctttagagctcgagagcgaaaattgccgccaacttcttctgaaaagttgcgagaccgttcgaatcgcgttgcgaagtctaggggctgacatcagcttgctatcggaagaaaataccttagcagctgtgggaaaatggttcgaggaattttccattgggctaaaagatagtgttactccctttgcatctcgctgctcgaagactgctgtggagagcctttcggcctgtctgctttcaaatgggtgtgaacactttaccacccttaaagctgatatccaaggtatgcttaatgatgaagccaaatttgcacagcttcgagatgcagctcaacccgtcgtaaaggctttccaagttctttactggaagaagaaaggatatgaagataccctgaggtctcttcgagcatctcttgcctcaagatcaaaatcacagctggccagttcgagccaacaagataaagacagtagtactccgagctcgagcgcacaggtgtgacgttcgtaaaaagaatagttaaggatgcttcgcatactcgaaaacaatgctattttgctgcttcaaagccgttatggttgagagcctttattgtaaaaatttatagtgtagctgactataatgcttttctcttattgcatgcttttcacggaaattccctttctttggggggctgcaggttaactcgaatcgaaaacttgtgattcgacgcaacaacactttgcctactcgaaatgtgaagcacttaagcatttagagaccctgcaaagctttcttctaccaggaccaccatttccgatgacgaactcgaagcctgttatgataacacttgtatatttgcttttaagtttttccgatggcaacgaagccatcgacatgacagtttacgtgactttgtactcgagtttagggaacggcgttcgaacaataagcttgctagtaaagccttttggcaaaacttccaaccatccgaacgccaacgtagaatatggaaaaggcgttattcaatagttccatatacagtaatgccttctcctctcaacattgtttatcccgactcttttctttcttctttgtagagtttgtatgtaacttgttataccttcttaacatcaaataaacccttcctttcttcttttctttataaatgctctttatttcaattgttcaagcacccttaggtaaactacgtcctccttatctttggaagaagttacgaaatcgaaacgtactttatctcgtcacatgcattttccgccttccgagctcaagcgaggggaaaatagagttcgagcattctttagttggttttttggactaaggcaaaaaagttcgaaaaccgccgtcctcctcacctttcgaaggagtgacgaggtcgaaacgtattttacctcgtcacgcggattttccgctttttgagctcgaacgagaatagagttcgagcattcctgagctggttttaggactagggcaaaatagttcgaaaaccgccgtcctcctcacccttcggaggagtgacgaggtcgaaacgtattttacctcgtcacgcggattttccgctttttgagctcgaacgagaatagagttcgagcattcctgagctggttttaggactagggcaaaatagttcgaaaaccgccatcctcctcacctttcggaggagtgacgaggtcgaaacgtattttatctcgtcacgcggattttccgctttttgagctcgaacgagaatagagttcgagcattcctgagctggttttaggactaaggcaaaatagttcgaagaccgccgtcctcctgtcgaaatttgctagtcgaatgtatttgactccgagcgtgcggagttctattttgtcgactttgctagtcgaatgtatttgactccgagcgtgcggagttctattttgtcgactttgctagtcgaatgtatttgactccgagcatgcggagttctattttgtcgactttgctagtcgaatgtatttgactccgagcgtgcggagttttattttgtcgactttgttagtcgaatgtatttgactcctagcgtgaggagttatattttgtcgactttcttagtcgaatgtatttgactccgagcgtgcggaggtctattttgtcgactttgctaatcgaatgtatttgactccgagcgtgcggag

SEQ ID NO: 72530 - DNA, 3947 bp, Oryza sativa
tgcgggcttatttgtagtggggtgggtgagaggcctccgtggctaggtgcacccgagggggagaacggattttttttttcaactctgagcatgagcaggaccctatcccgtcgaagtcacgtgactttgtcactgacatgtggtgtggccctgatgaaaacaccatgcatttgactgcagaggatctcaagtcatgtcagctacgttcggtgttaaggtaactttgggcctattcggctgccctagctgcggctgcggcgcagccggcacgaacagtttcgcactcactgtacgcagctgcagccgcagcagttggcctaccgaacaggccctttgttacttttagatttcaacgtttaactgcctactactccatataaaaaaagttgattatcatatctaagagcggaaaatagttacatgttccttcgacatcagcggagcgagagaaacactattgtttaccgtgcaggtgtttcctaagcctgctaaacggtgtgttataagttgtttttaaaaattatattgatccatttttcacatttaaaatagttaatactaaattaatcatacgctaatgactaatctcattttgtgtatcttctcttttcctctcctctcaaacacatctatgtttggttactgctataatttgccaaacatttcaggttttttagagcttaggttctgacaatgcatggtttgtaactctgaatatcacatggcttactccttctttttccaaacctagtagtaagaacttgtggacacacctgaccttagctgaacatctgatgtgttggcgattggtgttgcgaaatgtagtattgaacccaatttaagctaaataatacttaagtgggttgttagttgttacttgttagttatacacatctacccatttaaccaaacattgctgaacaattttgagtccattgctggttgccacatttttttgacatggcacaaccttcccacaattcacctaatcttttgcaaaattgtaccttacgataaattattggccatgtcttaatcaaggtttggcaaagacttacatgatagtatttgatagtgagagatttaagaccgaccgagactcaagggagctagatggtagctatacacatccatagattttataaactaagttaggatcaataatatgatgtatgcacacagttacactgtaaagttgcaaccgccgcacatgacatttttttttatagaagggtttttttttaccgctcacatatgtataggcaataaaataattgtgatcttttatgttgtgtgagtttttcttagtttgtgtgtgcttttatttattcaggtgtgagtttttgttgaattggtgttataattggatgtagctatttgagcaaaggccgggattatattccattattaaaaaaatatgtataggcagtaaaatgtgaagttgatgttgaaaatgagaatgataaaatctgaactattggttctaaattctggtcttacatttctttgttagtattgaggtagtcgcaatttggcagtattataaacaaaattagtttattctactttcatatcttattttcagtttatgacgataatctacacatggcactatataacttatttcatattaaactagtcacagagtggcgcgttgcgcaacaataaatatccacatataagtgttaacacgtgctcgtaaattattttgtgagtacatctgcactatttaatactcccttgttacataatataagagattttatccttactaattatcccacaatataacaatttatttgagaaataatataagagattttggtgtagtacttatcacttctatcaattcaaatccattttctacctattacacataactacccattcacccacaaccaattttatttaatagggataatttaatttgcgatccatattttaaaaattatatattatattatgagaggggtattttagagaagtagaaatcagagttacatcattttgttgcataatattaggatatagggggtgtttacacctagggatgtaaagatttggggtgacacgtcgggtattatatagagatgtcgcatgaggcgttagggcactaataaaaaaaactagtacagaatccggtcagtaaaccatgaggtgaatttattaagccctaattaatctgtccttagcaaatgtttactgtagcaccacattgtcaaatcatggatcaattaggcttaaaagattcgtctcgtaaattagtcataatatgtataattagttatttttcagactatatttaatacttcatacaggtgttcaaacgttcgatgtgatagggtgtaaaatttttgtgtgggatctaaacagggccatagtcattcaagtgcttgttgttggtgcatatcacacaccattctctagatcactatatattcaaacaacataataaactattatcacgatatactaagtactttttaggcatgttttttctgctgaatggaatgtaaatgatatattaagataacataatgtttaatacaaatatttaagtacaaatgcaacactttagtaattaatcaaataatttatttttgcaagtgtgtactctttctggattttaacgtacaacaccgctaatttttagacatacttttgactattcatcttatttaaaagttgtgtaaatatgaaatatacataaaaatacctctaataaaataaatactaacaaaataaatgataaataataaaataaatactaacaaaataaatgataattatgtgattttgttaaatacatctttaaaaatcaagagcatcatgtattaaaaaccaaaaccgaagacaacatatcgaagttccttgttttagtaaatacattttgtatttttacttgaactatgctattgatttttttctctatcattgacagtgtgcattgtagttttgaggctttttgttttgttcatttgaatagaactaagaatccaacggttcattttgcttgctgcctacatctgatggtggtcgttttgtagcctacgtggctcaatgaggatgagagaaagattaattctttcactactttagatattttccctatagtgcaggaaataccataaataggctaattgtagtcggccacaccaggacttcacaaagcaccaataggggttttcagaagacagaaattggtgttgtaggcttgtagtggcaacagcttaggatgcgttcgttcgttagagctaggaaagttcacctctagcaccgaaaaaagagcagttcattagcatatgattaattaattagtattagtcaaaaaaaaaacttggaaatggcttggtttggatttttttaaagccaccttttcttagaatttttttttaaaaaaatttcccgtttacctgttaaaaaaacgtgcgcccggaaaatgaggaagcggagttgggaacactcggtgccgaactcagccttaataccctcttcatcccataatataattaacgtgtgcatatattttaagattcaacattaaaaatatttggccaatggttagtataatatcattacattttattttttttaaaataatatcattggattcacatttaaatttacttttagatagttataattttggtgtaacaatccatatagtatatgagaaatataagtcaaagattctagtatatatgaaaaaaaaagtcaaatattagttttgaaaattgtacaagtttgatcatgcctatattatattaggatggtaggagtatcaaggttgatgttcggttggtattattggacggagtgactcattagcgcatgattaattaagtattagctatttttttaaaaaaataaattattaaatatgaattatgaagcaactttcagatagaattttctttgaaaaaaatacactgtttaatagtttgaaa

SEQ ID NO: 72531 - DNA, 5552 bp, Oryza sativa
agcacttcttgttgagcccacttttatgcatgcttagatcttatacgggattgactatatatcagtcaactaaaattttaataaccctgtatctaccgtgagccgttggatcgacacctaacaaattcatgatatacatggtttatcttctccaatgagacatgttatattttttttcatcttcttacttcgaatgaacttccatgaaaccatgactcaccggtgtcatctagcctacctcatctccggcggctcacttcacctaatacataggtacctccctccgcctcatggtcactccatttcgctcaacccctgcgactagctaatctaccaaaactatgtactgctgccacctagctgcaccacccgactaccacacatcaccgaccgcccgaaccaccactcccctccccgaccatccctctaagcttcagaacacccctctccccggcccatagccacactcacactaaccctcatcccgaatcctaatctagcgatgccgacatcctctcatcatatactaacgtttacattgtaatgaaagtggaatgatggggacattggtgttgttgttattagtgaaaaaaaagagagataaaagccggaggagagttgaagaaaaggtagaatacaactcacaatgatcggattttagtccaatggtaaatacaaggtgacactgtgaatagtttactgtgatacaaatttataacttattaaaaatgccatgatttatcttccattatagggcaacattttcgagtttttattctaataattctatttcaaatttattctagcgagatggcttattgtaagggtcagcgaattgctcttctatctgttcagtttgctttaggcttgatgatttgatccttaatccttcttccgaggccatttatactcgaagaaataatcatggaatcctttgatatagttttggtcgaggtcgagtaggtcatcaggattttgccaaagttgattttttttaattcagaatcctatcctcgttatacgtatgtgggtgaggatcctctaccataatgccactgccattacggccagtgatgcgtggatcccaccgtcctattgccccacatgtcaatctctacgtacacatattgggtatgatatatgtggactagcacatccatacatctatggaatatctcatactcccttcgtctcataatataagtatttttggagttagaaacgattattaagaaagcatgtagaattaaatgaatgagggttgtgattagataagaagtgaggtagatggaaaaattgaatagcggagggttgtgactagttgtgaagagaatattggtaaataaattgttatattttgaaataaattctaaaagagttgttatattttgggacggagggagtattatacagtacaccgacaaccatttgaagacaaaaaaaaatactggtgtggaaatggtttgaacatatttttttcagacttttttttcccgctggacatagaggagcaagttcgccgcacatatcctaaccagaaagagaaaaaaaaaagatcggacggtcgctccagcagcaagatagattgtgcgtcgacatgcatgattcatggcaatgatagtgaaccccagaatttagtacagccggagatcgatgagctcacaaccttatctcatctaatcatgatttgattttttgattagttagttttagtggccaccgcgtcggctcgcaggacaggacaaggacggacagtgctgagcaaaatggcagctgcctataaaccaactgcggcagattgtttacgacgcattacatttgttagcccatccatttaattatactattattatcgaacgcacacactgcacgcacccatccttttgctgcgatccgccaatggccaccaccaaatttgcaagattctgcagatcttgtcgctaccagggccaggatgtatgtttctttaagaagggtattatttcctcgacatttacatccaactggatatatacaatcatttaaattgagaactttgtttaaccaaatatgaaattcgctcctataaattaggaacctagtcccgcaaacaatctaatctgaaattcactcctatgaagatttaaactcagaatcttatgatgctattcagatcactgcaaccaatagattacatgctctttttgcattgttactgctgctgctgcttattgccaatcattttatttggtggagaagaggaggacggatcggatttctctccttatctccacttgcagtactcaaaagaaagtctgatgaagcgtttgcgagtgtgtgtgtatgtgttggtagtgtttgtctggatcttgagacagaaatgcttttgcatgatcgatatggcgtcggtttcggcagcactgttgaggcacgaacggcttcgtttctccgagaaaagtcgttctggatttcagtgggtactaggctgctttctggcgacgtgatttgtcgtctccaattatccagagagagagagagagagagagagagaaagcaagtagaggtcatgtttgctcttccgaattgttcttgttgctgttccgcggctgcacgagagcttgacgcctcaacgaccaccttgttctcatgatcctcccattcatctttgattttaaaattttaaggagtgactacactacatatgcaggtggttggtagtcagtttttaaaattttgaaaaagttaaaaaaaatccaaagctcttgacttctagttttctgaattgcttgagaaagctagatattttgaaaaaaaaatttgcaggtgcgagaagttagtttagtggttgtgacctaagtagtacctcaagatactgagttcaaatctttatataaaagaattttagattaggttgtttgagggacaaaattcccaatttaaaaagaccgcatacatctgttttgatgcaaaagttgggtaaaaaaataccattctctaaaaagagaagttaaaaccaaagctttcatatccaaattctgcaaatcaagttcaaatagggttcaaagttgcgaaaggacctgtaacctagtggttacaagagtctcagtagcatctgaggtcctaggttcgactccccgtgaaagcggatttttcaagatttaacgacgttgtgctttaataaaaaaaatagggttcaaagttaaatccactaacacttcgggatttgactgaacagatggaccgccggccaaacgaacaaacccaccactcccactgtcccacgcaacgaactgaagctcatgcgatcaaaaattcaaggaataagtccacatagactcccttaaaagtgacccaaatctaatatgtaaccctcaaccgcaaaaccggataggataggatgactcccgaactactgaaatcagtgcaatttgactccctcagtggttttgctgatgtggtgctgacgtggaaatattgacctagttttcgtcacacgtggcgcttacgtggcattacaattaaaaaaatatatgtgggacccatctgtgattcacacaaaaatatattgtggtccccactgacatgtgaggcccacatgtcatcctctctctctctttcttcctcctccctctctcccccttttctctccaccttctctctcgtggagcaatagacgggcaggggtagcgacagcgggcgggagctggagcggcggcggccggcaatgaccggagcggcagcggcggcaggcgggctcgacgaagcgggacttgagcttggtgagcgacgaccggcggtggagtagcgcggcaacgacagcggacgcaatcccgtcgcgccgcggccgcccatgcgacaagaggaacgccgtgccgggggagaaaggggagggaggagaaagagatgcggatgcaggggagtgggtgggtcttcctcgccggccgaccggtcaagggcgtcgagggctccgccttcgtccatggcgcttggattagggcgcggcggactccctcaaatataggtcaagctgcagtttcactaattcacaacttccaccgcctctacctcgccacgagcacgagccaccaccacccctcgccgacatcgcttcgtcctcgtcacaggagccgttggcttcgtcggctgccacgcaactgccgccctgcaaatcacaacactactaaaatctgaactctgaattcctgaatgcccagttgtttggtcttcacaaatgctcctatatatacaagacaattactaccgcaagaacacagaattagatcggttttgcagtagcacacacaatgatccaaggaaaatggattaacatcaatggcagtcgttttcagcacgcggaactcaggaggcagatcggcaaggcgatcgtcgtcgtgagtagtctgaagctctgaaacgaactaatcgacgagcggcacatacaggagaagataatcggtggagagagatctcatgagctgttgctatcgcattcaagcgccatgaccagtacgccgttgctatcggttttggggaggctttgcaacctccggcaacggcgtcgtcggcgtcaacagcggtggcggcgcagtcggaaatcctcctcggggtggcgctcccggacgacatcgccttcctggctggaggtggagcacggcgatgggatcggggcggccaccgcttcagctcccgccggctgccaccactccggcccccgcccgccgccgctccagcctgtgctccccgcagccggccgagagaaaggaagaggggaggaagaagaaagagagagaggatgacatgtggggcccactgacatgtgggccccacaatttttatgtgtgaatgataaacgggtcccacgtatacgtttttaattcaaatgccaccaaagcgccacatcaaccccacagattaggtcaacaatgtcacgtcagcgaaaccaccctccaaaaccaccaagggagtcaaattgtaccggtttcaatagttcgagggtcaggatatccggttttgcagtttaggatcatggattagattcgggtcatttttaagggagtaaaagtggacttgttccaaaattcaaaatggacagttttttttaggaataagttcacttggtgaccctcaaaagtgattgaaatttaatccgtaaccctaaaccataaaaccggatatcttaacccccaaactatggaaatcggtgcaatttgactccctcagcggttttggaggtcggtttcgctgacgtggcggtattgaccgggtcttctttacacgtggtgttgacgtggcatttagctggcatttagaattaaaaaatatgtgtgggacccatttgtcaatgacacagaaaatagattgtgggacccacatgtcccttctctctcccctccctcagttccctctctctcctcgtcgttccctctctctctcccgcagcaggcggagacggaggtgcggcgacctgcgagcggcggcggcacccgggctgagctccaccacggcgaagacggaggagaccacagcggcagcggcgggaggcacacgcggcggggtacagcgagctcggccca

SEQ ID NO: 72532 - DNA, 25174 bp, Oryza sativa
ggcccacccaaccgtacggcactgtggcgacccccggatgtgccgtgagttcgcaatcaacgagtcctcctgcgtaataattcacgatgtaatttggacagaacaagcaaagctgcacgtactccattcgtcccgtataaatcaaatctactaggacagtacagcactccctccgtcctaaaataaatatattttacattgttcatatttatatatgtttgactatttgttttattgataatcttttataattaatatttttattgttattagataataaaacatgaatggtactttatgcgtgactactttttctaatttttcaaataagatgaacggtccaacgttggacacagataccaacggctgcacttattttgggacagaggtagtactaagagcaactttaatagtatatctaacaaccgggctccaaatcatttgtagtcattttataggcaattcatacaatagttacctattaacatatactggaccatttataagttttacctgtcaaacacacatgcattttagagtccatgctaaagttggctataaatctgtagccctctactcttttctctccttttttacctcctcaaaatatgtttataactggcttataagctgctaccgtcagcagcgcgacatgcacaataaaacatgtattgtggtgcacggtgaatggcaattaattaagccgatgactgctgccgtaccccccaccctcccgactaaaaaacctaaactagaatttggatggatgataatctaatacaacgaattcgacatgtataatccaaatccaaatcctaggttagttttttttaatggagttttttttaattggacatctagctagggatgaaaacggtcggaaacgatacattattttattatttttttcgaaaacggacgaaaacggtcgggaaattttcatacttatgaattcatctatttagtgtcaatttcaatgccacgctgacagaaattaaaaacactaaattttgaaaacgataaccatcgctaaaaatattattattattatatagttttacggaaacggtgtatatacggtccgaaaatttttataccgttttcaccctgcagccttgatgttaccagtcacttgacttaatggctggcaggcaggcttatcacttgagtcgacgtacagccccatgatcaacagttcaaccttagtactccaaagaagtttattttgacttctttatgtaaatctaaaataatttttatttttatcaattattacatgagagtttgtaaaaataaaaaataaatatattgagagtagataaagtagaaaataattatattgagatttatccaatttaatataatcattataactaaatactctatgtcctattaaaaaacaacttccggggatgaacctggataagcatttatccagatccatccctacaagttttttttcattttttttcttggacggagggtgtaactcagaggattatattttgctcaaagaaatatgcatgtttcaatagcaaaatttcggttactaaaaatcaaaattcggttttttgcaatcatggaggttggagacttaaaaaaaaccctgtaaaacaaggcaactaagagagattttgctttaatttaagctcgcaacaagcagccaaagaataatggcactagcaggtacctctcctaggccaaaataagttgatttgtatattagttaaagtttatctagctcaattggttgtttgtcagatttcttgtggtgaaaccagtccaaatagatgcaagacctaaacttgataagagtgttcgttaattagttttttcagtagtcactattacataacatctaataagggacatctcatatatgacttataggtgtcagttgggagacataaccgacatcaatgttacttaagaggcccgcatataaaaatctattttcgcaaatagacctctaaatacacctgtatacaaaaacaagcctattttcgtagacggaacttttaagcagccacatgagaaaatgcattttcacatgcaggcctctcaaagccccacctacaagtctgacctttgtcctctcttccctctccactctcagcgccttcaaaatgtttaagtctcatccttatctcctcaccttctctccctcacctttaatttttccgtagtcttatttcctctctctctctctctctgtcacactccaatccggcaccgccgtacaacggcacctgacaggagcgtgtcgtaggaaaaacggcgcgaaccgcttcctacgaaaccgcaattatagtaccagtcccaggacatagtgctggtacccacggtgacaaatatgaatcattgcaatccttaaaataaataaaggacttatttaccttaacttatgttgtagcttagaacagcccgagaatgcaaccgacgatgcggacgaggaaaacaccaacagcagcagcagcagcggaaccaacggactaacacccaacaccacaggcgatggctgggaaccaggacgaaaccctaatcttcacttcacgatggaggaactatatatatatatatatatatatatatatatatatatatatatatatatatttatatagagcaagggtgagtactttcgtactcagcaagtcacgggaatcaggtgtttaatgcaagcttggaagagaggcaagattgttttacaaatcctttgtttgaaatcattttgaaatcactaagtgatttatttctttctaagtttgggtcgaaaaggagacttgcgtctcgattcgacttaagagatgctgttcaacaactcaattggtaatgtattgacctcccgggtcaaatcattacttcctggctcccagagccatttcacttgattaagcggctcccagagcctttttcattttctcggactcccagagtccagctgcccagcagcacaacaatccgcttccactcgggaagcctaatctatgatgcccgcaaacattccgaatcacacagattcgtttctgaccactcaggtcatccatctgccatgtaggctgattctggtgacgattcccaatccacaacaacttttcataaagcacaggcaaacaaatctacgcaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaagcatcaaatcctcacataaatataggccattttagttttcacaaatcaaactccaaccacctcgatcggtaatctggcaagcttcgcgttcttgccttaccaggaacccgggttggctccaaccgaccccgccccggcgttcccaactattggcatgcgaggtttccctgaaccgactagttacttagctagggtgtcccataccaccttgtggttgcactttgttatacttgatgagtttcccacaggaatcggtccttatatgcgaatacgggacaacgccatgcaggcaccacccccacatcgcgagttttcataattcatttatttttaaacacaccgacaccacatgtcgggttttcaaggcttctcaaacccatttcccaatttttcgacagtcaacggtgtatgtgggatatttggtatacgcgctcagagagcacggatacggaagtaccacaagggtggagcggcaaggaatcagggtagtacaatctacaggaattagtgcgactactgggtaggtccgtcggtttggcacgcaaaccgaggccaagcaaattaagtgtgtgattctaataatgcaagttacaaacaaaataataatgattttccaattatatgagcaattggtcaaagggtgacttgccttgctcaagatcttcacgaagcttcatgaatctacgagaaatccctgatcgacgaaaatccggtaaccgcggctatacgcaaacagtcaaaacctaaatgaaagactaaaagaaagaccctatttagactaattaatagtgccattaaatagatctcaattttacaggagtactggaagttgacggagtcaatcggagctacggattgagagatatgaattttggaagctcgaatgggattttctggactaggaaatgatttatctgaattttctggaatgaaaggaatggtttatggaatttatagaaataatattctcaagaatattattgacagtcactgacgtgcggggccaagggaaatgatttatggagcaaaggaaaaaggaattgatttatgaaaaagggaaaaaggatttattaaatcctttttggaaaagaaaagaaggatggatgtgatttagacttgggccgagcgaagggggcggggcccaggacatttgcggcgcggctgaggaaagtgggccggcgcacgggtgaggcggtccaaggccgggcgcggcccgcgtgagagggagccgaccgggcggaccgcggtccaccacgcgggatccggggcgggcccgcttgtcagcggctcggctcaccgatggcggggtgcatgcgagcgggacgctagggttagggggaggggcgcggtgcgcggtggacgcgggtgcggcgggcccacgcgcagcctctcggctcgcggtggaccgcgcgcgcgcgagcgggagtggagggaggcggctgaccggggtcagcccgacccaatccacgccgaggtggcgccaacgtggcgccttcgtggctgccatgcgggccggcgagaggaggaagacgaggccggccggaaaatggacggcgggcggcggccgacttcaccggaagcactacgcggcgattcgatcgagagggagtttaccgtacaagggggagcacggcaggggatgagccaacggctcggattcttcgaaaaggggccggcgacgacgaatcgcggcggcgcacgccggcggcaagaaaagggggaaacggcggaggggcgatgaggattcaattcaaggaggtgggagcatctccggggttcaaggagcccatttccggcgtcggatggggtggaagagcaccgaggagggccagcgacgagcggcggcctccgggagcgggcggcaacggcggcgaggccatgccgggcggcggcggggctaggggcagcgtctacgtgcgttcgagagtctagctgagctaccacgcgagccaaggaggggcgagggcgagcgagaaaaaggaacgggaggaaggcactaccgagccgggcgggcagtgatgggcggtcgacggcgcgtggcgagctctccagccttggacctgggaaggggaagaagaggtgcctggagtcctcgtctcgcgtccccgcacgcaccggtttccctagtgcttcggcgacggacggtgagggcgactgtagggcaggggcggcaacaatggcgcggtggtggcgacgagggaaaacgaatgagggagatggggcgactgctgttttataggcgcggggtggggcatcgaggagaaggaactgacattggggcggtcaaggggagcgagctggcggtcgtgctcggagctagcggccaaacagcagtggaggtgcggtggctgaggttggaaaaagagaaaaagaagggggaaagaggagcttgaccatgccgtttcggggagggagagaagcgggagcgagagctctggctcctggttttggacgggtgcgggtggagcggcttgggcacgcgctgcagagctccatggaacgccatggataggtaggtaggtcaatcgatggacatacatatagttggatttgagaaaccgatagttagttcgagtaggttgatagagcgataggtagataggtcgatggatagatagatagatgggtagatggttagataggttagataagcggatagatcgatcgatggacagggaaggattcaaggacggatttgacattctcggaatccggagaagtattggcaaggaattcaaggacaggattgaattccggtgtttgatttcggaagttgaatcggaattggaatcttcaggtggaggattttgatggcgatgagagggaacaacaggatttgaattgagatccagggcatgacttagactcacactcaaagaacgaaaattttcgcaattaggattttctcaaactagtttttaacgtctcacgaaaagcggagcgttacagatccaccccccttacaagaatcttgaccccaagatttgaaggtggaccacacacacgaaaccaaaaaggggatcttcagacttcatctcagcttcatactctgttggtctttcttcatctcatggttgcacactagccacaaaacgatctggtactctcactcacttaacatgcttcatcttactgtgggtttgtttcttcctgcggattctgttcttcagcttgctcgagattcataacttttccttttgtttccacttgcacatggttcagatgactttgtccaacaggcggtgaggttagcgagacagatccactgtttggtgactttgagctttttggtccgggtacgctagggaggctcgctgttggttgaacttgctttgacttgactttctgagggcagtaccatgaatagtgtcccatctcatggcagatgaaacattcgactcctgccttatgaccacgtcttttcggaggtggagggcatgacacggagttacttccttcaaggcttttactgttgatcactgtggtttgctgactagattctgacattgtcgagcgagacgtagaaccgaaaccattggaatactgaaatactctctgatagtactgtgctggcgagtttgttttttttgacacaaaccttcttttgcttgaatctctaaggatattactttgcgtctcttctattcttgcatctcttattctgcatcttctagtaacaaggacttatcgaccatttgctgaaacatcgagaagtcgtgagccaaaagtttcactcgcagtttcgcatccattccttttaaaaatcttctgatcttctttttatcagtgtctgcatcttctagggcatatcgggccaatctgttgaagcgactcaaatactcgttgataccagaggatccttgcctgatatttgcaaattcttccttcttcaaatcaattatgctttcaaggatgtgtgctgagcgaaagacttatgcaaattctgcccagacgatggtaccagcatctgtatggttagcacaatagttatcccaccaatctgcggtaggtcctctcaactgatgagcagcgtaaagggtcttctcatacggagtacactgtaccagatttaatctcctttccacatctttgatccaatcgtcaccttcaataggctcagttgtttgagagaactccggcggacgtgatgtcaagaaatcattcagttttgatcgcccattatcttgaaccatatggggttgacgctcttgtgtgtgttgttgttgcatagcaattatattctgaatcattccttgtaatatctgagtttgcatggctaggatttggtgaaggtccatgggtgggggttgattacctcttgcattattaactgattcggaagcaaccgtatgatcactctcagcttcttgctcatctgcttggttaactggttgatcgggaatctctgactgaactggctcttcttcaaaaccaaagcgattaggagcacgggtttgacgggtagaacgacgagccatctacttcaaagcgactgagatctgaccgaaccagaaatgggataagaaaaggaggaaaacaaaaacactagatcaaaacgtttttcgaaatcgcagaagacataggtggtgtattccagccggtaacccaactggtctaacacctgaacacgggctaccaaacaaaactcacacacgcactagttcaccacaactcctaccgagcgggtgacggagctagggttgcctaccaacaagggcttaactaagacgcctagaggcttgagcacacctttcttcaactgggcgtgaagacaggtttactctaggataacatgtcaaaacaaacgactagcttctacttttggacacaaaaacatttttcgcaaaactagagctaaaggggacaacgacaccttagctttcacaaatagtttttgtactcaattaatgccatcctattcaggggtttcgatcctagggccaactaatgctctgataccatctctgtcacaccccgatccggcaccgccgtacaacggcacctgacaggagcgtgtcgtaggaaaaacggcgtgaaccgcttcctacgaaaccgcgattacagtaccagtcccaggacatagtgctggtacccacggtgacaaatatgaatcattgcaatccttaaaataaataaatgacttatttaccttaacttaggttgtagctcagaacagcccgagaatgcaaccgacgacgcggacgaggaaaacaccaacagcagcagcagcagcggaaccaacggactaacacccaacaccacaggcgacggctgggaaccaggacgaaaccctaatcttcacttcacatcatcttcacttcacgacggaggaactatatatatatttatatagagaaagggtgagtactttcgtactcagcaagtcacgggaattaggtgtttaatgcaagcttggaagagaggtaaggttgttttacaaatcctttgtttgaaatcatttagaaatcactaagtgatttatttctttctaagtttgggtcgaaaaggagacttgcgtcttgattcgacttaagagatgcttttcaacaactcaattggtaatgtattgacctcccgggtcaaatcattacttcccggctcccagagccatttcacttgattaagcggctcccagagcctttttcattttctcggactcctagagtccagctgcccagcagcacaacaatccgcttccactcgggaagcctaatctatgatgcccccaaacatcctgaatcacacagattcgtttctgaccactcaggtcatccatctgccacgtaggctgattctggtgacaattcccaatccacaacaacttttcataaagcacaggcaaacagatctacgtaacgggaaccacctcacatccgcccatgaccgtgggcacggctgttagaatagttagttaacctctgcagaggggcacactttacccacaagatacgaacttacttcgaacacccgtctgtatcggaggttcgcaacaaagcctttcccaagccgacccagggttacctcatgccacatagaaggatcaaatcctcacataaatataggccatttagttttcacaaatcaaactccaaccacctcgatcggtaatctggcaagcttcgcgttcttgccttaccaggaacccgggttggctccaaccgaccccacccccgcgttcccaactattggcatgcgaggtttccctgaaccgactagttacttagctagggtgtcccataccaccttgtggttgcactttgttatgcttgatgagtttcccacaggaatcgatccttatatgcgaatacgggacaacgccacgcaggcacaacccccgtatcgcgagttttcataattcatttattttcaaacacaccgaatacggggcgactgctgttttataggcgcggggtggggcgtcgaggagaaggaaccggcattggggcgatcaaggggagcgagctggcggttgtgctcggagctagcggccaaacggcagtggaggtgcggtggctgaggttggaaaaagagaaaaagaagggggaaagaggagcttgatcatgtcgtttcggggagggagagaagcgggagcgagagctctggctcccggttttggacgggcgcgggtggagcggcttgggcacgcgctgcagagctcgcggcaggcagcggggctgagcggcagggcggcatgggcggctgcgcggcgcagccggccagggcggacgcggcggcgaccgggcagtcgaccgcgcgcgagcgcgcgcgcgaaggcgagttcaaacggcggtggcgggagggagttcgacaagagggagggagagagaaacagagagaacgagcgacgctccctctcgactccgacagcgtgcaacgcacgtggtgggggaagagatgatgggctgggaggggagatgggccgtgggaggaaatccggtccacaaaacttgagggaggtaaaatagacttttccagagaatttgatttggagaatttgagtaggattttggaattgcaaaccttgaaattttaatttggtgaaatgtgaggaagccaaggatgggattcaaagcgggatttatatatatttcttttgaaatatatttgtatctagcgactccggggattatttgagagggattccaaaggaagggaaaatcaatattcgaagatggatcaaagggagatagcgatggaacgccatggataggtaggtaggtcaatcgatggacatacatatagttggatttgagaaactgatagttagatcgagtaggtagatagagcgataggtagataggtcgatggatagatagatagatgggtagatggttagataggttagataagcggatagatcgattgatggacatcgagggattcaaggacggatttgacattctccgaatccggagaagtattggcaaggaattcaaggacgggattgaattccggtgtttgatttcggaagttgaatcggaattggaatcttcaggtggaggattttgatggcgatgagagggaataacaggatttgaattgagatccagggcatgacttagactcacactcaaagaacgaaaattttcgcaattaggattttctcaaactagtttttaacgtctcacgaaaagcggagcgttacactctctctcccccactcacttttctctcccacctctcccctcctctcccatttttccactcctcacatcccgacggtgggctcgagttggcgacgacgggagcgggagagcagtggtgggctcgtgcgggcgcggcagatcctgtgggagcgcgacggcgggtgcagcgacggcaacggcgaatccggcggtatggagggcgacgacggctgccttggcaaggtcgggggatggcgatgccaatgaggagaggcggtaaatgggattgttggaattttttttcacgatttttattttcgtgtgcggactacataagcaccggcacacaaaaatccgattttcccgtgtgggtgcgtcacccacatggaaaaatgggttttgaccgcatgcaaaaatgttttttttatgtagtgttcctaaatacttcttcatgtgattttgaggatagattgctacctaatgatttaattatgataagaaactatggagaatactagcgagagagaggttaggagatggataaggtcacacaggcgttcaagtcaagttggagacccaactcatatcaagttcgagtctacctcggctccaagagtagtctgtgctaaaaacatcgcctaggtcatgttcggactccattttagacgttctacctatgtatggaaaactaacaagaccacctttccgatgggtttggtcttccttcgaagtcattggggatcgtcaaaacaagtggtgtccagaatctgtccgagtgctgtgtcaccatctttttgtaccgttgggccatgtatcgtgttggagtccaacagggacgcatccaggggtttttgatcgaccgtagaacctatatattcagtagttgttgtcgagttagggttgggttttgcttagattatttttgcaattgcagtttcaccgttcatcggtttgtgaaaccccgacatcaagttcttaatcaatcctctacatttgtgttgcaatattcttattcttgcttgtgtcttcgattcgcacgcaaggatagccttctcggcgaggtcaatcgggtttggcatggttaataaccagaggagacgtggtgctgctattacatggttcatattatgttaatcgaaagtcggatcgtgtgtgccaagattttgccaattcgatagatctctacttgacggaagattgggcaccccattatcattataaacttttcccaaattactttttgaacaaaggatagaaacaccattgaatctatgaaattcctttacaatattttttgctgatccatgtggaaattttggaggaaagtcacgaggccgcccggttcaacctcctgaaaaatgttttcctttgactttattaatttcttgattcctgcatctatctgcggtctatgtatcatgtatttttcttgtattttgtacttctttgtttttttcttattcatatattttatccctgtgttcgacatgggcaattcttgataaaaaaaatgcatatgaattttctttgaagcaattctacagaggactttgaaagcctcatgctagatcaattcctcaagaacattgtggagaaatgttattcctatgctatgaattttatttaaaatggttgtctatatccacgtagatgcatgtagaaactggtgggtttttaatccaagcagttttaatccacgagttttcttccaagcagttatacaaattaaattactcgcatataagaattatttttcattgtattcccctagtctttctcacaagccacaaaatgcttcaacccaaaattgggtgatccgatcccctctaaatcgacatgggctgtttgcatgttgatccatcatgaataatcacattctaaaccattcgcggttataaacaaccctacttcgtttttgaaaacaacacatccaaattaatcgaaaaaaaaatccaatcatacaataatgtgtttttcctataccccatttatgacacaggcgagttgaaagtagaacccgcctgtgtaaacattggccaagggatggaccaatgggccacctgtgaagaactaacttagaacacacaaacacatagatctacaacaaattatgaattatatcgagcaaaacctctgccccttagttggtcgagcaaaaacaaagcccctctctattcttcccaattgagctggggtgtgagagggaacgtgcatatatattatggacctagttttcccgattgagctgttggttatgtaatagatccaacacctgtaagctcataaatatagccgtgccagggctacttcataccggttcataactaatattggcatatataagtcgtgcaagactattcaaggcccttatatatgtggaagaggttatggaatcgaatccctcacatgtatgtgatctgtgatttttttttctttcctcgcttgcatgaaacttaaagcaaatctaatagtttaaaattacgtgaaagttatatataaattacaatgtaattgtattataattgtactatatttacatctattaagtttttaagaggaaatttgtagataaatatgtaacaaaatgttacaccgttattagctcatgggcaccaaaaaaatcttgtggttatgtcatccgcagaaggctccatcgtcgtgtgtctttgatgtttgtaccaatcaattaaactagatgattcccgcgtgtgtttttctacgagatatataaataaatatatgttaaatgttgtataatcatgaatagaattggagtgaaatattttaaaaatgatttgaagataataattactatgatgtggtatgtttgcatgctagcttttagaattaataataaatactatgcttacctattgaattttagatgtttagtgggtcgtaactttatagaacgtagaacatatagataaccggtatcctaattaagttcaagttcaacatgtcatcaagagtatatatatattcattaaggtacgtggaattatacttcctccatttctgaatagataatgttgttaacttttagacgtatatttgactattcatcttatctaaaaaatttattgtatccatctcatagaaaacaaacttagtactagaaagcgtcgatatagtctatactagttatttatgggagtgtgagctagtatgtaattataatttattttgttgtgagctttttatcgctaaaagcactttacacatgatttatttcttagatatttgcgaatggttaaatgtgtatgaaaagtttacatagtcagctattgaaaacggaggaattatgggcttgtttagatcattgatagaatttttcaccctgtcacatcgaatgtttggatgtatgtatggagtattaaatataaaaaaactaattacacagattacgtgtaaattgcgagacggatcttttaagcctaattgctccatgatttgataatgtggtgctatagtaaacattttctaataacagactaattaggcttaataaattcgtttcgctgtttataagaggaatctgtaatttatcctgttattagtctatatttaatacttcaaatatgtgtctgtatactcgatgcgacacgccaaaactttacaccacttactccctcggtaagaaaaaactcaaacctatgactgattatgtcatatcacattcctaggttaatttttttttaacgaagtgagtatgtttttacgctgacttctaaaaagtgagacgcctgcgtacggcctgacggtagtacaagtactcgatagaaccgtcgatcgtaaattattgaagagtgaagaaaaaccccgtgcactgcaattaattgtcgtgcatccctccctgccattgcacgttgccacagcagatggtccggtcggtccacctcccctccattggtgaatgacaagggcacgttggtgggtgaagtgaactgagtttatcgtaattatttgagggcataaaaagataaattaaatatcacttgaaaattaatgattttgatttaagaaaagttttaaaaggaaattctaatgaacaaacttttttttaaaaaagtatattatttagaagcttaaaaatggtgactccgataatacgctagctagctattcccttaaaaaatgccctattatttgatgttcaacttgaagcatgcaagatatgcgggccgggcccaccaaggcgtgctaggaagaaaaagcatacaggtctggttccactgcagtaatgcagaagttcactaatagtgaacctttacattactgaggggatctggattttaagcgcactttattacattagataatatactcctccgtttcattttaaacgtagctattagttttcatgtccaaatttcatcgtctattttatttaaaattcttttatgattattattgttgttgttattagatgataaaatatgaatatatatttttttaaaaaaaaattaataagacagacgattaaaattggacacgaaaacttattgttgtgtttaaaatagggcggagggagtatatcgcaaaccgatctatcgtcggcggaaccagaatcagccgtacagataagtggcgctggtcctggtgacacgtaaacgaatatcgtggagaggcacatccatgggccatgccacgtaccgtcccgtacatgcatgtgcacctctggcgacattgtgggcacctcctggctcagaaacggaacatgctatactcgatcgatgacaattaataacgtgtggggggaagaaacgtgttacctctaattttaaatagtgaatttttactctctaaacctgttcatctatgttacccatgtttctaaactcttaaaatatatttagagtaatttttgttgaaacccttattttcataatcaattatgactttaccttttttttccttctatatagccatatttacttttagaggcaattgtgtctctgcccttgctttacatctcaattgtgattttacccatactttttagggtttgtgattttgcccatgctttttttaaacagggtagctgcctgcccctactctgttaactgatggtaacggtattaaatgtgtggtgaatggacgagtatacccctgacatgttttggcttgcacaggatacatgtttcaagttaattttgagcaaatttcatatgggaaataaatgttcacaaattttgtaaaagttgatagaacacaatattttggataattttgatagaactttcgcaataatttgaacacagtttataaacgatgtcagaacaatatttttgacaaaattttgacagaaattcatcaataatttggacacaaattatagaagataacagcacactatcaaggacaaaatttcagcaataatttctgctcgctgcttgctagctcgctgcaagcacacttcctgctcgttgcttgctagctcgctggctgcggggccaccggccgtggcgtctccctgcgcgtgcaacaccgcggggccgcgccgacacgccgacagagccgcgccgctcctttccgacgctcctcagtcgcggggccgccggccgccgcgcctccctgcgcttgcaatccgcggggccgccgtgccgacggaaccgccgctccgcagggccgccgcgccgccgcgtcgacggagccgctgctcctcggggccaccgcgccgcgcctgcccacgcccgactccaccgcgcgctggcccgagccgccgctcctccctgccgcgcgccgccgccgcttgcaacccaacaagctaggtttttcgattggatcggggacagcaaggtttggggatttggttgtttcattgaagcaagggtagaatagtcattcacaaattataatagcattttctttgggtgtagctatatttatggggccatatttttcatgaaaaaatagtcggcatgtatttacattgtaagtccctaaattacatatgtaattttagtgtatttataatgtaagtctaagtactaaaattacatatgtaaattcgaaaattacatatgtaaattcgaaaattacatactaattacatatgtaagtggggtgtaaatgaggtgtaactactgtgtaagtggctgaaaaaaaatcgattgtagcatatggcgccatatttctagcaactccgttttctttcatcgtttaattcggaaatcctgggcccatgaaactaccatccaaactaggggcagacggctgcttcgtttcaaaaaagctggggcaaaatcacaaaccctaaaatataggggtaaaatcataattgagatgtaaagtaagggcagaaaccaaattgacccttacttttattattgacgaaagcaagtgaacccggaatagttgagcgaaagaaataggtcttttgtaaatcttgagttacccttctatccttgctggtggaaggaaggagaggagctcctggatggaccacatatataccgatgtttctccatccaacagcaacagcggcagtgatgactcgggcaggcggcggcagcgctagctgcatgtggcgagctgtagtaggcggctgtagcgacctcgccaagggagatagatctaggcaaggtcactacatgcttactggaatactccgtattgtagaaattgcgatctactaagatataagtgctaagcctaacatgatcaccctaatgcggaatccttaggttactgaccgttgtttgaagctattgatgctgttctccctgttcttgtcggtgtagaggtagtagtggtagcagtagcagtgttgcaccggcttgatccccaaggggtcaccggcgatcacttgcggggtagcggcggccttccggtgccacctacactgtcccggaactaccacacgttctccctccagcgctcaattgattggatagggtttttgggattttcggggagaagaaggtcgtgaagagatcgtcatctcaccacgacaccagcctcccctattagtatggcgctgagggagatcgggggcaatccaaaatatagaaagatttggcgctaccgatcaatgcgcgtaatcacgtaattatggaaattgaatcgcgttaatcccgtaggcaccaggtggaaaacggccatccgagatttcctctcgatttccatgccgagagataaactttcctaacattctccccctgatcttgaggctaatgagtttattcttagaaaaatagatttactaaggcaacgcatcagggtagttatcatatcctaccaagactccggtacctatagttcactataaaacttcgaaagaactctatctaatcttaatgggagttagttaggactaagactaatgcctctatttctaggatcttagtcttaatcaaaggcaatcagttattcccatgccggctacatgatctttaaataaattgggaggtaagcctttggtgagcggatccgcgagcattgacttagtgctaatatgctcaatcttaatggtttgatcctggattctatctttcacaacatgatacttaatgtcgatgtgtttggcagcaccactcgacttgttgttacttgaatagaataccgcagctttattatcgtagtataatgtaattggtttagaaatgctgtcgaccactcttaaacccgggataagattcttaagccatacggcctgccccgttgcttcataacatgccaaaaattcagcctgcattgtcgacgatgtagtcaaggtttgtttagagcttttccatgaaatagctccatttgcgagagtgaatacataacctgatgtggatttcttagtgtctacacatcccgcaaagtctgcgtctgaataacctaggacttcaagttcttcagacttcttatatgtgagcatgtaatccttagtgccttggaaataacgcaagacttttttaacagccttccagtggtctaatcctggattggactgaaatctgctaagcatcccggtaacaaatgctaagtctggacgcgtacagacttcagcatacataaggcttccgacagctgaagcgtatggtaccattttcatctgatctgattctaatttatttttcgggctttgaaataatccgaatttatcacccttgactattggagcaggtgttgcagagcacttactcatattatatctttttagtactctgctaatgtatgatttctgagataaccccagtactcctttagacctatctcggtgtatttcaatgcctaaaacataagatgcctcaccaagatccttcatatcaaaattagatgacaaaaattctttagtctgatgcaacatattaatgtcgctgcttgctaacagtatgtcatccacatagagtactagtattataaattttccacccttagtcttaatgtaaatgcaattatccacctcattctccttaaatccgaatctcttaattatttcatcgaatttaaggtaccattgccttgacgcttgtttaagttcatagatagatttcttaagtttgcaagccaaatggtccttgccttccataacaaaaccctcgggttctgccatgtatacatcctcatgcaattcaccattaagaaatgcagtctttacatccatctgatggagctctaaatcataatgagcaacaagcgccatgacaattctaaatgagtctttcttagagacgggagaaaaggtttcattgtaatctattccctctctttgtgaaaaacccttcgctacaagccttgccttgaacctttcgattttccctttggagtcaagcttagttttgtagacccacttacagcctactgttttggatcctttaggaatttctactaagtcccagactccattatgactcatagattttaattcatcgtccataacttcaagccatttggatgaatgttcactcgttattgcttctttgaatgaggtaggatcatccaccttcccaatattttcacctaaataaacatcataataatttggaatggcagatctcctctcccgttgtgatcttctaagtggttcattttcgatcactgacggttgagaaggttcttctataatttcttcattttgtgcctcagaagtctgttgagtgtcattatttaattcattattattttcaacagagtcggtatcaccagaattttcatctggtgctaccacggtctgagtcacaggtacaacatgaggtaccaaatttattggaatattattctcttggatttccggtgtaacattagcccgaatttcctcaagattaatttctcttggacttcagctgatcttcactatgtttctgggacaatctctatctcgatttccatctcgattcctcctccacatctgatccttggattaccaaatttggtcgttaacactttcctgtgagctccccaagacttcattattttctaagcatacgacgtgtcttgtttccacaaatttagtgacacggtccgggcaataaaatcggtaccccttagatgtctcagggtatccgataaaatggcagcttacagtcttaggatctaatttctttagttgtggattaaatattcttgcctcagcacgacaaccccacacacgtaaataatttaatgtcggttttcttccggtccataattcataaggtgttttgggtaccgacttacttgaaactcgattgagtatgtgtgcagctgttttaagtgcctctatccataaattcacagacaaagtagaatgtctaagcatactccgtaccatgtccataagtgtacgattgcgacgctcagccactccattttgttgtggttctctaggcatggaatattgggcaattattccatgtatatgaaggtattgggcaaatggaccagaactttgcccataaggagtatgtctcccataaaattctcctcctcgatatgatctcactaccttaatttttgcattatgctgattttcaacctcagctttgaatatttaaacttatcgagtgattcagatctatctataatggggaaaacatatccataacgggagaaatcatctgtgaaggtaatgaacgagtcatatccatcaacagatgttactgggaacggtccacatatatccgtgtggattatctctaatggacactgctcctagtagctcctttcttatttttttttagtgaattttcccttaatacaatctaagcaatgatccgcatttgaaaaatctaagggttgaagtatctcttccttaatgagacgctccattctccccttagaaatgtggcctaaacgacagtgccacaattttgaagacgtctcattatcattacatgcattcaatatattcataatatgattatccaaagagagcaaacagagcttgtcttgcacactagcaagaccaatatcaatattattatacttaataaagcatttgtccttagaaaaattacaatcataaccactgttcgttaaaaccattacagaaataaggttcctcttaacagagggagcataaagaacatcatgaagtaaaagattattgccgcttggaagtcgaagatgaagctccccaacggccatcactttaatttcagctccatcagccactcttaggatccgctccccctttcttagcgtccttacggaacggaatccctgtaatgagttagcaacgtgcacagtggcacctgactcaatccaccatgatttatgagaaaattcaacgtaaagtaattcatcaacattagagacaatatcaacattagtacctttcttagcaagccaagcccaaaagccttcacagtccctctgtgcatgaccttctgcctcgcaaaacttgcaaaggaacttaccagcagagttctgacctgctggaacctgagatttgcccttatgagcaccattagaagcctgagtggaaggagtgttgggcttcttcttcttgttttgggagttgctggactccccttgatagaactttttcttactgcccttagcaccatgaaggaggttcagctgatccttatgcttctatttgtcagccttctgacgatcctcctcctcaacagaatgagaaatgagttcttcaatggaccacttatccctctgattattatagttaataatgaaagactcaaaatcagaaggaagtgaactcaagataaagtggactagaagatcatcattaattcccatgtccatactcttaagctctccattcatagcacccatctgcataatgtgctttctcacaccatctttataattatagcgcatggacgttaggcgcttaattatagagctagcataagacttagaagaactcctgaagttcctatcaatgttttctaagtatgtcttaacatcatcagagtcctcaataccaccaataatgacatttgatatggcactcttgatgtacatgagagaaatcctattggacttctcccattcaatagttttctcacgatataacttcagtttctcctcataatcgtgctcaacactaaaaggttcctcaggacggtcctctctaatggcataatcataatcgagtatgcctaagttgagtaacacgtcagccttccacttagcccattaagaggctcaatgagtcagatctgaccaaaagctgaaaaatcatgaagaaaaaatattcataagtacatatatgcaattaatatgcgttggctcaattaattacataattaaacagaaataaattcccctaattacatcaccgttgggcagaaataattttgggaaacataatcataaataaattttcgtgaatttataatcaacgttggtcaaaaaataaattcacatcatgaaaaaacaaatatctagccaaatttctcattggttccatttagctagaattaatttataaacagtcataaattttttcataatttttcagcaatttttaagcaatccaaaaaggtactaatgcaaatctgtaaataaaaatacttaaagggaaatcgaaaagagaaaatggccaagtacacattatagcatcagcccggccagcttgggaccttaacgcatgcggcccataatgcacagcgcggcccgtggcgagatcgatctcagccgtttgatgtaatagacggtttggatttatcccgaatcggaaaacatatagccgccggctgtaacactaaaaaaaaatcttttccccaactctctctctctccgaaaagaggcggcggcggcgatttcgcggcggagggggcgcgcagcatgaggcggcggcggcacgcgcgtgttaacagtgaaatttggtaagcccggagtagtcatcggctgagagtcagcatcggcttcgaagtcctgagattagccgatgagaattgtcaagtcgttagtagtcagattcctgctatattcggttaaggaaatcaatctactaaaggaagcttatccctaagtgaccgagtttaaagaggatgcggcatggcagtttatctattaattaggaatagtttgttagtttccttttatctttggaaaagtgtgtttagtgtccgataaggactttatattttccttttttctttaggttagttcctttcttgtccgacaaggacttgtatcaacccatgggtataaatatgtacacccggggtctatgtaatctatcttcacgatcaatgcaattcggcgcatcgccaccctttttacttctacttttgttttttaagttccgacggaacttggcatcggtgttcgatctccggcgaaagggtaagtccaatgttccgtcggcccaggcaattgtatcgtttacgtcggcgtcgttcaaggctgcatcagtacattcgacctcttggattgctctggtttggatgatataattgcctatctatttatcatgtctctgttaatctagtcttagcatatcaatttaggtctatcggctgtctcttgctttagggttcctgccggtatcggctaaatcgcgttgctagattagattagcctaggcatctaccaccgtgaaaatcagtcaacggcttgattctctagatattgtgtttcttttcatacttagtgctgcatcagttaagtttgatctactaagtcgtgcttagaaccataatctctagcctgcttattgattgccaataagggtttcatcggggtttcagccgatgagttatctggacgttgcatcggcccataaggattgcatatacatataagttggatttagccgatgacaacaaaggtttcattgtttaatccaatcttgtggatttcatgacatcggacctctagccgatgggtgctttaaccttcggatcaatacttgttctactatatcatattgttagccgattggtttctactggattatattgctatattacatcatcatcagccgattgcctttatatcattatctacatttgacatatagccgattgcttaaaccctatcgctatcggctggtatcggcatcggctattttcggctatcggctggaactactccatcggcttgtcagccgattggctgttttgatctactatttgcatatcttgtcggttgcaggattaaactgactggcacgcccgcatctcatcaatctttggacctgcacaggagctaagcatatctctcaggccggtgtgttcgattttttcgtcaacacagattagccgatgagaattgtcaagtcgtcagtagtcggattcctactatattcggttaaggaaatcaatctactaaaggaagcttatccctaagtgaccgagtttaaagaggatgcggcatggcagtttatctattaattaggaatagtttattaatttccttttatctttaggaaaatgtgtttagtgtcggataaggactttatattttccttttttctttaggttagtttctttcttgtctgacaaggacttgtatcaacccatgggtataaatatgtacacccggggtctatgtaatctatcttcacgatcaatacaatttggcgcatcgccaccctttttacttctacttttgttttttacgtttcggcggaacttggcacctgacgcggggctgcatcggtgttcgatctccggcgaaagggtaagtccaatgttccgtcggcccaggcaattgtatcatttacgtcggcgtcgttcaaggctgcatcagtacattcgacctcttggactgctctggtttggatgatatatttgccttcctatttatcatgtctctgctaatctagtcttagcatatcaatttagctctatcggg

SEQ ID NO: 72533 - DNA, 529 bp, Oryza sativa
tttaaatgcaatttcatcaggttgtacaaaatgtttaagaagttcattctgtcattaattaatatatttaatggcggcgcctatcatgcacctgatttgatcgccagcaagaagaggattagaactgagaataacttcgcttgaagaaatcggactagtaggttgatttaacaagctttgctggaagaactaatgacgtgtcagaattacttaccgtttagaccaatgcaaaggatacgaaaagcttcatcaaaatggtttccttgtacggaggtattgtttggcaactttgctgacatggattgataaatgagagcgaaatgagtgtgtcactgtcaaatcggattagatgagtagttcagctgcaaaggttaaaagcaagaggataaatacgatttcagaattcagatagcaccaaaaagagtaaccaaagtttgagtgttaatagatcatctgtgcacaaaacttgacgtctcttgcaggtctgcttgtgcttatcccttttcactctgtttaaagcttctttttc

SEQ ID NO: 72534 - DNA, 685 bp, Oryza sativa
tcaattcatcagaaaaccatatgatctctactttgtcaaggtgcatgccaactgccttccacatcatgatattgtagcggataatagcctgtattttgtttaggttacaggtgaatctagggttccgctgcggaaaccaatctgctatcaatattttaactgtacagccagctctaaccattttgttgacatagattgtcttcataataccctgaaaatgataacagaccatgacctagttatctgtgagcagtgtttgaaatgcaaccagagaattggatttgcataggagcacataaaaattagagatccacgtctgaaccatggcatagaaatcaagcttcttgtactactacaaatatactactggtattatattagtaccaccattatgtttttatgatatttcttggttcatacccctcttgatgagtttcatcctagcctgcccaacttgtccttaatatcaggggctaatggcagaaccaccaccaccactattatcttttatactgtactctctccgtttcataatgtaaaactttttagcattgtccacattcatataaatgttaattaatctatacacacatatatgtctagattcattaacatctatatgaatgtgggtaatgctagaaagttttacattatgaaacggaggaagtagtatagatatatattt

SEQ ID NO: 72535 - DNA, 640 bp, Oryza sativa
ctgcagcccagcctgacatcaagtattatgtacagtaacagagcagaatgtatgtaggatggctgaacgcttcgtcaacaatttttctccagtcatctttgcatgcttccatatctgacctgcaaaagaagaggaaactaatggttataacaggggagtgaagaaaagaaaatctagtaatttgaatgtcaaattcccaaaccatcaacttacaaatcaacagggacaaagagcaggacaaagttgtacagccatatcaatccagccttgagccaaccaacaccctttgcaatagcaaaatccaagtcacctcctacagctttcgggttgccacctgacaggaaacatcactcgatatgattggtatctacaccaagtatttatatgagtagcatataaacaccaagaatttagaaacttcatagtttctacgtactatttttttgagaggatgaataacgattcaactcagagggtttcttggaaggaattatggtgagcagcagcccaactgaacattaataatttgcaaaactttagttggtacaaatgatttagctctgaatgtaaataatgattagacgatgctggtaaaataacagttaggcaattatttctagaatcctagccacaaacaaag

SEQ ID NO: 72536 - DNA, 3951 bp, Oryza sativa
tgactgctaagttttgtgcgcggccgtgggcgggtgttcaacatattgtcatgttgagtcgatgctgttgcacgtcaggagttccgaaaagactcccccacacttgttttgtaccttgactttattcaacaaaatgatggaaagcaaaatgggcttccaccggggtaaaataccggtgagccaaattttattcaagtaattctaggcgcatgaagtgcctaaaattacttttattttatttcacttttattttgtttttatttatatttatattttatatttttttatcattttttatggcagcaatagaggtgatgggtaacctagcagggtggacatatgtgacgcaatgatacacagggtgtttcgaattcttactagataggacttaccaagctttgattcggatgcaagaatgcaacacaactttgcatttgctctgcctggttccctgagcatctgtcttctcatagtccaaggagcgtggtatgaatgttgagattattatacacttccccttagttgtctttttatttcctgcagaaggtcagtggacaacaaataccggagggaccacaaaaagttgaaaagattttatcatagcctcaagattagttgttcacattcatgctaaaaaggaattggattgaaaacttaatgagcatggatcccataaatttgccataattttatttttgtcattatttttactttttactcgagagaaaaatgtttttttttccgagagacatttcttttattcttgaaaacaatttttatcaaacttttatttaagaaaaactcatatagggctgagataaagttacataacatagcaaaggagcatttgacaataggtcacggcagctaaggcgggagtagaccttgcaaagcagggcgaaccgggcttccatggcgccatcgacggtgaccttgggcttcttgttcggcgcgatcgccctgcgccgccatcggagagctttcgccgactcagacccggcctcgaaggggatggagtggtaaaaccacttcgacatccagtggcgagccaacttgaacatggcggcgttgaccggccaaagatcagagtgctcggggcgaacattgaagttcacgctcccgaacgctgtcttcttcgtccctgcgggagtgaccaccgtcttcgagtttacgttgcgtaaaaaatggtgccgtaaaaaatggttcgaacccagcggtccggcacgcccagtcgaagatggcgattcggacgagagccgatgggcttagttgagggagctccacctaaaaaaggcgaaggatctccgaaaacaacacgttgcacggaaaccgaaggccgtctcgaagaacacggcgaagaccaccgtccggctatcgccgggcttcggcacaacagcctttcctgggggaggcctgcttctccgccagcacgccggaggtgaccagctttgccaactcatcctcgtccacaagcgaagccccgagataggcggtggtgtcgtcatcaatcctgccgggatcagggcccgtcacggaagctgggttcggcttgcgaggagccatggtgaaaagtgtgggccgtgacgaaaagaggaacagtcgaaaggtactagtgactcaagaggaccgtgaagtgagagggcggaaaagagagagctcgcggtgaaaatgacgggggtgcggcggtgaaaagggggggatatataacccacccaagcgtcaattcgccttcccacccaatcgtaagccgccatgtgtcacgagggtaggcaaaatggtaaattcccattcattgagctacacagtgctaagcccatgaagggaagcctgtcactgtttattgcggcccacggaaaaaaataaggacggcttcgccgtttgcaaaaggcgaaagctaggaaaatttactaaccgtaaaaatacatatgcacaaagtgtacacatttcctgtaggactgtattataggtttcggcaggagcgtcggtcgaaagggggcgcctcataccataccacatggtttgcacggtctcggccgaagctcctaactcacccttgcccgtgaggggcttgttggcagtatgtcatgagacccttcgaccagacctgccgaaaccgtgcaaccagcgaggactatgaagcaaagatggcgaaggccgaagagtcgtgctggtatccggcaagaccaaatgcgtcttgggcgaagggtgtatgccgaaggatggagacttcgcaataacaagcccaactttgaggaggctcaaggggccatcccggccgctcaggcctgttcgccaatcggcccattagaggcccatgtatccaaattacactgtatacccaagcaaacgtccctttcataagggcaaccatgtaaattcccctgtaaagcctaaaccctaaaggggtgaacctgtaataggattataaatagtcctctagggacatgtaaagggggatcccaaagaaaaatcttaaattaatacatttactgtttccaacactgtcggtgacatggggccgggggtatcgtgactagaggcttgggtagccgcggtcaccctcgtggcctgaccccctcgggggggtcgggctcgaaggtgacgtggccacccctccctctgtctccccgaggggtcgggccgctcccgtttcggccccgagggctggggtgccccgaccccctgtggttttggcgccacgtgtgtgggttaggtgagcacacagggctcacctaaccgcatttatagcaggttggacgagcgcgccacgccgcgtttaatgcggcgcagcgcacgcttatccggtccgtgaccggtcgcggtgagtgaccggtcacagacaggtcaagatcgcgggttaggtggcaacaggcggcctgtcacacgcctcgccccgtcccgtcggaatgatgagagcttcctggctctcgtccctagccggagccggcatgccaactccaggagtgggtatgtcagtcccggtcagattcattccaggcttcagcgcaagcatggcaaggaagtcgctggccattaaatgaaggttgaaatgggcgtccccgggaaaagcgggcgagcggggcaggaggcgtgtgctctgcttgtcagatgtcacttccggctgtagactagccctcattgtaaaaagcatgtttcctttcttaggcagcgagaggcccatgtggtgacccctgaccaaataaaaaaggaggcccaggcctaaggagaggggaagagaaaaagaaaagaagaagaagaaaaaaggagaagagggagggcctgaactctccctggctctccggctctcggtattccttcactcacagatccaccaaaacacaggagtagggtattacgcttctcagcggcccgaacctgtctacgtcgcctgtgtcttgtgcactttctcgctcgctgacgttcctcagatcgagggcgaagaatctcacttagcgcccccggccgaaccggcaaaggggggcctgcgcggtctcccggtgaggagccccacgctccgtcaaacactgttgagtaaccacgtccttcgacgtacgcagttatcgcttcgacaacactccattaaggaaagaaataaaaaagaagaaataaaaacaaaaatacgaggatgacctagactcgaataaattagcaacagttccctagcaacgacgccagaaatgcttgttggaatttcttacaaccatagataaatccgaagcgcacggaataccactgtagcactttacattcggtgtcatgccctgaagtttccccgttcttctttctttaaaagttggttgaataaatcgtccgaagaaattgttctaattaacctagagttgaatccctaattaataaatgcaattaatagtcagaaatagcgtggtggaatttttcttgagttccccatgtcctaatgtattaacaagatttttagtggaattttcacag

SEQ ID NO: 72537 - DNA, 1030 bp, Oryza sativa
ccttttcttctcccatccattgcagcgaggaggaacaaacagcctcatctccccacctcgactcgacaacaggaattcgacccgtcaccggcatcctcgccgcacggcacggcacttactcgtccatgccggaagtggaaccatctgtctttttttctttgcttttttttcttctcgactcatccatgatggaaccatctaccattctaccttgatttttcctctcatccttcttttcttctcttatttttttcttcaacttagtccatggcggaaccatctgccttttttttctcatccttctttctttcctttttcttttctctactcagtccatggcggaaccatccgcactgatttttcctctcactcctttcaatcacggtatcctctcattatcacaagatttatggcctcctccgtccatactaatcggcatcgcgtagagcaacgagcagttaatcgccggcggcgacggatcgagaaataacaacacagccaccgggcaccagctgaataaaggtcgtggcactagtagtggtaccgcggaagaacacacaggtggcgctggcggcaaggaatggcgtcagagaagatgccgtcgaagaacactcacgcggcggcgtgccagcgaagaatcgaggacgatggcgagtcaacaagcagttcagaagcaggggcgctcggcaaatcgattcttttttcccatcatgccccttttgattcaatggttggattttatttggtacctagcagtaccagtacctggagcgtaaaaactctcatatatattaggacagcaaattaaaccgtttgtttgtttgtttgtttgtttagaaaacatgagaaaaagattatggaattcaaactatgattgtatctacctaacgataataatccaatcaccacaatttcaccaaattttgattgtagaaaaagtataatatgtttagataacttgagacactgcttaattgaagtgcaaaaagtgaaaaatatgttaatagttcaactgtagggctgcaggaat

SEQ ID NO: 72538 - DNA, 2445 bp, Oryza sativa
ccggtttagccatagccattgttgagtcgttcactcgttcgttcgaatgaggtgttccccgtgcttcattcgttcgtccgtgttgagtcgtcctttaggttagagccgttcagagccgctggttccgttcgccagtttcagttgatcttttgggtggtcccgtgtcacgtagaattgactcgttgagtcgatatctcgtgaggctcgcttgccagatcaatctaagccatccgatcttggtcgacttggtcaagattaatctcagccatataaatcctttcctctcttttcaatggcatattattcattttactatatgtcatctaccaaatataatctaatattttctggaggttgttttaatcttttccctcagttataaatcatttgtaaattgtttaattaatttggaatagtcttttctttaataggtttaattggaattaaatcttgtaaaattcataactaattcatatgaaatcggaatgatgccgtttaagtctctaaattcatctaaaattatgatctacatgtttgtttactttatatgtactgtttatttggtttttattagtctttttctttgttttgcgtgttagcttgtcgtttccgccgttgcaaaggttcgcgtgtgcatcggaagtattccagaagacttattaaagaccgattattgctaggcaagtcacacagatcccaaacacaattcctttgagcatgttgatcctatatttaaagtctctatttatttcaactgtgcatttattttcgaatgtcaccgggtggtgtgaacttattcctttgttatggtcaatttgcattgattaccctatttcttgattaccttgggttattataatttgactagttgagctttatatattggttcagctagatgttagacataattgcttagccattcttagaaacattagtacacgattgggataactaatgttttactattacttaatgatggatatttaatgattagctcacgatggtcaatcgtgattggttaattaattaatatgctaactaaaacttgataatggtgggttgtgagcacatggttttgatggtcatgcacatgacaattaaggaccggttcacaagtttcagttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaacggtgcaatgctttgagttgtgttgtgcgaagggtactgtcacgatttccccctttgcagtgacgtggtggtacttcagggcatggtaacatgtgtggaatcgtgtcttgtgggtacagtggtacacctctggccagagtaaaactattcgaatagccgtgcccacggttatgggcgggtctaacaatgtctttcatgatagtctcacacttctcaccataatagatgatgctataactggtaaaatttgattagctcctggtttggaatggtatattcctggtttggagatagatctgtacagccgggtatggttgtttaggtttggttgggcctgtgcagcatgggtgtgatgttcagtgttgattaaaattgatgattaattgctctactattttacttctcttaaatgtttgctaaatgctgcttttgcaaatgagcctattgttaacaaccaaatttggtaatatcaacatcggagatgaagatgaaatcgaagcggactcgaagataaggtttttttcggaaacagagtaagaatcggctggagtccggatcggctacgactgggattggctaagtctgagtcagtctggttaagtgatacagccgattccgataatacgacccatgtgcgacattgggttcgagttgatgtgtttcaagatgattgccacgcatagatagagtcctgggaaggcaattgtatctattaattaggatattttatgtaaattccttagagataaatgtgggcaaaagtctgccgcaaagacttgtggtatcttagagtttgttagagataagagtcgtgtccaatatggacatatcttgtatttctcgggtataaatagaccccgagccctatgtaatgatgaacacacacgttcaatacaatttcggcgcatcgccactctttttgctttcgttttatttcaacgagttattgctttcgggttgagctgcatcggttttgatgttcaacaagaggtaaaacttgttatggcggcttgtgttctcgagattagtgcttccatctttatgatactctaatcttgtttatgtagtccgtcaagttatcatatatcttacataatccttgacaatatcgtcatttaacctacaatcggctaacatctgctaccagaaggcag

SEQ ID NO: 72539 - DNA, 14571 bp, Oryza sativa
cttgctgtgataccggtattttcttgctgctgctttaatttgttgtatgcaaatttggtgattcatgtggattcgccaatttagtcacaaacatgtgattcacggcacaaggaaaaataccgttagtagaggtaccagtgaccaagtttggtttagggtttcgggttcagccattctagctctacatctatataatgtgcatacacttcacctttcttttctttcctccctttgttgcagttgtagaagcgtggtctatggtttcctcttgctgctggactcataatcttctgctgtatatatattctgtactttggctcattcaatcaattgtgtttggtcttcactaatctcactcaattgagatttgaagtggatgtgttggtcatgcaaactggttacgagatgatggctagcaactatttttcgagatgaagagggaattttgttaataattcagaataagagtacattcttcaggaactatttgctctatagaataaaaaaggaaatcaacatatcaatatcaacggcagaacgttttaaacattatgccaattgtgcaacctcatgagcaatgaattatgttttcctcatcatgatccggcaggacaattaaaccaggtaattgttcatcaaagtcgatgaggcaaactaagtaactttgcaatgtttgagcaatcaaacactaatattataggttgcttgatccaatcaacaggaagagctgaattattggttgccttgtctacacgttggccattcaacctgtatatgaggcctgcaaaattattattactatactttttttttctgctgaatgaaaacagtcagtaaggtaaattttgcttgcacacttcaaatatcgtattcttttctcttcatgatcttttgagacttcctttcaaacacatgagttttacaatattttcaaagaaattagttctattaccacagttcatgtgttccaaaaggaggctttacgggatgaaactagtagggaggtgtttctacatgacgttaattaccacaatgcgaagtcctgtcacgacttgtagaaatgttttttatgatactcgaagattgtctagactagtcatttcacactgatccaacagttggcattttttgaatcatattacgtcctatgcaaatactcactacatttctaaatatttgacaccattgactttttagcacatgtttaaccgttcgtcttattaaaaaacttttgtgaaatatataaaactatatgtatacatattagtatatctaacaatgaatcaaatgataggaaaagaattaataattacttaaattttttgaataaaacgaatgatcaaacatatttaaaaaagtcaactgcgtcaaatatttagaaacggagggagtaggtcttaaaaggaggcattacatttcaaacttgctattgtaagcatggcgacccaaaagacaactataatttttgaaataacgttatttggcacattttgaaattttaattacaaaatacaactgtaattttcacaaaatatgccaattctgttaacatcacttggcaaattttgtgaaccttctctaatttttcactatgttaacagaattggaattattgccagcctgcctttttttacattcatctggtattttggccttggtggatctccccgtttgtgtttgcctgatggcggcggtattagatgctttgattgtctcatgcatcaagaagttgcaggatatcattacagacaatgcaatactcgtgctaggagtagaagaagagctcagtgaactggtgagaaaaacagattacatacgatgttctcttaatgacgctgagacaacgaggttggatcatgaagcagttaataattggcttggacaactaagagatgttatgtatgatgtcgatgatattattgatttggctagatttaaaggaagcatcctactagctgaccatccttcatcatcatcaagcaaaccaacacgttgcaattgcccttcgtgtcattgtaatatttggacacgtcatgaggttgctgttaagattagaagcctgaacaaaaagatagcgaacatttcaaatgatgaactacttcaagatctcagacgtagaccgcatccgagaaatggttcgatatggacaccgataaaaacctccagcatagttgaacccaaccttgtgggtgaagaggtcatacttgcttgcagagaattggtggatttggttattgaaaataaggaaaagaaagattacaagcttggtattgtagggacaggaggagttggcaagacaacacttgctcagcaaatatataatgatgaaaaaataacagggaatttcgataaacatgcatgggtttgtgtttcaacagacagcacacaaacttctctattggaagaagttcttcggatcatgaaaattcgatatgggaaagcaaaatcagttgaagagctccaaaacaagctcaaatcagccattaaagagaagagttttttccttgtgctagatgatgtatgggaatctaatgcgtggactaattcacttcaaaaaccattgcatgctgcagccaaggggatagttatagtaactacgagaaatgaaaagtagctcaggaaattaaagtggaccatacccatcaagttcatttgatgtcagaaaatgtagatgggatctactttggaagacatgggcataaccgaagagaaacaagttcatcatctgcgggacatagggattgagattgttcaccaatgtggttatctcccactagcaataaagatcatcgccaaagttttaattagcaaagagaaaacaaatgatgaatggaaaaggatattgagcaacaattcgtggtccatgaataatcttcctgatgaactaagagctttatatctgagttacagtgagctatcacaccaactgaaacaatgttttctttattgtgctatatatcctgaacattcaaccattaaccgtgatgatcttactagtatgtgggtggctgaaggcttcattgatgagcagaaagaccaactactagaagatacagcagtagaatactacaatgagctgatccattggaacctccttcaactagacctttcatattttgacctaggtgggtgcaagatgcatggtctcttaaggcagcttgtttgctatttatcaagagaagaatgttttgttggagatccagaatcacaaaatggtaatacaatgagtaaaatgcgacgtgtttctgtggtgacagagaaggacacggtggtgttaccaagtatggataagaagcagtataaagtgaggacttacagaacttcatattccaagtcactgagagtttacaatccacttttcaagaggcttacatatctccgtgttttggatttgactggcacacttgtacagagcatcccaagtcacattggaaatttgattcatatgcgtttgattaatcttgatgggacaaacatatcttgtctcccagagtccgttggtaaccttcaaaatcttcaagtactgaacctgcaaaggtgtaaatctttgtacaggcttcctttggcaaccacgaaactatgcaatttaaggcggcttggtcttcttgatacaccaataaataaggttccaaaagggataggaagactgcaattccttaatgatttggaaggatttcctattggaagtgtaacttataataaaaaaatgcaagatggatggaatttggaagacttggctgatctttcacagttgaggcggcttgttatggtaaaactagaaagatgtactccttgcagcagtgaagattcatttctcctaacaaacaaagaacatctgaaagttctatatctagaatgcactgaaccaacaaatgaagcatgttcagatgaacatgttaaacatgttgagaatatctttgagcagctagtccctccacagaacttgaaagatctatctattctgagattccttggtcagaacttaccctcctagctttgtaatgtctatctgccttcactgaaatatttgatcctctctgattgcaaatattgcatacatcttccaccaatatggcagctacccaacttggaacgcctgaaaattgtgaaagcaactgcaattaccaagattggacccgaatttattgggcaatttccaagatccagggaagcagttgctttccccaagcttgaatggttgatcatcaatgatatgcccaactgggaggaatgggcctttattgaagaagatgagatatcacttgcagcaatgaacgaaggaggaggggatggaactgctgtggccgaagaggaggagatatcacttgcagcaatgaatgaaggaggagaggatggaaccactgtgacggaaaagggggaagcctcatttccaaggttgtgtgtgctgccctctttgaagaggttggacattgataactgccccaagctgagggctctcccacaacagcttggacacgaggccaccagtttgaaagagctctcccttgtagcagcaagctgcttgaagtcggtgaaggaccttccatccctatctggtttcctttctgtttgtagatgtgaaggcctggagagggttacagaacttcccaaagtgagaaagctgtttgtaagtgtttgtccaaatttgagctgtgttgaggagttaggcagtttggagcagctatggttggatgtgaatatggaggactcatcaccgtgggtgcatgggcttcgagagcagtaccgccacctggatgtctacacgtggcctagagagtgagatgtgaagacccaactaaaagacagtagattagtagagacacaaggtaagggcattggctctgtatttgttgatacatatttttattctatcgttatctaaaatagtggaaacatattttaatttcattccaactttgcatattttcagccaaaatcatgcatgtctaatgttattctcacctgtacactttacattcattgatgttgtacactttgcatcattcttagtaaggagatcatcatatatattagacaaaatgtcaaactttcggtagttgttatgattaatatttgtacctatattactgaccttgtcacctaaaactagtacagaaatccttaaaactttgtgttgtaattattctcaatgtccataaccagtacagaaacaagtgttatagcattttataatctattatatcctaaagtacattaaacctcctacaaacgcttctaagccatcacgtagcactcctacgaacactcctaagcctccacatgacattctaataaattaaagaaatttctaaaaattccgagaaaaacaaaaacatcttgtcatttatctttattaaatctggtgaacccatcatttacaaccattagatctagtcgtcaacccgtgcgttgtatgggttattaaaatatttaagaaattcaattgtacatgtggttgaatacatgggttaaaatgattattttgcttaaaaaaatgttggaatggcggcattcgggcatccggtctcttgtactttaccatgatttgacttggaaaacagtgagggaagtctccacggttcggatataatgatgattaatccaaaactaattaattaattcaattaaaaatactcaactacagtaccatgactatagctggccaaatgggtggcccggcccaacacgcacggccccactagtggcacgacccactaaggcacggcaactgtagcaggccgtgcacgtggcccataaaaaattgaaaattgagggaaaaataatatgaagttaaaaaatgaatgaagacaggacaaacgtgaggaaaatttaggaaatatacgaaatatattagaaaatatatggtaaaaataggataaaatatgaaaaaaaataaaaaaatatgagaaaaatatgggaaaaattagaaaattgtagggaaaataaatgggcagctgggccgtgctcgtgccgacccgtcaacaggcatgccgtgccgtgtaagcccatgggctaaggtgctggcccaagcacgacacggacaaatgggccatgccggcacagcacacagtccgcccaacatctgttcctagtgtagggctcctaattaattaaggtttgtttggtgaaacaaaaaagccacctaaatgtctttgtattggttcaaattgattaatagttttgttcgtgttctacctgttaaaagaagaagaggatattgctgatcggcatgcctatgtatagtccatgtgtgtcttttccttatgccttttgtaatgcacgtgtattgtttggtaagttcaattccagaaaatatgattgttgaaaaactgatagcacatatattttcttttccttaattaagttattaaattaccaaaatacttatgtatatatacatccatgattaatttctgtgtgcttatttattttgtaggttgttaatcttgaagaatttgggctgtgcagtcacttgtaatatgtatttttgttttacctagttattggtctttgaaatattaaaaaaattttatttttttaaaaaataaataaaacaaaaatatcaagaaagggaaaatgtcaaaaaaataaaaaatatattttctttagctcttgtaaaatatattgtcatgtttcgttagattttgcgtgtgtgtttcttttctttttatttttttttgtaggtgtgtaggtaactccgcctatgtcatcgtaggtataactaaatgacatagccggtccccagcccggaaaaaggaggaggggatagtttggtatagatgtgtgttgaaatgatgctccgttgctagatcattgggaattttctgcacttttattagattaatttcattttcagtgatggaataattgtggaaacatttctggagactcatccacccttattgctctgttggacaaatctgattctgaactatttaagctagcttgaccagaccaccaggtctaagagctgcgaattgacaagtaggtgaaggaaattcagtgccgaccatgacctgatgaggagcaaaaatttttttcaagtcttggagcccaaatgtgcctgaagtcctgaacaacaagatacaattttgctgcaggatcaaacaattttgctcctctcatttgtttcttgtctttacctagttgctggtctttggaagattacaaaaactgaaaaaaaaaagagtgaaaagaacacgaaaattacaaaaaaaaagtcaaaaaagggatacagatccaaaaatgaaaaaaaaaacgtgtttttgttttttgtcttgcacgtgtgtaggtagctcctcctatgccatcttgggtgtgcatctttaatggcattgctagttccaagcccgaaaaagagaaaattgcatatgtaccatcgcgtaaaattggcttcgtaaaaataccatcacttaaatgggcttcgctagaataacatcctgaactgagtacacttcgccactttaccattttcatcatttcttccattttaaatttattttatcatctttgcatctctttttggactgaaatacccctaagtcatcaacgctgaagcacttctggtcccaagcccggaaaaggagcagggggtaatagtgtatagacattaagtgaaacaatgcgctgctgctatctagagcagtgaaagttctcttgaaaatttctgcactcttgtcaagttaattgcatttttattgatggaatagtttactgaaaaacacttctagacactcatccactctggtgctctattgggcaattctgtttctaaactattttagcttgacctcattgcaaaccagttttcatgtgaaagcaatggaggcgaacacattcaccagttcgtcctcctctcattccctgcatcctgtttgagaattgagaattgtgaacactgcggtgtggaggctgcggttcgtcagaagtttaaattcctagatccagtttcagatacttagcagcatttcacctgatggcatttgatcgtaatgttcagagaatgttatctcctaatgctttggagttcactccccaaattttcaacactgtcatggactctgaaattagaatccagctgtgttgcgttcattactgtaagagctctttttttttttaaacctaagccagcattgctggttttatattaagagagggagaaactgtacagacaagagacatcgggcccgaaacccatacagctgcatggttaattatggggaaccgacatcacagaggaaaacatgggacctaactacactactaacaacaacggcggagcccaaacgcaagacatcattgccaagctaaacacaaaagtggcacaacagctccgacatcatagaagaggtgttatcgttgccgagctagccggccaagcaacccagcagcgccgacttcaccactgcagcgacattgaagccacggaagttgccaaagcgaaagcagctccgacatccacaatggacatcagccaagccatgaaagagccacttccttcacatggccagcaccaactctttggaagagaccgcaacacgtcatcgttgtcaagcgtcgccgcaccccagcagcgagcagctccgacttcctccgtagaaacaaccgaagagtgtgtcgcccaccacaagagcgaagcgaacccaagaggcttaggcctcgccaagcaccaaggaaagaaagcttttgaaccgaagagaccctcaatagtcatcgatgtaaaggaacttccccgaagcgacgcccccaaggaggacacgacgcgtaacgccgccgccgctcgtccgaagccggagcaaggttttcacttggagatttgtggggcaaatgggagagcacattgacaacgccttcaagaagggaaatggcgccaatgggtgcgtcgtcgtcatcgagccggccaaaggtacagcaaggctttcgccagcgtctgcacattacccacacaagcacccccacatcgacgaccaaacgatagtccaagatgactcacaagcattccaccctcgacgcatcctaccatcgcccacactcctctgctgcaccgaccagaaccggccaaggcggccaaggtactggtcgtcgaagctccccgctgccatcgcctccacgagcacccactccccgctatgccgctgccaccgtcgccacaagcgcccgcagccccgctgcacctcgtcaagacgccagtgggcgtagctggaggttgccactgcgccgacaagggcctcgcatccgcctcctcgcagcaccagacccccgccgtcgccggcctcccactgccgctctggcgagggcacactggtccccaccttggcagcacgccatcatccagccaggagggtggtggatctggccaagggccaccggatccgaccgcccccatcgccgggccgagggccaccgccgcctcgcggctgcctcgccgtcgtctcgcggctgcctcgccgtcgtctcgcggccaccccaccgccgtctcgcgtggccccccatcaccggccgagggcctcgccagccggggcccgcgtcctccctcgtgccgctcgatgcccctctccacctccgtcgcgacgctagcccgctggccgaaaccgtgggtgagggggccagatccggccacggaggcgccggatccgccgccccaaaccgatcggccgtctcaccttcggctgcgccgtcgtcggccttctccgtcctcctcacgcagaggacggttccaccgagctgtacgtttgggccttgccgccgccttcccggctcaccactggctttgccgccggcgagcttcggcggcggcgaggtggaggagggggatgagggtgtggcggcacgggtggctagggtttcgcccccgagccgcccgcgtgagagcgacgcgggggacgcgtcctcctttcatcttcctgtaagagctcttcagtcattcagtttagtgcacagactttttagggcccctttgaatcgcaggattgagaaaacataggaataggaaaaacgtaagattttgataggaatgtaagtgtaaaacagaagattgcaaaacgcaggaaaaacacaggaatgaccgtttgattgaatcgcaggaaaaacacaggaattagatgagagagatagactcgtaggaaagttaccaagaggttgaagctcttgctaaatttcctccaaaatctctttaggattgtccataggaatttcaaaggattgtatatgattcaatcctttgtttcgaagggcttcataggaaattttcctataggattgaaatcctccaaaattcctatgtttttcctccaattcaaagaggcgcttagtgtcatcgcaacaagttcatctaacaggtacaaaattgtcttcccctggatgacaaaatgcagcagaaagcaaagcaaaactgaattgcattcagcgacgggaaaagaaagggaggagtgagaggtgtcgcttacattctctggtctccggcacgaacgccgaggtgggggctcgctcgacggccgcgcgcgctaggagctcgaggatgacctcattggctcgtcggatcgcccgctcgcagcaacgcccggttcccttctccccatcgcctctcgctgaagctcctgccgtcgccgggtcgccgtcgctcgcaacgacaacaatacgagataactcgagggcctatacgaaaataaacccccagttcacacttcacaggcgtgtttaaatctcagccgcctatatcagatcgaacggtgcagagaggctgaggttttggatcgctcgaacgaagagattttttttttgacgcaaaaggtagagactaccttataaccattgcattaatggtggtcaaatcagataaaatctggtaaagccgaacaagagaacagaggggggagaagaaggaaaaaacagaaagaaaagacatgagaaaaaacagaggtacaagggagaaaaacaggaagaaagaaaaaaaaatacaagagatacatagatacaaaaggggagacaagatggttaagcgaatttgaccacccaagcagtaatgtgtgctcgaaggcaaggcttgaggcaacgaagagattttggtcgatagtagttgagttcatgttcctttgttggtctgtagcgctcagtgattcacatcatctcaagacatgaatcaacctattttttttagataatggataaaatccggcctctatatccaaaggaatcaacctatttctgtttgggagaatgttagaacaatgcttcccgttgaagtcgcaatccaactagaaatgctttttatatgcagcttgtagatagatgtgcagacaagattcagttcagcacttcagccaaactgtattcagacaagattctattatcaaaagacacaacagtagtccccacatgtgacatgtggaccaaaaggagtgaagtagtatattgtaggagtatttcaaaaactcccctgtagcctccccacttgggtctaattttattttacaggaaccgtaagcaaaccctaggattttgcttatacaaggtttacctaactataccattgatgatagagacacttacattcttgccctttcctaacccgccctgctccttcacactgcggaggcaaactttttttgaatgactcgcacgagattacaagattacaaccctggagggtcgtaaccaggaaaaagaaaaaaaaccccacccacacaccgacatcgccaacacacaagcccaggagaaggctagcaccggaccggccgccgctaagtatgaccgaccgccactaggccgacaaagggacactgacgagatcgccccataggggtgccaaaacgatgtcttcaagaagagaagtgacggaaaagccgctgccgccgtccgtcgggactcgaaggagccaagactaggctttcgcccggcaattacccttgggggatgaaacaacacgacaacaccctcaggagggagaacctcgttgttggttcgaccaaggccggactgagttttcacccgccgctcaccacctgcaaatccacggctgacgcactgatgccccaccaccatacaagctctgccgacctgtgggacccctgcactggtgtccccagtcggctagccttcgagcgccgaagatcgcgccacacccaccagcagattctcctcacacctaggtcgcctcctccaccgtcagccgcgcctctcgcgccaagccggcctcctccaccggacacgcctctcgcgccaatccggcctccctccatcggacgcgcctctcgcgccaatccggcctccctccatcggccgcgcttctcgtgccaagccggtcaccgacccctctaccaaacgatgtcgcgccggccaaatgtagccatctcccacgccctcgtcttgccgtccgaggccgccatgcctccggtgaccgtagtcatggccaccaccaccacagccactgctgttgaacgcaaagccacctcaccgtcctcatcctcacctcgcacctccacttgctgccgccagtgacccgcatccgccgacatcgccagcgcctccacaggctatcgcagaagatcccgccgccgccgggtcaccgtcgatcatgacgacaacaatacgagataactcgagggcctatatgaaaataaaccctcgattcacagtcacaggcatgcttaaatctaagccacctgtataagatcgagcggtgcagagaggctgaggttttggatcgctggaacgaagagattttggttgatagcagttgagttcgtgttcctttgttggtctgtactctgtagagttcagtgattcacatcatctcaagacctgaatcaacctatactatctctgtttgggagaatgttagatcaatgcttcccgttgaagtcgcaatccatatgctttctaaatggtaaatgcaagtagcttgtagatagatgtgcagacaagattcagttcagcacttcagccaaactgtatctgttggacaaatctgattctattatcaaaagatacaacagtactccccacatatggaccaaacacagtgaagtagtttcccagtaaaatcaattgggatagacacatgcaccagttcatccccctctcagtccttgcatcctgctgtttgagagttgagaattgagacacaagttaggcaaaggaaatcattcactgtttgttagcagtacgtacaaagtttggccagatacacaaaaacgcatgaaaacaagtatacttgtaaacaattactcctgtaaactccaatatttgatgagaaatatttctgtatgtttactcgtgaaacctgtccattggattcaacgctaaaagttttgatcccaagtatgcaacaggactggaaataagccccgaattctcatagaaacctctgccgttgtctctgtcaaccagctctttcacaatgcaaatgcatgcctaagcagagaactggttggcgtcaggaaggccaagtgagattctgttctccagacacttggagatactacaaagatttgatctttctcatcttttaatcgccttcttgagagagatcatctcagttgcctgcagcttctagaaaaaaaaaacaggtacaattcagcgaggagagggaaggtcagcaagaagcagataggacacagccatgttccagaaatcagttccaactgttagccttttttttttcctgtaaaagaaacaactgcgttaccactgtcatataggccagaacacaacatcagttagatcttactacggagctagtgcccttgtttggttgattcaggttcattcttgagctaaaaagtactaacagtttaggatggcaatgtcactgcattgcttgactgaacttgcaattccctgaatcacaggaggtagctggcagtagagctactgcgcgtaccataacgtggtgcaccacaccgcccggggatttcacccaggtgctccaggacgtcgccggcgaccccaccctgccccgcaccaagtccgtccggtgcgccgcctgcggccacggcgaagctgtcttcttccaggtcaggattatcgatcacaaccaaaccaactagtttattcagagttcagagttaatacaaaagatactcaactaacgcaagttctgcatattctcaaaaaaaataattctcggtttcggttcagatgccaactgtgattaacagaatgtgtagttgcagatggagtaataattcggggtatctttgtgaacattgcagtggagaggccgcgccaggggcaacgcccggttcccttctcctcatcgccggcggcagcggcggcggcgtctcgacatctcttcctcccttgtacaacgacacgacaacacgagataatacgagggcctaaacgaaaatcggcccacggattccgaggcgcgtctaatctcagccgcctgtatatgatcgaacggtgcagagagaggctgtggttttggatcgctggaacgaagaaattttggtcgatagcagttgagttcgtgttcctctgttggtctgtagcgttcaatgatgcagagatgccgtactgccgtttaagcttcagaacctattgatgttatacagtacagatacgagtaca

SEQ ID NO: 72540 - DNA, 1120 bp, Oryza sativa
atatcgaccacatcaaatactatctcttcttttctcacattagtgcctttttcaaagaccacttgtaaagatatttttccaattgcatgtacttgttgtccaccaaacccttgtaaaggtactcctgcgtttgttaacctatcttctggtatttgcattttcttgaaagcatcgtaaaacagcacatccgctgaacttcctccatcaattaacaccctttgcacttcgcattgtgctatttccactgagaccactaaaggatcttgatgagggaaaagtattccttctgcatcttcaggcccaaaggaaattaccgtttttgagtatactggtgattttgactgatagcttgtcccgacatgatttacctgtctgacatatgcttttctttgcctttttgactcaactcccaatgaagagcccccagttatggcatttatcactctctttggcacttcttcaattgcctctatcttcataacttgcggtgcttctatggcattttgtcctcgttgatcacgagctccttcatacttgttctcatatcgatttacgtgtttttccaacaagtgggtcatttgcctgcattcttctgtggaatggcctcccggaccatgtatatgacaaaacttactgtaacattcttctgtggaatgacctcccggtccatgtgtttgacaaaatttggtttggtcaggtttattttctcttccttttcctctttcattgttccaccatcgtcctctacctctgcctgaattccaccattgtcctcgaccttttccagactgcccccaattgtttctccctctgcgagtgttgtcccattgatgttttcctttttctctttcattgttggatccatctccgataaaatttacctgttttttctgatcttgtttatagtcatacttgaactttttccagggctttccggtattctctcccttttgttcttccccttgggaaatttgcttgttctttgactgcttttttcccaacaagacggcttcttcctcttgcactctcaactcatcttcttctcctcttgcaaaactttccattctttcaaacaagtcttttgctgtttttggtctatttctagcaagatcaaaacgaa

SEQ ID NO: 72541 - DNA, 5021 bp, Oryza sativa
ttcctgcagcctacacgctatatctatctgatcggctatgctatgaatatatatataatctcattattaatatatatttcgatgtaagtgatttatactgtctcggcaaggtgaccgatctatcccaattacttgattcaagtatacatcgatataaggattatgtatcattgatatttacagccgatcgagtagatttagttctgatttgttttcttaacaattgccgatcgatttacatataacatcggctcaaagataaatgatatgtcatcggcatttagccgatcggctatcatttatggatttaattacggtttctttgtctttgtttcttgttgattgcaggatcaaatcaactggcacgctcatacatccaaaggcgagttttggacctgcactggagctaagcagatctcccaggcctcgtgttttctatcaacacctatattatgccattctttggtatccttgtgcacttgcatatttgttgtgtgccttgctgagtatgtcatatgctcaccttgcaataatcaatcaaatctcagttgaagacaagtcgcaaaggagaagacgtttggcttataccccagttgagctgcctgtgagagtggagccggagcttcgctagaccgtaattccgcagcagttttcttttcttttgtaagtatgtaacgttattattatgatgaatctgtatattaaattgtcagtttgtgtacctcggctgattcctggacgaggatttcatgcacaaattagttcggaaattactagggtatttccgggcgtgacaaccgcaatatttaatcccaggagaatcctttccctttttcccttttcttttcctccctatttcctttgttgggccgtcggcccaaccttccttcctcccgcgtcctctctccctccttgactagtccggcccatcaccccactctcctctctgggacgctgacaggtggggcccacctgtcaggtcgtcccctacctccagtcgcccacgccccggcgccaaccgccaccgaaaccaccgctcctcatgccgcccaccttccccgcctctcgctcccgcaccttgcgcccacgccacccacctcctccaccttccccgcatctcccccgcgcgcgtgcccgcaagtggtgggggacttgaaatcccccaacaccctctctctccccacctcccccacgtcgtcgccggcgccaaccacgacctcccggccatgttctcccctccctcgcctataaaatccctccccggagtcccctcttcctttttccgcgctcgccgctctctcccgtgcctcctatcgcgcccgcgccactcgccgctagcgccgccgcctaccaccgcctccggccgtgcgccgtcgccgctagagccgccgccgcgccaagccgccgccgccgctagcttcaccgccgtgtgggtcatctcggccaccacctcgcgtcgccggaaccccatcggaaccccatctccctcgcgagccggtgagctatccattcccctccatctccggccggcgtttaaagccgccgtggtcatcgtctcctctcctaactcctctcctcccctcctctaggtgtcgccgccgctcgtccgcccctcctctcaccgggtggtcgtcgccgccttcgtcttccactccggccgccgtgtcgccggtgaggcctctcccccccccctttcctccccatcccgcgagcgccgagccacgctgctactccggccatgcgccgctgcctttcggccgtcaccgccgtcggtggccgtgcctcgccaccgcctcgccttggtcggccggtcggccttgaggccaagccgagcccggccggcgcctccactccctccactttgagccaccgcccgtggggcccacatgccggtgccctttcctctctcttgagtcgctgacgtgcggggcccacctgtcggcgccccccttgctgacgtcagccctggggatttattgcgccataattaattaaggccttttctttattagtaaaaacacagattatcttctaaaattcataagtaattcatccgagctccgtttaagtccattcaagtctcaataaattcataaaaatccctagaatctattaaaaatggttttgttctctgttacagtagtcttatagcgtgtttttcttttgtgctttgtttgtcgcgtagatttcggccgcttcgtcgatccgcggtttctcgaagacgttgctgtggtctcatcagtgcgagagcaaggcaagtcatgtattacatttgatcgtattgtacccaatttacaaatatcccgcatttctattaaatgttgcattcttttacaatatcatatgggatgggtcctattattcagccatatattgtttaccttatgccattgataacttgggtttcaaaatgattagatgttggtttaggaaatgcttagccatgcttagttcaactagtacacaaagggggatcgcattattacatagactttgactattagcatagctttggattggttccaccgcaatggtgttagttaattaaaatacactgaatggtgggctgtgggtgcatggtttcgctggtcgcacccatggcagttaaggaccagttcacgggaaaccctgggagacttaccgtgctgaccacaagagggagtgggtaactgcttgatctgaagtatagctcgacactttcctaggcaccggtggcgatggtgggcgtgatggagttgggtcggccggggtgtccggttgtctagctgccggattcaccgcggcgcaagaggggaccgcccactgccttttgaggggtgggggtgaaaccttagcgtggtgtgaatggttaggggagggttatgcggagggtcttgtcacgatttccccctttgcagtatcatggtgatacttcggggcatggcgacatgtgtggaatcatatcttgtgggtacagttgtacacctctggccagagtaaaactattcgaatagtcgtgctcgcggttatgggcgatcaaccagattcactgtgattagtctcacccctagtttagtttaatgcacattcagcttagaaattctggttcatgaatttctaggcgtgacattcgggtaaccccaaacggatatcgaactcagggaacgtgtataatctatctaaggctaagactatccaagaacaacaactgaaggtaggctaggcaggctagagaggactttctatgtttttaattatctaagctgagtaaaacataatttcctgtatgatgctccggacaccgacccctgctggtctgccaacgtggttccggctatagctctatgatttatccgaatgcggaggattactgggacgggattcagggctgtcaccacctgccgtctacctctgacaaatctgtgggatacacaataaacaattactactctaatacttgcgtaggaacttccttctctatccggagtcctagtactagagcacttagtacgaatactaaataatgaacccacaaagatggaaatatatctcacttagactaaataattaaataataaaaaagaaaggatcccaaatgcttactttatagaagaagtttctgcgaacccggagtaaagtgtaccgacaactccggtactcctccagaattcctactatgaagctacactcatcgtggtagaagtcggatgagcaccaaacttccgggcattcctccagagcttcccctcactctctacctatttttaatgtacaaaagatacaacagagcctcttgtaattcagctcaaagttgtgtgttggaaataagagttagctcctccttttataggcaggtatgacggttagagcctatgccaaatgtccaaaatgccccggaaccgccattaggatgtaatcagggccatcgatgtaaaatcaggcgatcaacggcctccaaatgggtttggctaaactggtggttcaaccgaacccgggatggctccgttcggctcatttttcctcgtggacactaattttgaggcccttagcccattggcatggaggattgggccatctggaggcgtttaattgggtttttgggtccaaaactccataagttggtatatgtgtttgattatcctccttcatgtatatttcctctcaactttgttagtttgtcacctgcatccaaatatataccaacactaatagaaatgattagttataaaccctaccactaagttgaataccatattttattccattatatgcaggtattgatagtcatatattatgatttaaggaccgccaatagatacgagcggcacgagtgcttctaaggcaatcatcttccaggacaaatcagagatttgtgcagccttgaggtgaggtttttggcgatttcgagctgggcttttgtggaggccatgggatcggaaccagaagaatctggtaccaagatgtcacgggctagagagttggaatgaggattgcgatgcagttgatatttgaacaaagtggatgggcgtggccctggacctcgtcggcgcaacgtaatttgcgacatatgttggaattggacatacaactcctcgtcattcaaaattcccaaaatgttttagattgcgctcggggtgcatggttttcatagtagcacctcggccatcataaggatcggtcttcgggcttctgtttcaaagcactaccgtacttccacatgtctaatgggtaaggcttagtttggggctcaacctggacatgaacaaaaggacacggatacagatgtcgtggtagtcgagatatcgtggcacaggacgggcatccgggtggtcactcctgagggatgtcctgatgccatggggctcaactataacctacctgtccggggagccctgtccgtaggcgggtgttcagtcggtactcttgttcatggctaggatgagttaggaactatgtcacctcctccgtccgtataccatggtggtatggtgcatgcggcgacacgtgaggaagacgtgtcttatgggtaaagatgtacacct

SEQ ID NO: 72542 - DNA, 7732 bp, Oryza sativa
ctcgatgtggtcaggggacgcagatttgacttcccccgtgtaccgggtggcgccgcagccttcttcccccgaccacacgagatcatcaacaacaaaacaacagaaatatacaatattttttaatgcaatagggatgcatagttctttggatatccaaactgcatgtctgggctctaacgcattgccaagaagatggtaacattatttttgcagacaatcggtttgagatttagcgctggttcagtttgttgccaaaactagcattaccaaaatttggtattgtccaattctggcacaatttagagttaccaaattttattaacgttggatatgttcaatttgtagccatgttaaaatttagtagctagtgcttgtatgagaaggaacttccggaaataccaaattgtggtgaagtgacaacggcaaaatttgtttagtttgttatcttactaaaatttgataacataaaaaattaataaagttaaaattgacggcgaagtgaataagcccttatttagctttccattccgctaggcatgcgtgctgcgtaatcatttgacgcttcaacatccaagaccttgactctcagtcaacctagaaggaaaaaccagtggcagtacgatccttatcttcccatccaaaagtgggtttgagcgacaattattaggcggctttccactctacttaggcattgtgtagttctaaatttttttttctaaaaatatcacatcgaatttattagccgcctgccacagtcgctcctggtgtcgcctgtccgccgacgctcgttcggtgagggagagagagaggagagaagaaagagggagaggagagtaggagacagaaagagaaagagggagagttaaaataattatgagaggaggagagagaggggaaaaaattgaagcagtgggagggaaaagagagtggagggaaaaaatgaatggagggaaattatgagaggagagagggcaaaaataaattttgaattgaattttatgatactaaatgaactcatatgaaaaagttgtcaaaaaaagtttatatatctcatcaagatttataacttttattttggcatttttctatataacattttttgaacagtttgaatttgaatttaaaaatatgacaactccaaacaatattttcaaatattaaatgattttaacttaaaaaattcatcaacaacaaagttgtatacctcatcaagatctattacttttatttgggtatttttctatataacaattttttgaacaatttgaatttgaatatgaaaatatgacaacttcaaacaatattttcaaataataaatgattttaactgaaaaagtcatcaacaacaaagttgtataattcatcaagatctataacttttattttggtcatttcttcatccgacaaagtgatagtaacattgttcacaaaattcacatatctctcatttggttttataaactataacatagatatgtaaattttgtgaacaatattactaacattttatcggatgaagaaatgataaaaataaaagttatagatcttgatgagttatacaactttgttgttgatgacttttttagttgaaattatttagtatttgaaaatattgtttgaagttatcgtattttcaaattcaaattcaaattcaaactattcaaaaaaatttatataagaaatgaccaaaataaaagttatatatcttgatgagttatataactttgtcgttgatgacttttttagttgaaattatttagtatttgaaaatgttgttttgaagttgtcatattttcaaattcaaattcaaactgttcaaaaaaagttgtatagaaaaatgaccaaaataaaagttgtaaatcttgataagttatacaactttgttgttgataattttttcattttaaataatttattacacgaaaaattattttgactaataaaacgaattattatactgcagttaattattttgctacaggtcaactcacaaatataaacatttcatatgaaaaatggaaaaaatgtcatcaataacggccattagttaaagtccgacagaggttaagtcatctcaatcgggcattaatatagagcccgtcacggatgagtcatatgcgacgggcctagttgttatatcacacggatgtgtcatatgcgacgggcctagttgttattttaatcgggccccaagttggtgcccgtcacagatgatggtcatctgtgacggacgccaacttgaagcccgattgtgatatggaatgttatctcaatcgagcctaaattatggcccgtcacggatatgtgtcatccgtgacgggtctgagttttatatccatctaatatgtctgttcgaccatatctcaatagggctttttttggcccgattgagatgactttcttgtgacgacccgttaattataggcatattagaggccgtcacatatggaagattctgtactcatggtggtttttctttttttttccactcaccctcaaataaataatctttactgcgtgaaacactacgcacgatatgtaatatttatatgcaaattgaacgttgaaaagtggtcaattcataacccttcgtcacgccgcagaaggaaaattaatagcatacaggcatgcatttacgtacttgaaataattttatgtcgattgggtggtgagtggcaatgcctgtctacccctaccgttacgcacatacctcatgttcattaatttatgccgtttccatttaacatatctctacttcctaaggaaactgactgactgacaaataggacatgcgatttttttttaatcttcagcatatgactttgacaataaatcaataaaatttaataagttctttctatggaaaatctcgacataacagttttatgattttatattaagcgttttatttttttttacgatcaataatttaaagttttgactaaaaaaagttcaaagttgatcacaagagaatcttattaccagtcgtactcgtgttctctctctctctatatatatatggccaaacaacgaaaacacagacagagacacgagcaagctaacgagtgagtgcaaattaagctagtgatcgatagtggtcatgggtgttggtcctcattgtactactagtctgctaataatactggccgtcgtcatcacgtcgtctttgctcacgacgacgatcaaggcagatgagccgagcaatgataccgacatcgccgcgctgcttgccttcaaggcacagttctctgaccctctgggtttcctccgtgacggctggagggaggacaatgcatcctgcttctgccagtggatcggcgtgtcgtgcagccgccgccggcagcgcgtcaccgccctggagctgccgggcattcccctgcaagggtcgatcacccctcacctcggtaacctctctttcctctacgtcctcaacctcgccaacaccagcctcacggggacactcccgggtgttataggaaggctgcatcgcctggagctccttgatcttggctacaatgccctgtcaggtaacatcccagccaccataggaaacctcaccaaacttgagcttcttaatctcgagtttaaccagctatctggtccaatcccagcagagctgcagggcctgcgaagccttggcagtatgaatctccgtaggaactatctcagtggcttgattcccaacagtctattcaacaacaccccattgttaggttatctcagcattggcaacaacagcttgtcagggccaataccgcacgtgatattctcgttgcacgtgctgcaggtccttgttctagagcacaatcaattgtccggctcactgcccccagccatcttcaacatgtccagacttgaaaagctgtatgccactcgaaacaatctcactggacctatcccatacccagctgaaaaccagaccttgatgaacatccccatgattcgggtgatgtgtctctctttcaacggattcataggccgaattccacctgggcttgcggcatgccggaaactccagatgcttgagttaggtgggaatctcttgacggatcatgtgccggaatggttagcgggcttgtccctgctaagcaccttggttataggtcagaatgagcttgtcggttcgatcccagttgtgctaagcaatctcaccaagctcaccgtgcttgatctgtcatcttgcaagctaagtggaatcattccattggaactaggaaagatgacacaactcaacatcttgcacctctcatttaatcgcctaactggtccttttcctacctcccttggtaacttgacaaaattatcttttctaggattagaatctaacctgctgaccggacaagtacctgagacccttgggaacctcaggtctctatactcccttggtattggaaagaatcatctacaagggaaacttcacttctttgcccttctctccaattgtagggaactccaattcctcgacataggaatgaattctttctcagggagcatttctgcgagtttactagcaaacctctctaacaacttacaatatttttatgcaaatgataacaacttaactggcagtattcctgctaccatatcaaatctgtctaacctgaatgtaataggcctttttgacaaccaaataagcggcacaattccagattctataatgctaatggataatctacaggcattggacctctctataaacaatttgtttggaccaatcccaggacaaattggtaccccaaaaggaatggtcgcattatctctcagtggcaacaatctttctagttacatccctaacggtgttggcaatctaagcacgttgcagtactgatttctgtcatataataggttgtcatcagttatacccgcaagcttagttaatcttagtaatcttctccaactagatatttctaataataacttaactggttcattgccttctgatctcagttccttcaaagtaataggcctaatggacatctcagcaaataatttggtcggtagcctcccaacttcgttgggatagctccaactgtcaagctacctgaatttatctcaaaacacattcaatgattcaattccagactctttcaaaggtctaattaatttagaaacattggatctgtctcataacaatctttcaggaggcataccaaaatacttttccaacttaacctatcttacttctttgaacctctcctttaacaatctacaaggtcagataccaagtggaggtattttttcaaacatcactatgcaatctttaatgggaaatgctggactctgtggtgctccacgtctgggatttcctgcatgtctggagaagtccgactcgactagaacaaaacacttgctgaagattgtgctccctactgtcattgtggcgtttggtgccattgttgtgttcctatacctaatgattgcaaagaaaatgaaaaatccagatattacggcttcttttggcatagcagatgcgatttgccacaggctagtgtcctaccaagaaatcgttcgcgctaccgaaaatttcaatgaggacaacctacttggagttggaagttttggcaaagttttcaagggtcggctggatgacggtttggtggttgcaatcaaaatcctcaacatgcaggttgaacgagctattaggagttttgatgcagagtgccatgtcttgcggatggccagacatcgcaacctgataaagatactaaatacatgttccaacttggatttcagagcactgtttcttcagttcatgcccaatggaaacttggagtcatacttgcactctgaaagcaggccttgtgtgggatcattcctcaaaaggatggagattatgctagatgtgtcaatggctatggaatatctgcatcatgaacaccatgaggttgtcctgcattgtgatttgaaacctagcaacgtgctatttgatgaagagatgactgcacatgtagcagactttggcatagcaaagatgttgttaggggatgacaattcagcagtttcagcaagcatgctaggcacaattgggtacatggcaccaggtacttacactagccaatctaaagccacatacattttttgttggagttgttacaaattcacttcaagatattggccgggcttctgacgaagcggagcggaggcccgtcgccggaggcttgggccggagccagtgggttggtgtatcgtgtagccgccgcaggtaacatgcatggcttccttgtgccagtgttcgagctgggcttgctctgttcggctgactcccccgagcaaaggacggcgatgagcgatgtggtcgtgacactgaagaagattagaaaggactatgtcaaattgatggcaaccacccgacccggcaaaaaattgatggcaaccacagtaagcgttgtgcagcagtgattcatcgctctatcgttgtatatgagcgaatgaaatacatatcatttgcatcattttcttcttctgcattaggaatagcatcagtgatcgattaccctttgtttgtatttgtgtatggttgaattgaatatatatatatatatatatatatatatataacaatttcgttggtgtaaatatgtgattgaaccgctggtcaataaatttgcatcacgaaaatgggagtagatgatgtgctacttatgttttcttatttctggccaaaataaataaataaaaaaggaatattatcggcacagcatcacaactccggctcgttcagccttaaacaaccacaattaacagtcctaagcagagaaacttaacaagcttttcaggctaacagaacatcaaaaggtccacaagacaacagggtcttcagagagcacatcttcaggctgtcatgcacgcaaaaaagatcagacagccagatgagagcgggtacaataaccggtagccatctcagtaaaactaacgaggctgtaggacagagaagaaaaaaggtagtaggaacgggcgacaatagtcggccagctctacatgagctccaaggtgaaaaagcctacaagataggaattttcaatttttaaaaatggccatgggcccacaagtagtgagatgcatgcaatgaaagatgctagtcagttgggtcccacaagaaaaagaaatacatctcgggattaactgctagcttactctagttaatatggacatggatggagccggcagccagcaatactattgaacctgcttaagagcaagtgcaatagtaggctatataccagctataaacatactttaaagagataaaggaagagagagaggaatagcagattacagcacggattacaagacgtaatatgtgtataacatgtgagaccagatattaatagtatagtaagcaactattgtatgaactaggaaggaagcccgcgcagatgcgcaggcatctaatttattgttttatgatttatgaaataatgctaaaagatgtcatgtctcatcttttttatgctgtgagataaactgactttaatatacttagtaaatgataagaatgtctccaagattaaaagaaaatcagtctgttccgattacttataaattctcctattgtcaccacaacttattattattgttttaaaagttatgatctataaatagattaaactggatatgtaccaataaaataagcctaatacatcattgatacactaaaatattcactacttatctaagtgttcatgtttcacttatttccgaatcaatatataaatattttaaaaatcccctt

SEQ ID NO: 72543 - DNA, 9162 bp, Oryza sativa
tatggcttcactggtcaatcaagttttaatttaggtttaattagacctaaagtgtatatatatacttatacatgtttatgtattaattaaacaacactatgtgtttaaattcttatttcactaagttaaggttttgatcaatgttctctacagaaggtgccaaattttattttactatgttgaagataactatttgctggttctatagaaactttgttcatttcatttggactaaaatgaattttctacaagttttacaaattaatggctgctctatgttagtaaatccttatatgaatatttagagacttttactacacagcaagtatataatattatttcataacttggaaatacttgtgttagtgatcctacataacttaagtttattcaaattgaagctaaattgggttctacatgaatttctaaagtttagcttatctaaaactagtcattttaaagataatagttttagaggcttttaatgcaaagtaagtaattacttttatttcacttaatcagagattgtatgatgatgaatgatgaatctgtagaatttgattttgtttcaaaatgagttgaaatgaattttctatgtattttataagtttgtacatgttttatgcatgacttatcttagataaatcttagagacattatttgtacagtaagtgtcaagttttatattcctggaataaagttcataacttcaagaatctacagaaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgatgtttctaggaatcaacccgcagtcctaggcccatatgtcagttactaacattttgcgcaaaaacctctggtttctcgggaaatagatcccgcagtcccctagttttaggtttgtatgcaaaacaatgcttgagttttagtttatttacagattattactggtcctacttgtaagtgactgttccagttgttaatacatccctgggagtctttaaatttcaaaagccatgcccttgctctggacagagcagagcagcagcacagccgtgagcttcacagcatcaccagtggcgaacaatggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcatgtgggttttgaggctcgatttaatcgtgcatgcgtatgataaggactctagggactactaggaggctcaccaagaatcaaacgcggctcggcgaagtcttggcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcggcggcggccagagcacgacggtgttccgagttgacgcggtcgcgttcccggagattggctgcactaaaagaggcgttcttggtggcgttagagacggcattgagagggaattacagaacgcttattgaacggaaatggagctcaccggatttcgacggcgtcgaggacttatctcaccggcgccggagttggcacccccgttcccggcgaatctgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgttttcttttagttgtctgcttcaaccgattaatttgagatatcaacatgagtgttaacatgttaccaaattacagaggacaagtttgtgctaatcactgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccatatgttatcacccaagattaactataggtttgtttagtgaaataattcttttagattatgctcatgggatctattatggaatgcaagaccaaaactccaaatgcacaaagaactcgagcctaggcatgcattatgtacatgtatgcttgatgacatttctagtctaatgttgggaatgaaaaggttttattttgttctcaaattttaatcatgcaatggtttaagttgatcatcacctaaattaaaacggaaatttttggctctcgaaatttggagaagttaacctctaactattttgacaagaaatcttaagtcctaaaatttcgggtatgttacacaggccgggggagaggaggcggctgcaacaccggggaaggcgacggcacggccggccggcgcacggtcgaggagggagaggcggtggaggcgcccggcgcggaggaaagagaagggcgacggcggggaggtggctagggaccacgggagaatgcgggagggggctaaaactggagaacggatcgagggggttccattttataggagaggagagggagccgggcacgggagagggcggaacggcgacgggaaacacggccggcggccatggaaagcggccggggaagacgcgggcgttcccggcgattgggggcacgattcaagggggaaattggggggaattgaagaggattcaatggggattaaaacccccgaatcaattttggaattagccaaatgaatcagcggatttgagggaggaacggcgctagggttcacgggagagggaggaggccggctgggggaggaagacgacgtcctggcgcgtgggccccacgcgggcgcgcggtcagcacgtgtgcaacgcacgtgcgcgggaggggagcggctcaggcaggggcgcggcgtgggccgggcagccggcccaggaggagaggaggggaggggtggcccggggagagagggaggaggagggagtgggccggggaaggagggagggcggcccaagagagagagagagggggaaggaaaaagagagggaggagggaaggacttcggccgcgggccggggggagagagggaggactttgggccagacttggcccaaaggaggaaggaggattatttttaggtttttctttttaataaactttgataattgtttttgttgcttaataattattttcggtgctctgaaaattcaagtaaaatttgagggctccttttagaccaaagagaatttaacaaaaattctccgggccacatttgaatttttcttgtacgtattttagtgtttgccaatttcttttcgaattttaaataaattctattattccttttagagaatgatttttaattcgggatgaatttatcaggacgtgacagctggtgctatgagataggtcatcggtcttcgttggtaggttgggcgcgacgattctgcatttgtcgagatcgttctcaataatggggtgtactcgaccacaacctactcgagtgctcaattgttcctgaaaaatattttctagaaggcaagaaatatagcagagaatatcgagtatgtactcaaaaaactgcataaatcttctagtattatcaggatataacgagcagatgtaaatatcaggcattacgtgaaccgtaaacaagcttgatttgtacaaaataaaatagagcgagcccccggcattaaaccgtagtcggtttaacatcagggacactcgcacaacagatattgtacaaaaagcatgctctaggtaaacataattgatctgacaatatctgaaaataggtacggtaaattgtatataaaatattgcgtacctttgtagatatatgccggatatatctacggaataagtagatcaattaaattaattattccactaattaccttaattttccttggccggtcaatgcacagaccgtagctctgtacataccaatatgcatccgtatgcataggcatgtatgtgtacagcgtacaggggtgctggtcacggtagagtgcatccgatgcatgcgaggtgaagtcgggatctcgtcggaagacatactccggtcgggttagatcttcccacagccgaagttatcgagcagcttgttgttggagaatccatctcttaaacccatctcgtcgaaatcctgaagcaccaaaatccccctacctggcgcgcctctgtcaacgtttgatgtcgcgattccggtatttgcatagtatggggatcgttgatactaggatatacgcgagactgaggtaaaagagatggggacgaggatttttatacaggttcgggcctctgaattgtcaggtaataaccctacatcctgttggccgaagccggtattactcttattcaccataatcacaccagtacaatatgtgggatagcctatctaattgttgtcgacatggcggtctgaaggtctgactcgtagtcggcaacagggtagtcttcttcctcgaatccgtgcccggcaagatcagagatagcgctttcgtctctcctgacagtatccggagacaccgtatggggttagccgtgcttatccttgaagtcgatatccgacgtcttgtcttggcgtatgttggcttgtatgttgtggcttctgttgttccgtgttgtccgtgtcccctctcctcctagggggccttgtatttatatccataggtgtccccttgtccaaatagaactagggaaaccaatatggatatagtccgagtggtacttgtcgtttccatgtagaactctggttgtctttccttatccaaaactccctccatatctgaagtcagtttccgtataagacatggtatgtggtgggtcctgccgagatatagtcgactactattaggtatgtggtatccataaccctgacagtcgcccatgtaaccctagccgcgcgtgcgtgtgtgctgtggggaagcggcacgcgggcgtgtattggtaaataacagtggcagataagtcttccctctctaaatttatttttttattttcttctaaatctattcctcacagtgtgaatacaatagggctagacggccacttcgattttgaaaaagagggtcaaatgaacaaagttaaaaatatagggtcaaatttatagttagactttaaaatagagtgaaaaaaagcaattgtctctttgtcgttttccatatatatggtcgcaaacatttcagggctagcccagccttggctggccaatcaaagtttctacaattctctctcagttctatcttggtatatcagatcctcatcatcaagagatatttttcttaaccagcagaaaaaaattcgtccccatcttcgaatttggacgaaatacattgaaatgcttttaaatttagcattaataatatcttcaaatctgtccaaaaaacaacatcggtagtgtgcacttagaatcagtggagaatggacaagaggctagaaaacaacccaatggttagcattgatcataatgaagtgtcaagtatatatatggaagttagagttatatcagatataattgatttctatcatagtcttactagtcttacttatttttaatcttttcttatttctacctaagcatatattctacatatacaattgccctgaggcccaatacaacaaatccaatattcacaatatatgtcctcccattctattcaacacgaacctgagcctcatatgtcgacatgatagggttgatgaacatatatactacttcctccgttttataatgtaagaatgttataatgtcgacattatagcattccccatattcatattgatgttaatgaatctaaatagatatatatgtctagattcgttaacatcaatatgaatgtgaaaaatgctaaaatgacttacattgtgaaacggaaggagtattagacatgctttttaccctctctagtggtcgccaccctccccagccttttccttttttctttctcacttttgtaatctcttagccttcacggctattatacagtattttcctctcctttaatacaaacacaccatgctggggtttaaaaaaagacagtgatagagtattttgttgaacttagtcacccataattccagctacatttatcatcatagaaggaactttcatgcatatgctgccataagtcaataagtcaacgtttttatcgttttgtacaatggttcatcgatgctgacacctgacatcgataccggccggcaacaacaaactgattgcaactagaagggaaaatattagaaacaagaagctttagctttgttcacctacctactataccatcacgagctttaataccgggtagcaaaccttcccatatttatatatgcgatttcattcatataatatatactccctccgtattttaatgtatgacgccgttgactttttgacaaacgtttgacctttcgtcttattcaaaaaatttatgtaattataatttattttattgtgacttgatttatcatcaaatgttctctaagcatgacatacgtatttttatatttgcataaaattttttaataagacgagtggtcaaacgttggttaaaaagtcgacggcgttatatattaaaatatggagagagtataagccaatggatgcatggctttgtcatgtggatgagatttagctctccctcatctcacctcaggcccgtcaactcgtctcaggctactaaatagtagtgtagtaccttacacgaacttcacaaatctcacagccatctcctgtcctctttgtgcaaccgcatgagagcccagcaaatctcgtacagtatatggaatcaccaggagtgcgctgatcatcgtcttcctcacgatgggggatgccatggttagctgcacaaaaggcatctctccagtgaggtgagcctccctcacgacatacgtccacttgaacattttttttgttcttgtttaaaattatgtgtagcgattatacttgtgttcttgtatagcaattctacaaaactaaaggtactatttgattcaacaaaacctgcgaacagtatccaaaggggggcaaaattgaaggggaaaataaggggttgtatgcacgatgagtttttcttctttttgcacaatttacaattgtacgatgctttggtatagtaggagagcctagccgttcaaaagcatcttgcataaacagaaacttttaaacaaactacccttgctaaggctcatcagtacgctgatcaaatgtactcggtaagggatgcatggatattttcaagtggagctaatcatcatcttcacggttgctttgagaaccatatgactaagccttatcatcaagtatacagacaatcgacatgccttttaagaacttttttttgggtcatgcctgataacttctaccttacgtactacattatttgtgtaaggcacaatcacatggagttggtggcattatgctctcatgagaacattaaatttcatcaacttacatagtacggactatttacttccaagttgtgctccttgcatccttgattaatgggaacaactcagctcatggaatctcaaagtaaatggatcacattgccaactaatattagcaatatattactcctacatctcatgtcttgtcctgttcaatacacctaggcacttgacaattggtgacagttgcagttttccatgttgctaattactcccttagaggggtacatcagagtcaacacaatggaaggggaaaaactaaaaaagcatcggcgactttgtagacttgtatgcagtcttcatactttataatgtctcattgtacgttcttgatgtgatgcaagaccggtttctctctagtgtccagccatccctctgcttaatacagagttcatctctcttaacattgaaaaaaaatagagttcttctctcttcctagctcttctcttgatttgtccatgttgaccatgtcgccgaagatccatgatcaacgtggccatttctgttcttattgaagtttttttactgaagagatcttgttgttgggagttgggacttgggagggaccaatttttctgaacatatagcactctccttcagtccttctgcagcactctgaccaatggcatgataatttgtatccatatttccggttatttctcttattctctggttcatatggcgtaaccttaatttcttcttttccattgatgtgttttacttctaaccattggttgcaccagctttctattaatgaacttgcaattcacctgttcttttatttttcttctctttgcaggtgatctcaggttttatcttggtggtttcctgctgaaccttctgctatcgatccatcgaaaaatctagtgagttgatagttgcaggaaactgatgctatcaatccgttgaaaaatcaa

SEQ ID NO: 72544 - DNA, 22899 bp, Oryza sativa
actttaacccactttaaaaagagaggatggatgaagttaaatgttgacgggtttttgatgcaacctcaggaactggaggtctaggtgctgttctcaggaatagtttaggctctgtcattttgtcatttttttcagcctgcggttctatggagagatgtagcagccctcttgaagctgaacttttggcttgcaaagaaggcatcaatctagctctacaatgggctctgctgccgctcattatggagtcggattgtttggtcgctatcaatatgatccagtcaccagggagggagatgtcccagcttgcttaccttgtcagggacatagaagagctgctggcaggcgatagagtggtcagcattcagaaagttcagcgatgccagaataacataagccactttttagctaatagaggccgcactaattttctttctgagttctggccagatggctcttgtaatctcatttcacagtttgtgaatgaggaagctttaaatgagtaatatatctggtcttcctcgcaaaaaaaaactcactgaatatcaaaagctcatcatataaacatagcaactacatctataagttattacattttaaacctcaacatatgagcatcatttttcgcaatagtgatttacagtctctaacataaaaatttaactagatgaagtaccaaatttcaccggtacttgaaggtaccaaatttgcactaaaaattttggtatctcttcttatctttcgagaaacagtaaatttctcttttcacaatattttaacataaatctgctcattatttatataacatttaacgtgtattcaatcatatattttacagtaaaacttggaagaccgtctaatataatactatttcagggaacgtttgctttgaattactgtcgattcatcccagaattctcattaattttccacgcaatctacactagacaacaatagtttatttatgtcaacatcgaatggttcaaatcgagagtacctgactgactggggtgcgatcgtttgtgcagtggcggtggacagtttagtcgcacgcaaaatgagaaatacgattaacatattattaattaagtattaatatataatttttttatgaataaatttattgaatttttttaacaacttctttatagaaagtttttgcacgaaatataccgtttagcggtttgaaaacgtgctaacagaaaacgaggagaatctaatcctataaactgaaaagagcgcaccctaaagaaactatcagatcggatgatccattcagcaaggctcgattaacctctgaatgcacgcaaaaccctcttcacccgtacacacctgcatccccccgtcccgggccactggttttccaccgccctgacccgccaagtcgcgatcgcaactcacacatgctactgatgatgtacgtacggacgttacgtagcgcgcgggcctgacccggggcgacgactcctgcaggctgcagcgtgcgacgcgacaacgacgtgcgtagtggcccacgccccacgtaacgtagcgtacagtgtacacctgatttcgctcggtcgagaggtggagccgtggaggagtcgatgccgtggtgtgcgcgcgcgtcgcgccccaccaaccggataccagcaagctagcgagaggagagagggccgggggggccctaacggctgggcgcaacgtgacagcggaatccggacaagagcgcgaggccttttgcgccaaggaatttcgaccgggcgagattccaaccacattacgtacgtccgctgtcacccgggctgggcttagctatcttgtggcctatatatactcgcccttgacccgattacgttctcgtcccaaaccaaaatttctcatccttgccaccacagtgaccactccgcccgtctctcctcctgatcgctcgttgttgtctcttctcgcgcgtagagctctctgcactacgcaaagcagaggctaagattgatcgagtgccattttatatacaccgttgtgcatttccctcgcgtaggtgtggccatgtctcccgctatgctgcaggcgtcgtcgctgtgcgtatccgcggtgctgtcaggcgccgcgagctggccgggccgcctggccagccaggggcaccagggcaagcgggccgtggcgcagcctctcgcggctagcgccgtgacggaggcagcgccgcccgcgccggtcgtcgcgccgccggcccgccccgtcgacgccccgcggcgccgtggcggacgtggcggcggcggaggcggcggcgagctcgtggcgtggaagagtgtacggcaggagaggtgggagggtgcgctcgaggtggacggagagctgcctctctggctggtgggttaagcctcctactgattgcaaatctccctaaatatgacttgatttggcttttgccttctctccaccctaattaagtattcatgaacacaccataacctcagcattttataagatctgccggtggtcaagctaaggctagccgtgcatttttcattcaagaatgcgaatcttttctgttattttgattcaaaggtttcccagtactccatatcgctttcttgagatcatctataaactaaagatccttttgaacatcttagtaaaaaagcatgcacaacatcttcccacacattgagaaatacgaaaggcactttctggaccacatcactgtgcaacaaatcctttataattaacctaaccattttcatcttgtagcatctccttgattagtgcaggctaaccgctgacctagagcacatatatgcatatagccccagaagggtcctaaaaaggtaccagctttggccacgtacctagcatatttttaccagcagtatctaacacgccagggtatattacttgccgactgtcatttttaatttccactgtgccagcagttgctgaagcactcacccaaatcttcagtaatttgatcgacaaagaggagggcgacactaacttaccctatgctggcctagcgaaaaggagatggcatcttggcactcacgatgcttgcggggaacacaacatatatacccagattctctgctcacccctagcttcgatcggcgacaacaatggcatcactgtcttgtggttgcagttttgttgcaccccgcaactctctgaaaacaaaagtcaaaaaccttggtctcccctaactccaagtgatcttatcactgttcttgccaattttgatagtgacttgatttgaggaattaatacaggtgtacatgtagtataatattgttgtaactttgtagttacactcactaagctatggataatacaatcgtttcagctaattaaaaatgcaatcttctgaggtaagctcgtggatagattaatttgtcggtcgttaattagaggtggacggatttgtcgacgtgctgcaaatgattgatcggatcgatgcatacttgctgcaggatggcacgtacctgaggaacggcccgggactatggaacctcggcgactacggcttccggcacctgttcgacggctacgcgacgctggtgcgcgtctcgttccgcggcggccgcgccgtgggcgcgcaccggcagatcgagtcggaggcgtacaaggcggcgcgcgcgcacggcaaggtgtgctaccgcgagttctcggaggtgcccaagccggacaacttcctgtcctacgtcggccagctggcgaccctcttctcgggctcgtcgctcaccgacaactccaacaccggcgtcgtcatgctcggcgacggccgcgtgctctgcctcacggagaccatcaagggctccatccaggtcgacccggacacgctcgacacggtcggcaagttccagtacacggacaagctgggcgggctgatccactcggcgcacccgatcgtgaccgacaccgagttctggacgctgatccccgacctgatccggcccggctacgtggtggcgaggatggacgccggtagcaacgagaggcagttcgtcggcagggtggactgccgcggcgggccggcgccagggtgggtgcactcgttccccgtcaccgagcactacgtcgtcgtgccggagatgccgctccgctactgcgccaagaacctcctccgcgccgagcccacgccgctgtacaagttcgagtggcacctcgagtccggcagctacatgcacgtcatgtgcaaggccagcggcaagattgtaagccatcatcaatcgctgccgcccgtagtgcgttcccgttttgcctatttaattggttgggtgatctaatgatgatatttgtcgggacgatggccaaccgaaggtggcgagcgtggaggtgccgccgttcgtgacgttccacttcatcaacgcgtacgaggagacggacgaggaggggcgcgtgacggcgatcatcgccgactgctgcgagcacaacgccaacaccgccatcctcgacaagctccgcctccacaacctccgctcctccagcggccaggacgtcctccccgacgccaggtacgtacacacacgagccacacgacgacgtcccgccgtcaatttgctacgctacgcatgcacgtatgcacgatggatgacggggaacaccatgtgtagggtggggcggttcaggatccccctggacgggagccagttcggcgagctggagacggcgctggacccggaggagcacgggcggggcatggacatgtgcagcatcaacccggcgcacgtcggcagggagtaccggtacgcctacgcctgcggcgcccgccggccgtgcaacttccccaacacgctcaccaaggtcgacctggtggagaggacggccaagaactggcacgaggagggctccgtgccgtccgagcccttcttcgtgccacgccccggcgccaccgaggaagacgacggttagtgtcaccatctctcctcgttggctgcgtatacgtacgtcttggctttgcctcgtttcgtttgtaataacttgaccaactctgttattgatggcaggcgtggcgatatcgatggtgagcgccaaggacgggtcgggctatgcgctggtgctggacggcaagacgttcgaggaggtcgcgcgggccaagttcccgtacgggctgccctacggcttgcactgctgctgggtgcccaggaaaaggaacagcaagtaacacacacgccggtccatcccaacatgtcaccgccagtactgattcgtctctgctgcttgcgtcttgggtctgcgcatcgaatcacagtacaagtggaggcttggatttgtagctacgaaaatggcagcatgaatgcagtcaccgtttggtaggtggtctcagaaggaaagaaagacatacatacgctgcacgtggtgaactgttagtacgtgatgtatgaggtaccggaagatgtaatatacgtggaaatgaaactatagcgatctgtacgtgttaggctgtagtaattcacatgatgtgtaaaatgtgtacataaaccctccgttgcgattgttcgtactcctgctgtttaatttgtagtacagtgaatatatcttgtgctctttaaatcgaagatatctcgtgcacgtactagtacgtttttgcatgtactggggtcactgggccattgcatcagacatgtttgccaatttcagattgattatgtccgttcactgttgtacagaagcagtggcagctgaactttgaaattgattatttgctccacatctcaaataatatgttttattaaaaatatttcttctattgtaatatttagattacttacataagctatttgcttagtttatttcttaaaatattttatttatcactataatgaagttgataatctacgataatgtcggagatatgggtctgggggtatgtgaagcgtgggaaatctaccttcctgtcctgccgcgtgtccctacagcctggtcttgcccacgcaacccgcggatcgctggagcgaccggagggaggtcggggcctcggggtgccacgtcatgcccctcgggcctttgcaccgcttcgccccgaggccctcgcccagccgccatgtggcggagggatcgagcgaggagggggcccaggctgagcctccattaatgcacacaacgccccaactgccccatgccgcatttaatgcagtaaggcagacgtgcggtgtgcgaatctgacatgccataatcaaagaatgaccggtttgtgaccggtcatgattctggtcacgtctgactagaccgacaaccgagctcccacgtcacgtctgctcccaatgaagtgggggtaggtatgacccgtcccatcggagggtcattcggacggcggccaccacaagtcttcatccattaatgggggaatgacagggctatcccccatgtcaggcgagggacggcgctgggccccactcaaggacaagctgtggctttgcttccaagcgaagacacgggtcgagtcccggtcaagatagggtgggttcccacccgaaagaagagtaggtagaggcggtgcatgtggtatccccttgagatataaaaggaggaccttgcccaccgaaaaaggggacgactctcagaaaacctaaactctaggagaagaagagcgagagtgctctccggagttaaggaacccttgtaacagtactctatcttcaacctccaaacagtgaccgagccgtcccaagcctgtgcagccgtgccgcctcctcccaccaatccggccacctcgttgctcctttttccaaattagttgcgggaatggaatcctctcaatctcctcttccttttccccaagaaatccccaaaagtttctatggaaatcctttccaatttcggggttcaatctttccttactccggcgagaaccctagactttcccgagttttatagtcgatttgggctcggacccgagctcccgtgcctatataaaggaccccctagtcgtcctctacctatcccctcatgtctcatcttccaccgtcgtcggaatcgccctccccgcgagctccttctctctccgccgccggtagccgttccagccgccgtgcgccgtcgcctcggccgtcgccgatcagctccaccacctccctcggctccgcaaagtcgagctctatcccggccgctggttcttttgcgccaaatccaaccggagattggccgtcatcgtgaaccggagcgccgccgtgcctccaaccgcgtcgtccgtcatcgccttcggtcgccgtcgtctccattggatttgcagctgcgaggagaagcccatccgccatttgtcatccgccgaagatcaccggaaagtcatcgccggccatctccttcgccgttcatcgctgcgtaagtgttggtaagcatcgccgttgcctcctctttctcccggtgccctccgtttgcattattgtgccgtggttcgccggcaaccgccgctcctatgtcattcaccggtgtactttatccttagggtcttaattcaatctaatccgttatttgtctagcatcgtcgtcgtctccatgtgttgtcgtcgggtcaccgtcgtcatctctctctctgatcgctttggttcggtgagacttctatccgtgttccctcggtttagtttttaatctctcgtttttgtcgtcgagtagccgccgccgtgccacgcttagctactgccctagcgtcgccgctgcgctagccgcctagccgtcgctgtgccactccctgctacagccatgctgctactgctcgtgcgtgccaagtcgctgccgttccactaccatagccaccgtcgccatctgtcgccgccaccgggttcgcacggcggaggagcaccctgtccaccccttcgcagccgccgaagaccaccggagcgccgtcgccgtcggggacccgagccgagccgagccgccgtcgaacctcgtcgccggtcgtcgttcgtcgttatccgtcgttgttctttgtaccggtgagttcgcgtcgtcatcctcttcgcgttggtgtcctcggtgagcccggtcgagctctctatcgccggtggccgcgtcgtccagtgctaggccggcgatgacgtcatcgtgacgtcataaatcttttatttaattcgtaataattttctggattagatgaaaatcgattaaacttcggaaattcataactaaatcatcgtaactcggattcgagtggttcaagtcgctaaattcatctaaaatcgagatctacatgttaaaaatatccacatgtactgtttatgcttgtttttgtactgttttgttgattttgttcttttgctttagtttccgacgttccggaggagagcgtttttgttgaggaaggttcggaagcgtttgcggaagctcaaggcaagtcacacagatcccaaacaaccctttgagcatgttgaacctatttaaagctaatgttttatttcaactcatgcattattttcgaatgtcatcgggtggtgagcctttcccaattaattatggccgaagatgactttattttcctatgggtaataaatttattagcttggaccttatatattggattggttcagctaaatgctatatatataattgcttagccgtgcttagaaacattagttcattaatgggatgaatcatactacattattatttatggttatatttaatggtagctcacgatggtcaatcgtgttatgataattaattgataattaaaatatgattaatggtgagttgtgagcacatggttttgatggtcgtgctcatgacaattaaggactggttcacgagtttcggttgtgaaacattaaccgtgccaaccacaagccagcgtgggcaacggctttaccttttgtatagcatggttcattgcggggcaccagactgagaagtggcggagataagcccacgggggtcgctggggagtccatgccttgttttataagggagtgattatgatccaggaacggtgcgctgtggtggattgtgttatgcgaggggtactgtcacagctcctttccgaggtaccgtggtggtattgaggcgcatggtgacatgtcgtggagctgtgtcttgtgggtacagtggtacacctctggccagagtaaaactattcgaatagccgtgcccgcagttatgggcaggtctaacaatgtctttcgtgattagtttcacacttttcaccataataaatgatgctataactggtaataatttgattagctcctggtttggaatggtacatttctggtttggagatagatctatacagccgggtatggttgttcaggatggttgggcctgtgcagcatgggtgtgctgttcagtgttgattaatattgatgattaattactctactgttttacaaatctcaaatgtttgctaaatgctgcttttgcaaataagccctatattatgccattctttggtatccttgtgcacttgcatatttgttgtgtggcttgttgagtatgtcatatgctcaccttgcaataatcaatcaaacctcagtggaagacaagttgcgaaggagaagacgtttggcttataccccagttgagctgcctgtgggagtggagccggagcttcgctagaccgtaattccgctgttgttttcttttcttttataagtatgtaacgttattattatgatgaatatgtatattaaattgtcagtttgtgtacctcggctgattcctggacgaggatttcatgcacaaattagttcggaaattactagtgaatttctgggcgtgacattatccatccggagtggctggcgaacccggtggtcgtcccgaaggccaacggcaagctccggatgtgcatcgactacacggacctcaacaaggcatgccctaaagatcccttccctctaccacgcatagatcagatagtcgactccactacggggtgcgaccttttgtgttttctagatgcctactctgggtatcaccagatctgcatggctagggaagatgaggaaaaaactgccttcattactcctgtgggcactttttgttatacaactatgccttttgggttaaagaatgcaggccctacctttcagcgcatgactcgtattactttgagtaatcagatagggtgtaatatagaggcgtatgtcgatgacctggtggtaaagacgcgccaccaggacacgttgctgcaggatttggccgagactttcgacagtattaggtccacgcgcgtgaaactgaaccctgataagtgtgtgttcggtgtgccggcggacaaacttctcggttttctagtctcctcccgaggcatagaagctaatcccgagaaaatatgcgcgatagagaggatgcgcccccagcaagcttagggatgtgcagtgcgtcactggatgcatggccgccctaagtcgattcatatcgaggttgggagagagggcactacccctattcaagctcctcaagcgctctggcccgttcgtgtggacggaggaagctgagcaagctttcaaccaagcttgcctcaccttcccccccccatcttggtagccccggggccggaggaacagttgctgctctacttggccgcgaccccccatgtggtgagtgccgccctagtggtcgagtgcgaagaaagcggaccggaggtccctttaactcgcgatggcccttcgtcccccgaaggtccggtgcccgaagcccctagccaccaggaggaccccgaggcccccgtgggaggaggggaggcttttggcgagtggtcccgaggcctatgatcccgacatggctcgagaccccctcggggcccctgagtaagggagccccagatcatctgcccctgacaatacggaccggccccgccgaaaggtatagcggcccgtctactttgtcagcgaggcactccgagatgcgaagacccgatacccacaggcccagaaaatgctttatgcggttttaatggcctcaaggaaattgcgccactatttccaagcgcatcgggtttctatagtgacatcctaccccctcggccaaatcttgcacaaccgagagggcactggtcaggttgtaaagtgggccatcgagctggctgagttcgatttgcacttcgaaccacgacacgcgatcaaaagccaggtcctggctgacttcatcgcggagtggaccccagtggacgaacctgttccaccaaacgtcccatctcttctcggagatggggaggacccaaacgccgacattcgttgcgggcattgggttacgcatttcgatggttccctcaaccttcaaggtgcaggcgctggagtcacgctgacttcgccaagcggggacgtcctcaagtacgtcgttcggctcgacttctgagccacgaacaacatggcggaatacgaaggactccttgcgggattgagggcggcggccagaatgggcatccgccgtctcctggtcctaggcgactcccagctagtcatgaatcaagtatccaaagagtactagtgcaccgacccacaaatggacgcatatgtccgcgaagtgcggcgcatggaacgtcactttgacggactcgagctccggcacgtgccccgacgcgacaacacttttgctgatgagttgtcgcgtgttgcgtcggcacgagccccactccccccgaggaccttcgaggaaagactcgcgcagccatcggcgcaaccgaacccctcgagggaccccgacgacacgccctccgccccgacccttggcgacccgcggcccgagggggtcgaccccgacccccctcgtcaggtcggttggatgactgacatcctggcgtatctcgacagcaatactcttcctgaggatcgcgcagaagctgagaagctcgcgcgcatatccaagcggtacgtcctcgcagaagggaccctctaccagcgtgccaccaatgggatactcttgaagtgtgtttctcgagagcaaggcatcgagctcatagctgaaacccattagggtgagtgtggggcccattcggcctcacgaactttggtcggtaaagccttccgacaaggtttttactggccgactgtattgcaagatgcccaagaatgggtccggcggtgcaaggcatgccagttccacgccaagcaaacccactagctggcccaagccttgcaggtcatcccactatcttggccttttgcggtctgggggctagacatcctcggaccattcaaggcggcttgaggcgggtatcagcacatgtacgtcgccatcgactagttcaccaagtggcccgaagcttacctggtcgtcaagatcgacaagcattccgccctcaagttcatcaggggcatcacgtccctattcggagtgcccaaccgcaccattacagataacggcacccagttcaccagtgagctgttcggcgattattgcgacgacatgggcatcaaattgtgctttgcctcgcccgcccactccaagagcaacggccaagttgagcgagccaacgccaaaatcctcaaaggcctcaagaccaagacgtacaacgtcctgaaaaaacacggggatttgtggctcgaggaattacccgccgtgttgtgggcaaatcggaccactccaagccgcgccacgggggaaacgccctttttcctggtgtatggcgccgaggcggtcctaccttcggagctttccctaggatcgcctcgcgtcgcgctgtacaatgagaccaaccaggatggtcttcgccgcgatgacctcgactatcttcaagaacagaggaggcgtgcggccctgcgtaccgcgtgctaccagcaaagcctgcggcgctaccatcagcgccacgtccgggcccggtcactacaagttggcaacctcgtcctacgccgcgtgcaatcgcgcctggggctgagcaagctctcgccaatgtgggaagagccatacaaagtgatcggcgttccctggccaggctccattcgactaaccacggaggacggcacggagttgcctaacccctggaatatcgaacacctctgtcgcttctatccatagcgtcgagattttttgctttccaagagctcgggccaacccccgcacaacccctcggcttgtgcgggcttggccaggggctaccattgtgtatccttttccctttccaagcaataaatttttccatttaatgtggaggctgttacgcgccctttcttcttactctttcctctagcttgtcctggttcaaaggacagttcgggtttactccagaccctaagtgccgtggggcgacctaaaaaccgtcgaaagagagcccaaacacgggccgctccccgggttgcgccgaaccccgggggctcggaagggcctacacacggccgtccttgacccctggtcgttgtagcctcggtctggccagtcccgctgggcggctccctcggggcgatgatcttgcccctcaccacttaggtaccacggaccgagcacggatttgccttttcgctagaacgagcccgagggggggaggatggggtaagagcggcatttcgttcacagggaggttaattatatgcttttgctcttgtttcttcgtctttctgtgccgcaggcattcaatggggagcaaaggcgtacaaagtgtgaaaaggaagctttaattacagacaagataagacggcacgatggcctaaatacaagaagtgtccgttgcaggcacacaacaaaaggaaataaaaagcgcgaatgatcacggagtgcccgggcccccgaggccggcgccgctaacgacgtcgtcccagtcctcgccgccgacgtcgtcatcatcgtctccgctcctgctctcctcattcgaggcaagcccgaaggtgaaccggggggccgacccctcgaagttagagacaatcgcgtcggccgtctcccggacttgctcccgagcctttgcctcggtccccggggggaaatcctcgagtgcgcgccacgggacgaagtcggggttgcgcgcttggtggctcgcgaggaccagttccaccgcggcccatgccaaggaagctgacgacgatttcacggtctcgccaatctcctcctccagcctctccagatccactgccagcccgtccagccggagcgcgagtgctggctgtgtactcggcgccccgcgcgctccagctgatcgacggcatcggagagctgcccaggtccgatctcgttggtgaggcggagggccgcaatctccccagcctgatcttgcaccaagcgctctaggtcggcgagagtgctctgagccgtggtaggctggctcaccaactccgcgctgccgggctgcccgcccgccgctaggtccttttcccgggcctccagctcagaagccctcgccgctatcgccgcgcgtccggcaacggcctcctcgcgtttcgcgagttgctcgcccagccggtgtgaggccacctcatcgcggttcacatcggcttcacgctcggcgagtgcgacgtcccgttcccggcacgcctcttcccgaagccgtagctcctctgcgaggcggtccgctgaagctttcgcgacgagggtgacccggtcacgcttggctgcggcctcttcacgaaggcgaagggaggcctccacctccgccgccattctctcgtgggcggccaaggtggactcccgctgatccagcagacgcgctcgctcctccagcgcctgagcccgcctctccagctcctgggctcgctacgcctgctcctggctgcgcgcgttctgctcgcgctggctccggtcgaggacctcgattcgccgatgaatcgtggtctcgaactcctgcgcggagcgggaacgctcatccaaggccctgtgttcagcctcgagcgccgccgtccgggcccgcagcgacgtgtcggcctccgatacccgccgttcttgggcagcagctgcgtcgaggatactgcgggcatccttgaccctcttcaccaggtcctcggcatgggactcgtactgtaggcggatgtcgcccaacgcttcgtccaggacgcttgaggcgatcagtgccgcctgccgctcttcctccgtctcccgcatgacggagtccagcgtctcctcgcgcgcctgaatttcagccaattgggcttggcgcattttgcgtcccaccttcaccatgtcgtccacggcgcggcgcccctcgtcaacccgcgcgcggtccgcagcaagctgtgcccactctgcctccagggctgctcgctcttccgccagggcttgaacttgggcgttgagcccctcccggacggtggaatcggcggcggcgagcacctgcaggagcggttccatatttgccggagttggagaagaaaaggtcgtggtctgcccctgggacgacggagtgctgctggatcccccgcgagactgggggctgctctcggcccctcttctgcgcaaccagccccgagggcgccccaagtgcaagggggagcggccgtccctctcgccccccgtctcgggtcctcaggtagattcagcctcggcctcgggctcgggcccgcccccagtttcggtctcgacctcgagctcagggccgcctctggccgcggcttccgagccacgacctccctcgccccccggtcccgggtggcgctccgcatggaccctggtctcggagctgcccccgggaggggcatcaccaccgctatcgcccgctgcgagtcgagtcctggctggggttaactcggggtcggacccggtatgtggtctgtgggccccgccgagaggctgtgaaggccccgcggccttggatcggccaagcccgggccgctccgatcattcggatttggtcccctgcgaagggtcggaccctgagaccccctaggaaggaatctcgctacaagagaacccagatcgcgttaacgaagaaaaagaaaaggagggaacaacagaccgagctgggtaaaagcaccgaagtgggtgccggcaatcgtacctgcggggagggcgattgaaagtccacttcgggggctcaatgaagctcccccgacacggctccatttgtccttcttccggagccgcttctttttccgtccggcctcaggcccggcagggcgcttgtggcccgctggcggacggtctgccacgcgctcggcgccccctccacgtgggggagagggcagtcgagattcgggcatcttccgtttccctttcgggtcgctggtcgagtcgtccccgggtccgcggctcgggccgggtgccctggagctgccacccccgccgggtccgctcgtccgactcccgcctgtggtcgcgccactgccacccacgccggcagcgctaccatttgtgccgccccggctggaccggctcctgccggcgccgacgaccgacatcacggccaggatgctctcccgatcgcggtcgcaacagaggggaaggatcccgtctggaatcagtgtttgctcggcggagtctaggcccagcacccgccgaatcaccatcttcgcgtcctccttcccccagtcccagcgctcacccacatgcgtgcgtatggggtcgttgggacctgtgtactcccacgcgccacgggatcgatcctggagaggtgcgatgcggcggcggaaatagtcaccaaagaccattgcccctgtgaggcccaggcttcgcaggcccctaaggcgatcccacaccgcgtcgtactcctcgcccagctccgaaaccgccagccatgcggcggatctttcgagaggactagcgggaatccgaagtcgcgggtggtccggcagcgcggtgtagaaccagtcctcccatttcttgcggagatgactctcgatgtattgccccgccgtgcctggccggggctggaagtaacatccccccaccaccgcaccttgcagcagctgcgggatgaagaaagactggaacagccgcatcgtcagccgcaccccgatgaacatctcgcacagatgtgcgaagatagccagcgtcatcacggcgttgggtgcgagatgcaaggtgtggatttcatagaaatccaaaacctcatggaagaatccggagaacggtggaatcaaccccgccatagcgaaggacaagaggtgcacagatcgctccggataccgcggccgcggccgcaactccctcgccctcacgacggcgccgtccggcatgatcttgcgggggaggttaaggtgcctatccaccgtaatgcgtgctgccgggagcactgtgtcgccagcgtcttgagccatgatggccggcggagaaacggcgaagggcttggtgcgcggaatagtgcgaagtggcgagaatgttaggacttaaggagcgagaagacgagtgggcagttggcgaaaggaagggggcaaagttcctgcctccgtatccttttatcctcgcctcacccacgctcacctcctcgtttcacgccctcacgattgcccccacgattctcgcgcccgcggttgtctcttcgtttcctgcgtccactcatcacgtcgcccactgaatccgcgccccgcatttagtgcgcctatcagcggcacactcggagcagggcgcgcaacggtcacgggcgcaacctgagcgaaccgtcgccactaccgccgcatgagtagcgagcgagggaattgaggcgtagtctaaccgaccccccaattttcgcgccttagacatcctcatcgacagcgcggtcagtgacagccaaaccgctgctgtggttgatacgccagtctggccactcggcagttttcccttagattacctgccgagcctgcaaccctagcttgggaaatcgtgaggcaccacatcagaccgacctcaggaggccaatgtccgatatggtgccgggggctactgtcggagatatgggtctgggggtatgtgaagcgtggggaatctaccttcctgtcctgtcgcgtgtccctacagcctggtcttgcccccgcaacccgcggatcgctggagcgaccggagaggggtcggggcctcggggtgccacgtcatgcccctcgggcctttgcaccgcttcgccccgaggccctcgcccagccgccatgtggcagagggagctagcgaggagggggcccaggctgagcctccattaatgcacacaatgccccaactgccccctgccgcatttaatgcagtaaggcagacgtgcggcgtgcgaatctgacgcgccataatcaaagaatgaccggtttgtgaccggtcatgattctggtcacgtctgactagaccgacaaccgagctcccacgtcgcgtctgctcccggcgaagtgggggtaggtatgacccgtcccatcggagggtcattcggacggcggccaccacaagtcttcatccattaatgggggaatgacagggttgtcccccatgtcaagcgagggacggcgttgggccccactcaaggacaagctgtggctttgcttccaaacgaaggcacgggtcgagtcccggtcaagatagggtgggtccccacccgaaagaagagtaggtagaggcggtgtatgtggtatccacttgagatataaaaggaggaccttgcccaccgaaaaaggggacgactctcagaaaacctgaactctaggagaagaagagcgagagtgctctccggagttaaggaacccttgtaacactcaaccataatcccaaacacaggagtaaggtattacgctccacagcggcccgaacctgtataattcgattgtgtacaagctagctagcagccttaggggcggatacgtgatttctaagaggcgagcttcttcccccggccgaactcacaaaaggaggctctcacgacctcccgctatcgagggacttccctcgacagataacaatcctctaaataatataaatcaaacaggccttggtttgaaatatattattcaccaaattattgccacaaataatctagtttattctagagataaatattctaagacaaactgagcaaacaacataaaacaagtggtctatacaatacaaatagaagaaagttttttgagaaactacattttaggtgtacagtaaataatctgcggcaattagtagagtagatgaaaagaacagggcgacaattgttttatatataagctcaactagtgtgtttttttccccataattctacaaagaacgtgatttgcaaagagaatcaattaacgtgacacaaatattttatatacaactatatcacttaaactatataccgatatagtttggacctagcacaatcaaatgcaacaaatatattttcagtattgacatgttaatattttaagcttcacgatccaacgcctggctcccttttgctctactccgcatctcaataacaaaatagaacagaaaacagctttggacttgccctttctattcttgttcaacattttgtgcagctcccagaaacggttcccaactactgaacttacaggatcactcttcagtttctctatgatctacaattgcttattagtccagaacgtctaggattagtcaccataaagagttattcaccccaaaagaaatagaggaagaaacaaggaatacaatattgtgcccattctaaaatacatttactagcatttctttgtacataagtaacatctaaggtatcactaaagctaaaaatacaatgtccggtacatatacatgcatgacacaattgctcattcatgaaggaacacaagttcaacctttgctcattcagagtgaacacaagttcaacctcttcccaaggaacatacagttactggtaatcaactgacgattaacgccgtcaaacttccagcaaagtggatgtggcactcataccccaaatagaactattacttaaggttcttcaagaattgcacgcgcaaggtttgatgctagagctaatctgacggagttcaatgcatggcttggtaggtgaatgttggaaaagtcaggccgaagtttggccaatgacagttcttgtagcttgttgagcaacaaagtcgtttcagcaacatttaacaatgggcagggtttgcaattgagaagcctcacctgcagaaacaaccggggatagaaacagaatcaaaagcctgatacagattaaattattgaacaggggcaaaaagaagatttagctagctgctttgctgaacaccccaagtaaacatatgactagcttaccgagtcatgtaaaagtggtagccagaaacgttgaggtgtagaaggatttctcatcagctgcacagaaatagatattaagtttgatttatcaagagtcattcaaggtgcataagctattgacaggctgacagcactgtctgtgcggtgttaaattgaattgcaggacgacagcccagccaaggtgtaaatattttcacctgtataagaaactccacggtttgccgaacagactcgccagtccttccttcttgtgccatctgaagggaccttttgaaatctcggtacctgtgtgcaagcatatgttgaaacgaaatttagtactcatgaagagaagagatacagaaattgatggaaaggggactaatacctgtgaaggaactcaagaccacctgcactaccgatgtcagaacctagtaactcaagcagcccctcccattgctgaccatacaaaattataattagcaaatgtcataaacaaaaacattgtcgatatatctgcttgatgaaaaagatctcccttttgatcagatttcttggttactagtacactcagaactaactgcaggtgtacaaaagataggtcataaggaggagcagaaatcggcaccttaaaactatcatctgtgaccgacttgccaatatgttcgaataattgttgagcaattctgtcaagacgaactttatcattagcttgctggaaccagtaaactccagttcctttcctaccatgtttccaatgataaatgccagcaatctagaagaaaaaatagataggactcgtgagtcaaaacgacaggtgggtacaataaaatatgcatgctggtaagtttgaatatatagataataactaagccaggttaaaactccaagaaatcttcgttttgaaatcttggaaaagtacaggtgtacatgcattgggaagaacatcttaccttcatgatatttgtactaacattctccagctcatacaagcggcaaatttccaaagtctgctcacaacaacaatattaggtaacaaaaagcaaaggtgcagaaaaaattcaagggcatatcaatacaaagtaccttcaatacaacacgattatcttgtatgggttgcttcagaagcagaatctccaacagccctaggccttggtttagacatgaggacagataagttggtgcaatctgagaatcaaataggcaagccagccattaataacaattatcaaattataaaaatttgctatcattaacagataacagcacctgttcaaaagtagaggttctgcaacaaaaagctagacaatggataataacaaacagcatggtagtcatacgcaaaagaacgtcacagttatgcgtagcaagcaattcatacaggccaagtgtcatctcaagaaaatatctgcctagtacaatccacaaagctacaaaaaaatacctgccatgttaaagcatgagagcacaaaacttgagcataaacaagcctgtgcagctcctctatgcttataccaccgaagttaggcctctcttcatgcaacatcatatccgcatagtcattgtcagcagtcagcagctccatagcatgtgtgaccatcctgcatttacaaatggcaaaacacattaagatgcaatgtttcaaagttggcagcataaatcaaatggccaacaatacatcttaccaaggaccaaaattttttgtgcattcagccaagacaacctaatgttagaaaagaaaaaaaaatgtcacacaaacaagaaaagtggaaaggataagaaatttgggggcctatgtaatggatgatcacattgtgttccaacctctctattttctgaaaggataccagtaaggaggcctgtcaatccgctattgtcagcagacggtttaagctgtatgcacttttgtgctaactgatgcatcccttcaaaaccctggcaaacatatagattttagcagaacataacaagaggttttgattgttcaaatatatactccccttcaaaaaaattgttgccacatatatatattgactaactgtttacatcacacaagaaataagtgggtacgggtcagtaaggcaaacatctgccaacataaaaacatgttctattgtacaagacaactcaagatgaataaccataattactggataccttttacaggagataggagatggtaaaaatatctagcattctcttctatataatgggtaatttcatcatgtcacagattaaagaataacaaactaaaaatgaactctctagcgaggggattgctctaatagcagctgcaaaatgcaaaattgcggtgacaaataaatgaatcgacaagaaagcattataatgaagaacatattagcaaacacaataatatgggactaaccactgtgaatggccttatataaagtaaatgagaagcaaagagctccagccaatgtgaagtagaagcagtgaggttctttatgttccccaacataatatgaagcaaactcttcagaccatcacgagttttttggtgaccgcactgaatccagaatgcactgcactccagtttacttacttgacctcgccatttttccaatgcctgtaaaaaatacaatttggcaaatgcttttagctgacgtcaatggaggcaatacaatttctgtgtacctccaaacacttgggcaggaaactatacaagtttttacacaaattttcactgccctttccttcctttttttttttgaagtaaccattatgctactgagcttgagaggatataaacatataattattaatcacaaaagaacatattgtgcaaaattcaaagttcagccaacatagtcagtaactctcagcatagatgagcagtggaacaatggtggtgggtgcaaagccagcagcagcccgaggatgcagcagcaatcagtgacaaaagagcacagtagagcagct

SEQ ID NO: 72545 - DNA, 598 bp, Oryza sativa
  unsure (1)..(598): unsure at all n locations
ctccaagttctctctgttcctccccttcttcctaccccttctctctgttcgaatctgctcctctaatcccaaaactcccaaattcgcaagcagattcgtaacaataggtatcagagccatccatcctggagtacctcgacaaacctagataccattcccgtgcgcaactcaagtcccaagagatggagcagcaattggcggaactcgcggcggccatggcgacaatccagaagcagaataccgccatccaagcttcgatgggatccttggaggaaatcaagcctatggtggtggaactcgcgagctggaagccagcggtggacaaggccatgacggagatgcgggacgacctcggcgacctgcgttagcaagtggagcggatatcccgcaatccgattctagccgtcaagccagcggatctgccccctcttctacccacgccgacggtgcctcaaatctcggtgccgaaggaggaggagacggcttacaaaggggcggacgcgagtccagggcccgtaggccatggcgttgcaacgatgaatcgngggaaggcgtctggagatgatatttctacaacgctttcccgggcaagggtacg

SEQ ID NO: 72546 - DNA, 37278 bp, Oryza sativa
tgtctgatggaccaaaatgggggaaaagggtgatgttaaaaaagcaagtgtatataaatcaactggtgacataaaaatagcatatttgtcaaagctacaacgaaatataattgtatacaatcaggtacactataggaagatatagcacattttctttatttcaaaagattagtgcaacactgtaaatactactagaaaacataacaaattaagcccttgaagcaaataaaatgatttttatgtgaatgatagatgcaagtcatgaagaaataaagaatggtctcaaagcaacctaactacctcacggctgtccatctgatccaattggtatgatccatgaaaacgtagcatattcacctaaaagaaaaaaaaaacaacttctgattgtaggattcaatcaaaactgacatgtctataaaatagcgtgcaagaaaatagcttaccacaatatcaagccatccaaccgatagagctgctgataatccactccaataatcaggatcatcttcaacaacctatagagcatcactcattattcatttatactcattactgctattgaatcaatggttggaagtagcacaaatgaacattagtaaaatagactacaaaacaatcaactcaaagcatggagttgtagaagttttatagagaaaagaacaaataaaatgattgagaggtacaaatttgacgtctaatgctatatgctacaacaaatataatgagtcaaacctgcaggttgatgagctttttctggaaattgatcagcgtgcgatatatcgtgttctctgtcttggtcaagaggctgtcatagtcctaaaaccacaggaagcctgataagagacgcccctaggtattgtaacagcaaagtccgctcacaattgaaacaaagcaatagatcaaagaaagagcattacggctaaccaatcaacaagacgctctggaagccaagtttgcaactgtttatcaacaaagaatatctctagcaactcccacgcagcctttaaactagtaggcttctccttgacctgcaagataaaatataccaattactttctataggcaaaaaagtaaatttaacttcaaacaaaggcaaagcaagaaaacaggaaacaatgtgacacatagatatggtcaccttaaggatcatctttgggtcatcaatcatgtaagcagaaagagaatctgggttcccaaggagactaccgatggttttactgtattcaagcacatattgccacctgacaaaacatagtagaatcagaagcaagcacatggaaaaaatggatagcttatactaggcagaggtttgatctagattaactgtataaacagtgattataataccactttggcacagatgtttaaaatttaaccatatgtgtacttcagatatgtcgatttatccatttaggcggaagcctaagagctacaaattcagcttctacaatatgaaaaagggtatctgaatagttggatagctatcgaacacaaacaatataacaaagcattgctaaaacttaaaattctgagcgatatgtgacatgcctatcccagtacaagcatagcttgggcagtaatcctttctttctatatagttggaacccacttagtgcaattactactacaaagcagccaccaggttaagccacatcatcacaattatctcagccattagatataatcaagacgctaaacgattatcctcggaccagtccccttatctctgaatcctacaaattcttaattagtggatccaatccccttcacacctagcctgccgcatctacttctcccattacgatggaagcaattgtgcagcagaaactgcctctgataattatagcagcgagaccaaatgtcatggttaatcagatttattctcttccaaagcatctttgaaatcctcttgcagtcctgcagccacgcataccagcgctatctcttttgtagaccaaccggatatttgatcatcagctcttgcatggtgagtgatatatttgctatcatttttttctcattagatcttcatattaatttacagtattatctttttccccccaagggctattgctttttctatccaccaggtgataagtgaataagtgataacatatttgatttgatgatttgatcggttcatttgactcttacttttgattcgatgctgatcttaaaagcaattttgtacaacctgcagattattttgccttccgctgttctctcaaccgcaagatagctttttgatgatttgattggtttaagtcctttttttatttcactctgatttaaatattaatggttcttgggcaggtatagaaatatgttatggctgtgctccaagaaggatgagtcaatgatgtatgtgctaattcaaggacaaatttgtagcagataatagaacatcgaaggatgcttatatacaatgattaaaatgatatgttgtcaatggtctacagttttctttccggaaaagctatgcatgccctccttccaataaagttcccagtgtaagcatacaattagctatactgcttagttgttcgtcagttttgcttgtgaaattttcatagtttcgaattggaattcataagtatcctagcagttgtttatatttgtagtgatgtgtatttattcgtaaactacaattgttgtcatctttttcggactattccctcgcacaatgtagacattgttgctataagagctgactgttaaataagaacagttcctttcttttttttttctcaaccagtcaatgaatcgtaagtttacggtctgtcctgtgattggtgcgatgggtgattctacccatacaacgagaatagccatacttcttggatttatattctacctggacaagtttatctccaatatataggcattgccctgaaacaaagtcatcaccaatttgaattaatgctattatctacactccccatgattcatgaacaaaaccaaaagttgtctggtcttattgacttctatctcaatctttcacccatgcttcaaagttgtattcttcatttcccacagcagcgcgcagggtatcacctagttaacagtttatagacctctaaagtcttatacagcagccaaaatgccatattaatcatcagtccagactaaaaatactagcatttagcaaagtaggcggtccaaattccaatgtcttaccattctgcgtgctccgagactgagggcaagcgcgacataccggagccatctacgagcgcgttcttcctgctctgaagcagcgcaaacgccggtaccgacccgtactcgatcctccgcatttccgcctcatcgatctcctccgcatccgcgccgccaggcccgctaccgccacctccgaggtttacctccaccactctccccccggagacctcctccgccccacggtctccgccaccctccggattcggtgggcggaggcaggcgacctgcaggaggttgccgctagaaaaggaaacgtagacgcgggagatgggcggggccacgccgtggcggatgttccgcacgggcggggccgccgccaccgcgtggcctggttctcccgagaacggcacgatggcgccgccgccgtccatcagcatccctggcatccccgccgccggacgacgatgagctagggttttggaagcgggagacggcgggggtttgggggttcgggggcccgggtaactgaggtactgtacaagtctacaggttagccttcagactagaagcaaagccggcaggtctctcgagtctcgacttctcaagcttcagggcatgtttggcacagctccagctccagctccagctccacccttcctagagctgttgctcagctaaacaattttaactccactaaaactgggagtggagctgggtggagctctctcacaaaataaactagagttgtagagctgggtttaggcagctccacaactccactccagacccaactcctagagctaaatttaggagttgaagctgtatcaaacataccctcaattacagttctctggattcgtagtactagctttgaagcgttgaaattttgaatgatgcaaacatctgaaattaggcttttttaaataaattatattggtggtacacaattttatcaagtgatcagtgtaatctgatgcataaatttataaaaagcatgttttgatacacaagcttgtctacttcgaagaaattgctaaaaaccctatcgtaagttctaatttgataagtagtctaatatattgacgtgcaatttttttacgtgttcgagagaaaaaaatctaataataagtagtactaaaataccaaattatattgagtatgtattgtgaaaaggaatttttatctattttcatttcaaataccctatctcaaatcctgaacccaccctgttgtttggtgcgtgtaaaccaagaccaaaagaacacaataagactaatctcgctgatttaagctatgattaggatgcgacgcaaacacgaaaaaaaaaagatgccacacaaacatatatatacgctcaaccaaatggtaaaataaggcacacttattgtacagataaaagacataaaatactaaataatgatgcaagggtggaaatgaaaataagcgtaatgtagaaaccgagtttataaatatagcattctcactcccatctcttatatgcacatcacgtcctaatcaattttcaacttagtgaaattagtcttgttatgtcattttggccttggttcacaaacaccagacaaattcattaatcaaaacgaatgttttataagtttgtacgctatattatatccccctaacaagttcgtataccaccagtaatttacttttttttattaggctatgtctggtacaacatactactacttgaaatcaccgtggtattctggaacgaacaatctctggagaaatttagatgcgaaattttctgcatttttccatgtgtacctttttcaaattaagaaaaataagaactcttagaaatacattgaaattacgatacaagtgtctaatatgtggtgaatttggagaaaaatccagtatgagctctaggtttcttgcccctaaaattgtgaattttctaccagtaatgcgtgcttcaaaaatccagcttacccaattatctctgcattatatatctattgaaatcgtgaaacttatagttatagaatcttgaattcaactagtataggaccaacacaacgtatgtgtggatagaaatcaatccattctaattcaactaaatttcagtccgcagtgttaaaaataaaatgtagtccattttatttaactaaaaattggtcagttattacccacgtgtcgctccgtacttattcttagttaaagttttagctagaagccgagttatcatattcttgttttgtttcttagaatattccaattcctaaccatgtacattacctttttgggaaaatcaattttgttgttctctccaaatccaaacgactcaatcgagccaaaggtgacggtggtggtcggtatgatggacgagcaagtcctctctcaccacctccctctacaatccaaagccatgatgttagctgggaaccgttaacgtcaaaatttggtaaaattctttagtggattcggttaagaaaatagcacaatcgtccgatataaacttatccagaagagaccgagttcaagaaaaaatcgtgaatactatggcatggtggcataattatatctattaattaggcaggatttagtagtttgctttaatctttaggatagtatgtttagtgtctataaggactttatgttttccttttatcttcaggaaagtttctttcttgttcaacaaggactgatatctaaccatgggtacaaatatgttctatcaagaggtatgacttgatctcagcggtttgcgttggcggattagggcgtcgctttagatgttctaatctatcttctacaccgatcgatggttatcatatatcttagttaatctagcttaacatcttaatttgatcatatcgaccgagatttgttttagggtttatacaggtatcgactaaattatcttgctagattagattaactaaggtatacaccacccttaaaatcaatcatcaaaggcttgattgtctagacaccatgttttcttttatactttccgctgcattagccctagtcgtgtttagaactataatctctaccctactgtttgattttcaataaaggtttcatcggggtatcagccgatgagttatctgatgttgcatcggtttataaggattgcatacaggttgtttttagccaattgcaacaaagattttactgtttatctaatcatttggatttaatgatatcggacctctagtcgatgtatgctttaaccatcggatcacttattctatcatgacattgttagcagattggtttctattagattatattattgttttattatcatcaggcgattgtccttatatcactatctgcattggatatatagttgattgctcaaaacctatcgacatcggctggaatcgctctatcggcttgtcagccgatcgactctttggtgatcaacatatttgtctatcttgtcagtcgcaggatcaaactgactggcgcgccggcaccttatcaatattctggacttgcattggagttaagcagatctcccatgccgttgtgttcgtcgacttagttcgcgccaacacagttccagcaccatcggccgagcgcgattttttcgttaacaggagcctatgtgttcttgcggtggttggctttgtcagagcgggcgatgtggctctattgtagacctaaaggcaatcagtatcgcatgtggtggccaactcggcgctaggttcctttctcggactgagttcaggaggtggagttcctaactttaccttcccgcacggaaaacggtgttgcccataaacgcgtgattatttatgtatattagccttaaaaaacttgaaaaaacttgaaagattgattaatatgattttttaaagcaactatcctatataaaatttttgcataaaacaacatttagcagtttgaaatgcgtgtacggaaaaagagggaggtgagttattaggaaagaagggaggagaacacaacctcagtgatgtgttgtggtgttgtcagggcatggtcgcctcgtggttgagctggcacatggtggagttattttaatgttttttcttgattatagttctcagggctttagtcttttgcatttttttctattatgctgataaaaacttcgcactgtctagcaatgtttgggaaaaaaatcgaacattaaaatcaggtcactggacacacagaaattcacatttttacaggaacaatataaattatattactagaaagtaaaacattctaaaggactagcagcccacatatattctggaggccattcaatttggaaataagtccattttgcctccctcatctcttgcgcttaacatcccccaactggaaaaccggatataacgcctccttcgtctcttaaaaccagagcaaatcacctccctcggtggttttgctggtggtttcatccgacttggcatcgttgaccaggttgacagatgactcagcgtggtgggacccacctgtcagtgtgtaggcattacaaactcaccggcgctgagtcagcgtggaaatggggatagagaaagagaggtgcttggcgatggcgacgaggagaagggccggcgacgagcgacgggggaggggcacggccggcgacgggcggggagaaccagaggcgtgcggcggctagcggtggccctcgttggcggcagcggcgctcgcttgcgatggacgggaagggggtggcggctggcggggagaggcgcgcggtggcagggtccccacggtgaagacggcggccggtcgtcggggcggagaagggcgcggatacgagaaggagacgctgcagcggcacattccgccgctattcgatggggcgctcatcggcgtcgacgccgacaacggtagcaaggcgcatggctttcccgcggtggaggaggcacaagtgtcggcctcccttggaacccctttcgctggttctcgctgctcaacccctcggtgtctcggagcctgccgctgcaatgtacatccaatgtgaaataatgctacatgcaaggtttcttttttattttgagggaaaattgaacaagaaaaaactccggtgattagttcagacggaaatatagttgcaagaaatattagtttgcagaggagaggagggaagaggagtcagccggtgttgcgtatgccggcggcgatgccgttgatggtgatgagcagcgcgtcgcggagcttgcggttgtcgtggtggcgcaggacctcgacctgcagcatgttcatggggttgaggtacgtcagcctgctctcgatcagcttccgcaggctgtggtgttggcggacagcttcttgtggccgctcaccgccagcacgcagttctccgttcgcgccagctcctgccggagctccgcccccagcgcccgccgcccggcgtcgtgcaccagcacgtcgtcgtagtgcttcgccatgggcgcgtccgccttggccacaccatctcgatcaggtccaccgtggactggaagaagggccactccttgtacatggcgcggagctcgtcggtgtgccccttgtcgcaggcgtcctgcaggccgcgcccgacgccgagccacgccgggagcaccagtcgcgtctgcgtccacgcgaacacccacgagatggcggcggccggcggtggcccttgttggcggcagcggctatcgcccctcacctcctccgccgtcgccgccatcatcattgccgtaatggctgccgccgtcgtcctggcttcgctctccatcggcaggtggtcaacaaggccagctactgcaccatctacaaggccaagctggcggagggccgcggcagcatcgagctgcgcctcctccgtgagggctgctgcaaggacgccgagtcgtgcgcgccggcggtgcgctgcatcggccgtgcgcgccacgagaacctggttccgctgcgcgccttctaccatggtaccagaacagtagccgaccgccgcgatctacagccccgccgagcctaggaacgacgccggcacgcccaccgccgccgtcttctaattccattctcacaatctcattactctgttcgtccgaatctgaccaggggagagagagagctacacactgacatgtgagtcccaccacgctgagtcagcttattaccgggccaacaacaccacgtcggacgaaattgtcagcaaaaccaccgagggaggtgatttgctctggttttaagagatgaaggaggcgttatacccggttttccggatgggggatgttattcacagaaacgtaagagatgagggaggcaaaatagacttattccttcaatttgcacccacatcttttgggccgctctggtcgctgcacgctggttttgtgcaaacctggataggcgggtaacgggaaaaccatgtccgggggtagcggtctagcaaacctgtttgagaaaccaacacaaagcccggccatccgcaagcgcagaccgcgacatgacatgccttacatgaatcagcaacaacgactctcccaggagaaaaacagaaggactgcaagactgcaaggttcaacagatcaacaaaccgagatcagctctgaccaaacaaatttacttgaaggggaaatacgtagctctgatcaactgatgcccagatacatttcgatcgatatctacagacagcacaaccgcgagacataaggtcggcgttcataaagaagaaaatgtaaaggtcgaaatgtaacgtcgatcacttcgcaagttgctggtgtgttgttctaattttggtcagtgtgtgtagcatgtggatctcttgtcctacgaaatagtagtatctaatttactttcaacttggattagggtggcgagaagatgacctcgtgcgccttttatcatccaaaccacaaccgtgcgtcgcctgcgacaccacaggcaagcgaccacgaccacccgtgcattgattttgaccacgaaacaagtaacttagcctctattattgcacgcttatgcggatgtgcgtgtgtgcgcttaagcaattaattgctaattagacatgatgcatgtagcattataattcttctaaacaaatacatgtggcattagaaaaaacgagaagaattgctactgtgtatccaacggcccacacatacggtttcaacaaaaaaaaaaaaaacggcccacgcatatgtgagcagcgagagcacatatcgctttgcccgtcaaacgacgacggccgcgcgccatgtgcactcgtgcatgcagcactaacacatacgtggcctggtggcattttaattctcaacacgtactcctctctttcaaaatgtttaacaccgttgactttttagtatgtgtttaaccattcatcttattcaaaaaaatttaagtaattatttattttttttatatcatttgattcgtcgttaaatatactttcatgtacacatatagttttacttatttcaaaaataattaaataagacgaacggtcaaatatgtaattaaaaaaatcaacggtgtcaaacattttaaaacggagagaatactacatacgcttgcctgccgcgatatttatcgacaacacatgcaattattctagctagctctcgtagggtcttcctcttccacgtctaggggcaggtattctagcttgacgatgacgacaaagtgtgtcgtagtccggtgtgataaacatgaacatgacgacgcaccgcaccttgcttttcagtcatctcaaccgtacgagctagctggccggttacagtgcaaggtcgcatgcacacgagatcaatcatgcatataaaccatatcgatctccactagtactgctctaatgcaatattgtttactgctgtttgaaaagggatactcctatatcggttagtttccgacactgcaccatacctcttccctcccttaactatgcacgaacatcactttcaagctaatcacagttaaaccttctgcattggcacgtagctctaactcgctattcttttcctctggtatatttatataccactcgtatctgtgttagttctcaagccaaatctctgaagtctaaactaagattaagatcaagtgtatcagtcccgcacggctacagctacactacacgcacgcaaagcgtacgttagcacgatcgtttcacttcacgtgacccgcgcgactaccatgcacacgttagctcgctcccttccgacccgcacccatcggcacatgcggcgcgcgaaggcgaagcaacccggaacggaaagctagcctagcccagcgaggctcgccgaggagcgaggggtcaaaagacggggggaggaatctcgccacgtggcgttgaccaccgctcccacgcccgtgcggccccacctcacatgacgttcctggcgcgaccacgacggtcctactcctacgccttcgccgtcacgtgcctggtgggccccacgccgcttcgtattaaactgggccgagggctcgggggcgtggatcgcacataaaatattttggcccatcctggcactatccaaccggaatagtactaagaattttttttatttttaattttttttattaaaaattttacaaaaataatttttcattttgaaaattgacagaagtggtcgcctaccgccctctgggagggcgatttttaaaaatcgccatcccagagggcggcgaaagtgacgtggcagacggccgttcgctctcaggcgacggccgtcaacgaaatttgcaggcggcccccttgccgctctgggggaggacgattttatactgtgctttatattttttataaatatcaatagttatcaaatttttttatattgaaaactatacaagattaaaatctccaagactggtaaaatacaattttattattttttagggcctatttggaatgttaccgtataaatattttgttagtgccaaaatataagcaagttttggcactaccaaatatttggtaaggtaaaattgcatttgatcatatttggtttgctgccaaaatataaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacagtacaaatttgtcaatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagtttggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccacttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaactaccgtgtgggcgagggatcgacactccatgagaggaagagctggcgaacgcgcccgaagaggtggcgaacgcccctgcggagctcgcggaagcgccgatcgtgcctgcgaacgcgctcgaaggcatacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacaaggtgatgttttcgtacaaaaacataaacaaaacttaagaaacctctgggctgagcagtaccgtgcgaaacaggtgccgtaggtcgaggtcttgctccgacggtaggcgcgcgaggccgtggttgtaccggaccagctggaggtacgacgtccacgacgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaatgtactgctgtacacgtggagcccaaagtgtgcctgctagctgtccccgtcgagtcaacctgtgaagagaggtaaattatatggctcgatgaagtaagtatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgacgttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctctcgcgtcagtcttcgtgcacgcctcacagagggcacggtacgtggctgctagcacggcagaaccccagctccactgcggcacgtcttgtggctgagcatccgcgatggaccgtgcgtagtggaccagccggaagtccacagcgtgcccgtgggtgctagtgaacatcacccacccgaacaaccacaacaggtacgccttaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttactaggcccgactgtagagtacggaggaagggtgttggccggtcctaggtgtggaaggcgcatcacctgctcgaagcgcgcagtgatatcctccttccacccaacaacactgtccacgggaccaactggtgctcccgccagcggtagcccgagcaggtacgacacgtcctgcagtgtcggagccatctccccacagggaaggtggaacgtgtgcgtctcaggtctccagcggtctaccaaagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcaacacgcaaccactcgcgcgacgtgcatggacggaaggtgccgagctgtgcaccctcgactgctgacaggaacgagcggtggttcctgtcaatcccacggttcaacagcgccggtgtgtcgtacgccatacctgcatcaaatagattggtcagaaacatataaataattagtcaacataagtaataaatgttcataagcgaattactaacacatattaaacaagagtacaaacaaacaaaagtgtcaccatacggaatatttctgattacaacaatagctgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacacacatcacatcacaacagcgttttatttcctaaatcgatagtattgttacaccatggaatcgcctgctgcgcgacgacgccttggccttgcgcgcctgcttgttgttccttcaccatgtggtcgcctaccatcacttgcctgtccagatggactagcatctgcgccgcttggaacttctgcattcttcgggcatttcttgtaagtatggccgcgcagattacacttgctgcagcgtaaagtcctcccacctgcttctgactcatccatatcatttctgatgagtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggaagatatgccacaatcaccggcagcagcaagaacgtgtgagcaaggaaggtgatgaagcttcggcttcatacaactgcaggtacatccaccatccgcctttaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatttgtttgcttcgttgtcaactcatccaacttgtcccacaactcattaaatttcttctcttggttctgtacacagagcctcttaaagagcttcataagatgcttgttcttgaattgcttgtagaaatttgcacccatgtgacgcatgcaccaccgactccgaacatcatgccacttagctggaagtcccttctcatcccaaccgttctgcaagtagtcaatagcccgcaacatacccgcgtgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagcaaatgttaccaacaacactgctgtacatctcacttgccacaaaagctgaagtgatgtttcggtgatacttctccatcccttgtaagtagcacttgtgctcggtcacaatgctaactttccaataatcatttcatttacccttatatgcatggacacgtcacggacaatcttccttcatgcacctcacttcatacacataatttgttgacttgaccaccctaaactctctctgcaaggaaactgtccaatgcttcactgcctccttcatctcatccttatgagcatatcttgcactctcaattacctcgttctccttatactcccagggtacatgatcaccctctgatataacaagtccagagaagtcctcatttgcccaatcagtggccattacatcaccttcctcatcggatgatgcgtcatcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcgtttttttttggatttttagtgaatataatgaaatttcagagaggggggactgggctttatagggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttcattgacggccgtcgcccgagagcgaacggccgtctgccacgtcattttcgccgccctctgggatgacgatttttaaaaatcgccctcccagagggcggtaggcgactacttccgtcaattttcaaaatggaaaattattttttaaaacttttaataaaaaaaattaaaaataaaaaaaattcataatactaaccaggggcaaaagaataaaaaaaaaagctaaagagagaaaaaatatcataggcaaaagggaagaagattggtacagactacagagataaaaatacgtgacgtaaacctcctatccaagcaatcaatggtctccccggccttgggcgccctggctcagtggctcctgctctgttccccacagcacaggcctttcctttgaatccaagcaaaatttgacaaaagttgcaaagttgagctgccgccataatttttttgggaaggcaaatgtggtgccttgatgttcgtgtctagatatatatcgcggctgttccttttttcgaaaggtgtggtgcggccaccgtgcaagccgttgcagcttgactgagttttattgatgcgaatgccaccttttctgatgacatgggaacgacttgctcatttcgaaggatttctgagctagacctaggcatatatactgcacttccagttgatccatccagaagaaacacctaaaaattatactcttgcgaaaatacgagtactctctccgtttcacaatataaatcattttagcatttttcacattcattatgatgttaatgaatctatacatatatatctatgtaaattcattaacatcaatatgaatgtgagaatgctaaaatgacttacactgtgaaactgaggaagtaattcagattgcctgggtaaagtacagtatcaccaacttgagctcgagaacaaattacggtagaagtgctcactccgtgcccttctgcgagagcaatgaaccggaacaaaagcgttgcgatttatttacagaaagaaaagaaagctgcagaagaagaatcccattccccgaggccaatctacatcgggatcgtagtacatcgtagagctcgcgacgtcctcccggccggcggccggggccaccctctgacgcacgcagtcacccctgccgctctgatgccaaggtgccggtcgacgagtccacgtccgaacgatcgggatccgacggcgcaggatgccctcgcgtcggtgccccccacgtggtacgtacgtggacgcgcggcagggtgcccgtgacgtgggcgccctcctccgcgaaggctactcaccgtgtgaccgggctacgtgtcaagatcgcatacgtcactgctgtccccgtcgagccgtgacgacggcacgacgcgccggatcgatggccggcccggcgtgacatgaacacccttcagttgcgtggaccaagcctgtcccgagagaacgacaaatctatagtataggagtacaaactaaaccgagattttcgttatgtagctagtgacctatggttttagatcagatagctaggccggtttaagtcaccggaatgttttttacatggacgaaacaaaattcactgtgagcataggaaatgatggcgaaaacgacttgcatgttgctagtctcgtggtagaaagtgattttgccaccaagagtaattgcaccgaatgatgaacaacatatagcaatgcaaacataacgtcgtcatcgggctcaacatggtatgtctagctgcttgtcatgcgatatcatcccagatctctacagcaatagaccggctagtgcgagtgaccgtgacacccgatcatctcgcgacgattatcataccgtacgtcgtccgttcacatgttaatcgtaattaaactagcgcctgtccatgcctcctatatacttgtaaagacatggcaagacacttcgtagaatggactgcactttctctccgtccgtgtttacatgtatgttctttgaggtggatatgcttcaatgcatttacctgaaaatctgtaatttatttatctttaaaggaatatcgtaaaagatttgtcatgtatatattaatagagatgaaaacattatgaaaaaaaatatttacaagacaactttaaaataaacatgtctgcaaaaggttttaaaaaaatctgctacaagacgaccgccaaactaacgaattcctagagccttacagctcccgttttcacccaggtcattgcttctctttgattttggctatggttgtagccggggttacggcgacatggtatagaatatttgcatcgcgttcgtgaaaataaaatatttgcattgcgctccaactagagtgcacacaagaagacgatgatcatcaacctaagcggttttttaggccatatagaatcaatagcatctgttgcccaccagtctagcttcttaagcggtttcttcaggccatgtagaatcgatagcatctactgcaaatagccttccagtgagtcagagtctttccacctcttgtatgtggaggtctaggcctacccacttctagattgagtgtctagattctctgtcagcctacgcttgaccagaaggtggagtgttgttttccacgctgcgcagtacaacagacatatctgttggtttgatcagcctattctcttaagtatgtctactaaccagactgttttgtttgataggacatgaagatttacattccagtggcgcccgaagcttctaggttgtttgtttgctagttgagctgattatactcgcaaagtacggtctatatgtcaagttcaccatatactccctgttggccgtgagcttccaggtcatgatgtcataaactatgaacctagtggcgcctatagctgttttaaccacattcaaatatcaacgaaatgccatatatgattagcttttgtgatttgacgaatatttgaatccaggtgtcttcctctaggctgtcccacactaaacattctttcgttttgaggccataaagattgcagaggccaagagcctcggtgttttgttgtctaggcaatgtgagtcctagaacctcaccgtgtttccgttctcaagagtgatgatggtcgcaaacgcaaaatgatctgtgtatccagctggttaccagatccggcatgcctacccaaggtatctccaatgccttccaatattcaaaccaaagccatcgcaaacttaaaaaacgctcttgtgaagcgacgcgacgcatatttaggactcatcaaccacaaagttctttcggtttgcacacttttttttccaattcaactgcaagttttattctcgcatatttttaaacttagttataaaaagacatggtacgaaatataggtcaagattcattggcatacagtcactagcaagaattttagttctctctctagtctctactggtaaaaataagtatatagctcgctggccgctgcttgagctaaaaaagaatagttggcaactgctgctaatgttcaccatttctgaaatcttttgacctccaacatttgagatgccacctgtaaaaatgcgagttaaattttgatcttcggaacatgcagtggactatcccaattaaggacccagcaagtgttatcctctccgtttgaataatcggcggtgaaaaaaaaaattgaagcttcgtggcagcctcgactctgaacagaaacggccaacatggacaacgtgcggtgccactgcgatccctcgtgcaggcgtgcacggtgcagcaagctagctagcgatcccgtgggtctcgtacttacctcttcacgacgaacggtaatccagaacaaccgcggcccgggatagcattcgagacttgcgcctcgcggaatttaccagctgcttccacgtgacagagcctcacaaaatccacctgcctcgtcagactggtttgttgtcacgcgtacgtacgtaaatttgttctcacgcgcacgtaaaagacaacaggaatccaccgtgacttgcttcaccaccaccctgcatgcatattccattttccagagggaaaaaaggtgttcactgatctccagctgttcgcatggttggtgcccctctccttcccgggtagttggggaatgaaatgacgctgggattgcacggttagtaaagtgtttaaactggagttcttactgcttgcttggtttaaccacaacccggtccctctggtgtgcgggctgggctagctggtggccggctcagtggccctcgctttatttactccttaagaatcgttcgcttcagctgacctctctccgccccgcctccccttccgtctctccgcgctccagctccacgccaattaaaccctactcctcttgcgttgcgttatctgcggttccgtctcccactactcgcgcacacgtagaaacggaaggagaaacaaacaaaaggcgccgagtaacgcagatagagagttgtttccgcaccgagcgcgtccgcggcagtgtgtgtgtgtagcggtagcgcacgcgcggctcgcgggcgcgccggttgcaccagctgtgcgttgcggcgacgatggaggtgacggccgagttcggcggcgcctactacggcggcgcggcgggccgcgagaagaaggcgctgcagcaggggtgcggggaccacttcgccgtggacgacctcctcgtgttgccctacggcgaggaggatgaaacaacaagggagggtgaggccaccggcggtaaggaggaggctgccggctttgggaacgcgtcggcggactcgtcgaccataacggccctggatagctgcagcaattccttcggcctagccgacggcgacttccccggcgagctgtgcgagccggtaaattctttggccaccttttgtcttgttaattaccttggattttgcagtagaggtgccaatcatttctggcagctcctgcatatcacttcttctgaaattgtcgtccctttcatttgctgaactgatctaaactagagctatgtattttatcatcttgttttacgcctcgagagaatttgaatgcattattagaaaaagaaaaattcgcagctgtttgttggctcggctgttacgctgtcccataataactcccgttaaaccacacaaaatttgtcgcctataattatgcagctccaattcgaacttttctcccagataacaaaaatggaagaaaaaacccgttaatgtacttgaactaacgataccaaaacggtagccttttaaactgaagcagttgactgccatgtactctggaacaaacgagaattccattatcaaaattgtttagcttacgaaagcatatagcacaataataggacgctgaatttactgtcggattttctgcagtacgatcaactcgcggagctggaatggctatccaactatatgaacgagggagacgacgcattcgccaccgaggacctccagaagctgcagctcatctccggcatcccctccggtgggttctcgacggcgagcgtcccgtcggctcaagctcaagctgcgtcggcggctgcctccatggcagtgcagcccggcggcttcctgccggaggcccctgtccccgccaaggcacgaagcaagcgctcccgcgctgcgcctggcaactggtcgtcccgcctgctcgtgctgccgccgcctccggcctccccgccgtccccggcatccatggccatctcgccggcggagtctggcgtgtcggcgcatgcgttccctattaagaagccgtcgaagccggctaagaagaaagacgcgccggcgccaccggcgcaggcgcagctctcgagcgtgccggtgcactcgggcggctcggcgccagcggccgcggccggggaagggaggcggtgcctgcactgcgagactgacaagacgccacagtggaggacggggccgatggggcccaagacactgtgcaacgcgtgcggggtgcggtacaagtccgggcgactggtgccggagtaccggccggcggcgagccccaccttcatggtatcgaagcactccaactcccaccgcaaggtgctggagctgcgccggcagaaggagatgcaccagcagacgccgcatcatcaccagccgcaggtggccgccgccggtggagtggggagcctaatgcacatgcagagctccatgctgttcgacggagtgtcgcccgtcgtgagcggcgacgacttcttgatccaccaccacctaaggacagacttccggccgcccatctagagatgagtcgtgtgctagaattgatcaattagcccatgaataatctaaaagaaacccttgaaccaaaaaaaaaacagaagaactgatattttcttaggagtttccccagtttttgtctcttttcccttcgtttagtttgtgcgcttttgctcagctcgtcgaatttttcgtgtcaattttgtttatgatgctctttaagtttaccaccttttctagccgggagttgatttctctagcttctacttatcttcctctctatcttgccatttaatttgtaacgcatttcaaggtacttaaatctcttcttccatttcttcctcccttctaccagaagatgaaaacaaacctgtttttctttttcttttttttttttggctcattgctttggcctaaaactaatcatcatgccatgccgttgcaagaccacttcacgatggttgtgtgggcaaccgaacatacaatacaagcaggcatgcaggatgcaaaggccaaaggaggcgagggcgccattgcccacctgtcgtgcgtcgcagctctagcacgtgaccatttgcacacctcgcgtgagaaagatgccctccttatggcagcacagaataaatggtggctggggctgggcgggcgggcggatgggcggaggcatggagcccctctcctcgctgtaaaacttttggccccgccctgctgctgccggccggcaagccttttgctgctgctgtgttagtgtggttgcgtttcatcattgctgtacctcgcgccggtaccacctggggcttggcttggccgcaattccggataagcaatcagtgacatgccctgcccggctggctgctggcgaagtgaaagctccgttttactcctacctttggcgtacgtacgtactcctcgaactggctgtcagaaagtcagcagctcagaacaatataaatggcaggcaggcagcctaccgtacgataggccacttaacctgccggccgcatctgacatacctgccagcacccgctaaaaatatgtacagtactcctaactgtggaccttgggtggttattggttactccgatcctacccagctgtgaagctagtcctgttaaacttgatcatttggttgcaggtcagtcatttggtaacagtagtagccagcaagtagaaaattaaccatgagctacgtagtagcttgtggggggcactgtgaactgagcgcatgtgggctctcactaccccgaggggggggggggacaagtggaggagtataaaaaccggcgtcgtgctcggtcagggcggcagctacccccggccggtgacgggcggaggcgcgcgcccgagccgcatgctcacatgggaggtggcaatagataaacccgagatagaggagagagagggaggatactagtagtactacgattacagtactagaggccggacggagctctggattctgacgacggactacgtgctgggtcgggatagaatagtattcctaccagcatattgcgagcggtaagtcgccttggcccctgcgccccctcgtgatcccagacacgcagggtcgcaggcgttggtgatccagatggaacgatgaattaacggccaatatactagtaccccctccgggtacggtgcttacgttactgcatgcgtttaattatgctcgatgtgatagcaggagtgtaaaaacaatttttggcaccgaatatgctcctggtcatggtggcatttctcgctggttctacgtgctccggcctcggtagcacaagcttgtgcgccttgaccaccggcaggaggtgcacgggcgcggcctgggaaccgtcgcttgctgctgcgagcacgtacacacccgtgtacatgccagcatctgcgtggtaaatttgccaccgtagtaccagcattgcagcgcgtacaccatgtttaataatttcagcgtggctcgatcgctgttaattgtatatatagtatctgctagctgcacgtactggttgttagtccttcctgggtacatgatcatatcacatagtcaaagccacgggctctctgataactaatcaaacagaggtactgctgattagttagctgtactctggaaaagggagatcggttgatcagggatcacatcggcttactagatttgttacgggttaagtaaagtgggggcgggcatgcgagccgggaaaggcctagtgggctgtgggcggtgtcacatgcatgaatcctgatgcgtcgtaaccgagcgagcgcgcggtgctgggaggtaacatgatggagtacgtagctagggaggccggtcgatcggcgcactcaccgtttgcggttagctcgagtgctcgatgggtcgggacggtggctgtgggcgaacccgaatcggggtggtgatgaacagtgtggctcacgtctccgggcacgtgaaagcacgtgcgcgtgtgtgcgtgagagagcacccgcgccaccgccgggtccggcttttggtggacatggagggtgacgagacggcgatgcgcggccttgccccgcccggcaggcaagaaccccggccgcgcgcggccatctgcgctaggcacgcacgcatgcatcaccacctgcagcttcttgatttactcgcgtcggtcgatctgcttcgaggcgctgctgcctaacctgccgcagcaatatattgcaatgcatgcatgcatgcctgccctgcctgatcgatcggagatattttcttcagcgctttcgtgccatcaaggccatgcatgattgcatgttgtgctgttaggttaggtaccggtactgatgtgtagtagtagggcacttttcattcgtccgtttagtttcaggacccgtgtcgtgaaacatatagcccgtgtggtttctgaattcaattctgacgctgactgtgtgtgggacatgtcatttgtgtgcaagtccttcagtttgtactttgtacgtggtagtctctaaaagaatgagttggtcttcatcaggtgctgctcccgagtgtagaggaaaaaaaaaaggtcgtctctcttctcccttttctgggacttactatgcaacacgtacgtacgcttatcagtccacatgcttcatttttatcatgaccactggccagtggcttgcttgtgtcctttcgttccgacttcagattcgtcaggacgtataaatgaaaggaaactaattcatgtcattcagacttacgaatattttcgtcagacttaagatctagtatccggccggggtccttcaacatgaagaaactgagtttttgtgttcgcaatatcagaccgcaaggggacaaactaaaggaagttgatcctaattaatcttgcaaagcgaaagggcctgtagcctaatgattacaagaaccttgtcacgccccgaactagtcccgaccggaactagcccgtgacgctccaaattaacctgttaatcgataccagtcccagaaaacagtgctggtatcacaggaagacagaatatcacagcaacagaggtctctttattatagagtaggagtacagtcttgttgggctgcggacagaccccgagctcacaactgcattacaaaaggaaagcggaagccaagacttggaccaaacatcacaggcgcgacttgggaactaggccgaaaccctaaaactcatcgtaaccggcttgctcctggaagaactcctcatcagcaggatccgcttcatcttcttcagcagctggggaaataagtgtttaatgcaggcttcaaggaaagactattgcttttgcagttgattttatttgaactcttttctaaaaacgactaagtgagtgcttctcaaacgacacggatgagacagtgcgtctcgtccggtcggagtatgtgcaatgtatcagtctttagaaatgattcaaggttggcacccagccaatagcttttcaaacggccacccgggcctagctgatcccgtcagctacagatttttcaaacatcgaaccccttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcctgtgggaatcagccacgtcgggagacctccaagctttcatgacaaggcatttccaaagccgacacaggtttaccatatgccgacgagaggggtcacagaccaacaacaggttaggtcccagaccatactgcgccaggaagcccaggggtcctccccgacaccaccccggcgaatccacatgtctctcggcatcaaggctcccttgataagctagttactcagccaggggtgtcccattccacccatgtggtcgtacttgtcttatgtttggatgaaattccaaggaaacggtccttaagtgcgagagcgggaaaccgtacacccggtacgttccccggtccgcggttttggaaattcatttagttcgcaagcaccgacccaggtgtcgggttttccaagtcttttataaaacccaagttttacccaagaagtttttcagattttaagtttgaaggcgtccgtcgatactcgcacagggtgcatgaatatcgagacgcaactagatggttacaaggggacacgatataacaattatcaaatgaaggatcaaatgcaacaatttaggtaggtccgccaatctgccttgcagacgggacaacagattaagtgcgatcctatcaatgcataatattttgcaagcaatataattaagttcaaatataggctcaagatgttcaaaggtggcttgccttgctcgagatctggagcttgatcctcgaaatccacgcactgcgggtctttgggctccgaaactacacgcgaaacgggacaactcaacaaacggcaaaaaataaagccctattaatgacctctaagcgtgccattagatagatctcgagatttggggaattttggaagttgaacggagtcaaatggatttacggttgggaagatattgaatttctaagattattggatttttggtctaaaggaaaaaggatttaattaaatcctttttgaaaaagaaaagaaaagaaaaggaaagagggagggaaaatagacttccctcgggcggctagggcgcggcccgagagaaagggcagctcggccgagcttaatgggccggccggaccaagaaggcggcccagagcggcccaaggcacgcgcgcgcgggagggaaggagagagagagccggtggaccgggctcaccacgcgtggtcccgggtgggacccacttgtcggtgacacggttcaccgtgcggagcgagcacgcggcgcacgcgcgcgggcggggaagggatgcggtgcacgcgcgtggttcgcggaggaacggatgcggcgggcccacgcgcagcctcacggctcgcggtggaacgcgcgcacgggaggggctgaccggggtcggcccgacccgatctcggccgagctggcgccgacgtggcgcctacgtggcgccaggttgctgccacgcgggctggcgggaggtagacgacgacgccggccggaacggacggcggacgacagcgacgagcggcggagcgaaccacggcgatacaggcgagagcgagcataccgggtggttgctcaggacgaggggagacgagctaacggctcggattcgccggagggagtccgtcggcggtggattgcggcggcggcaaccggcggagagaaaaggggaaaacggcgacgaggtcacgaggggccaattcccggcggcgagagcatctacgcggctacgggaatccgttgctagcgtcggattgggcggagctacgccgagcgaggccggcgacgagcggcgcttcggagctcgggcggcggcgagcacacggcgagcggcggcaatggacggggcggcgccggctagctacggggaggctactcgtgctaccaccgaaaactaagggggggagatggagcgaggaggaggaacggagggaggcactaccgagatgaggagcggagggggagggagagagggagagagagagagagagagagagcgccgggagggagggggagatgggccaagagagattcggcccatcgaacccgggggaggcaaaatagacttttgcggagggaacgatttggaaggatttggattcgggattgaactcgacgatagatcggggatttgagatctgagatggcacggacactagacaacaagcgaagaaacaaatttcgcaattagggtttttaagagataattttcccgctaggcgccacgacggaacgggcgctacaaacctcaatagcaccttaggtccggggttcgactcctcgtgagagcgaattttccaggatttaacggtattatatatagattaataactttagggttcaactcttcttgggagcgaattttctacccatgggatgtttttcgcccctaacggaaaggggccggggaaaatgcggaaaatgcgttcgcccctaacggaaagaggccggggaaatgcagagcaaattttccaggatttaactgtattatatatagattaataactttagggttcgactgggctggggaaaatgcggagcgaattttccaggatttaacgatattatatatagattaataactttagggttcgattcttcatgggagcgaattttctaccatgggatgtggaaaatgcggagcgaatttttcaggatttaacggtattatatatagattaataactttagggttcgactcttcatgggagcgaattttctacccatgggatgtttttcgcccctgacggaaaggggccggggaaaatgcgttgttggttggcattatatatagattgataacttttcgactccttttgggagcgaattttctaggatttaacggcattatatatagattgataacttctaatgatgatatgtataacataccagacccatgggatgtttttcgcccctaacggaaaggggtcgggggtcgggggatgaaaatgccgagggaaaatgcgttgttggttggcattatatatagattgataacttctgatgatatgtataacataccaaacccatgggacgtttttcgcccctgacggcgttatatatagattgataacttttgatgatatgtatagaataccagacccatgggacgtttttcgcccctgatggaaaagggcggcgcaaaatgtgttgttggtttcactgtgcgttagttaatcttcttaaattaaaactgttactccctccgtttcataatatatatctacattcataacatcttgttaacgaccaaatttggtaatctaagtatcggagatgaagaaggaatcgaagcgaagttcgagagggagatcgcttcggaaacagagtaagaatcggctggggtctgagttggctgcgatcaggatcgacagagtccgagttggacagggttagccgattgagccgaatccgacaatgtgtcacagcgtacgttgtcgggttgggttgatgtgcttcatgaggattgccgcgtatggatagagtcctgagaaggcaattgtatctattacttaggatattttatgtaattttcttagagatatgttcgggcaaaagtttgctgtaaagacttgtggtattttagagtttgttagagataagagtcatgtcctaaatggacatattttgtaatctcgggtataaaatagaccccgagccccatgtaataaaactaacacacgctcaatacaatctcggcgcatcgccacccttttactttcgttttgttttcgacgaattcttgcttttgggttgagttgcatcggtttcgatcttcaacaagaggtaaaacttattatggcggcttgcgttctcaggattagtgcttacatctttatgatactctaatcctatttatgtaattcgtcgagttatcatatatcttacataatctccggcaatatcgctatctattcatcaatcggctaacgtctgccactagagggcagccgattaagttaaataccgatgttgacctagattatataagatatctaccaccctatgaaacatccagcgacttgattgtctagatattatcattcttttcatacttatagctgcatcagttgagtttgatcttatgagtcgtgattagaatctcaatctctagcctacctttggttggcgattagagtagcatcggggtttcagccgatcttacctgatttaactatatttatcttatatgcttgattgacatgttaaatctgccctttatgctaagatcttgtcgcatttaagttattaggattttgtttggtatattttacttgctttgatatcttaatatagagtggtatcggagtattagccgatacatgctagatctatctgatcggctatgctatgaacatatataatctcattgttagtatatatttcgatctaggtgatttatactgtctcggcatggcgaccgatctatcccaatcacttgatttaagcatatatcaacataaggattatatattgttaatatctacagccgatcgagtagatttagtcctttcttacttattcatgattaccgatcgattcacatatgacatcggcttgaagataaatgatatgtcatcggcaactagccgatcggctatcgtttatggatttaaccgcggtttcttcgtctttgtttcttgttgattgcaggatcaaatcaactgacacgctcatacatctaaaggcaagcttttggacctgcactggagttaagcagatctcctagacctcgtgttttcacgtcaacacatctatacgaatgtggataatactaaaaagtcggacgtttttcgcctctgacggaaaggggccgggggataatgcgttgttggtttcactgtgcgttagttaatcttcttgaattaaaactgttactccctccgtttcataatatatgtctaggttcattaacatctatatgaatgtggataattaaaaaaagtcttacataatgaaacggaggaagtattattgcggttatcagattatgagatatcccattagcctatagtcttcggtgtctaaacgcctatcatgaagacatgaagcccactcaaactgccccaagtatcgggcctctttttggggctacaggtgatgtgtggatactctcatggaataagttcatctaaggtccctaaattttacactgaatctaattttcgtccttaaaccccaaaaccagatacaaccagtccccgaattgtcaaaactggtacaaatgaggtcctttggcggtttggaaggcggttttggctgacgtggcgtctacgtggctggtttgactaggtctccatcccacgtggcattgacgtggcgcttacgtggcaataatagctctgaaaaataataaaaaactgtgggcccacatgtcagctacacataaaaaataatttaaaaatggtaggacccatgtggccccacatgttagccacacaaagcccatgtgggacccacatgtcattccctctcccccactcggctcttattcttcttcctcatcccgtcgcggcgccgccccacagccttaaagccgcggccggagcggcggggcccgccgcgccaatcaaccgccgtcggccaccggaaagccggccgccaccgccgccgctcttcccacttagcccgcatcgcaacgccacaaggggacgcgaccgccgcctccccacacctccggcaacgccgcccggagtcgcggccgcatcagccgctcgctgccgggggcgccaatggcgacgatttcggagacactgcccaactcggaggccgtctcccacgcctacaagttcgcctccacctgggagaaggtcggtttcctcgcttcgctgcgtggtcgggtgggtgtgtggtccagtggtagcactggtggatctggtggatctgatctgatctaatggtgatccagtgtgtttgatccatagtccctgttgcttgcgatgactaaatgttgtgaactgatgctaccatggtttggtttagtttagtttgtcgtgctatgctcgggatagactaacccgtcaatcgtatttgaaggatttgagatatttcattagttgcaacacagcatacatactccatttggtagttccttattcctcctcttgtttcttcctgtgctctgcttcctctgcctgcgccatggccgcaccaggaagtagcctcgcgccgactacctaatcgtcggcacgctgccacacttggtcaagaatcaacaccatctcgtcgagtggtcggccggcattgtatgttctcgacaccggatttggcacaacccccgctgctcgaagcgcagggggcctggagctcggggagctgagggctgaggcacctctccgtgatttcaacagcgcagctcaccgggagagggaatgacatgtagggccatgtgggttccacaatttttctttaactgacatgtgggctcatggtttttattatttttctgaaatatgattgccacgtaagcgccacgtcaatgccatgtgggacgaatacctagtcaaaccagccacgtaggtgccacgtcaaccaaaactgcctcccaaaccg

SEQ ID NO: 72547 - DNA, 3517 bp, Oryza sativa
gagtcaatttttggcacgcccggtgggacacaagttttgcacccaacatgtctgaagaggaagtcaataccaagaagtagcaatctcgcaagccgatggttgaaacacttcaagatacagttgatgaagcaattcatcgcgcattgtttaatcaatctggagttttggcggatacattacaaagtttgatcaaggtaacagttgatgagttaattattcaaaaaagtcagctcggggggtagattgaagaacaacatcagcatcggctcggggggcaagcacatcggtgtcagcatgatgaggcatatcaacaatatcggccagaaggaattcaaagatatcattatagggaagatttggccaatagaattgcaaaggtaatagaggagcagtttggaatcaatcttaaggaacatacttctgtgtatcggctgccatatgccgagtggtttgatagggttccattgccacaccgatagttccaaattactccaaattttcagggcaagatgatatatctacaggaacaaatcagccaattcttagtgcaatgtggggaagcaacggctgaggaagctctgagagttagattttttccactgtgtttgactggatcagccttcacatggttttcatcactaccatcgaattctattggaggatgggccaatcttgagaagcaatttcatgactatttctttgctggcatcgatgagatgaagcttttagatttgatatcagttcagcagcaagaaggagaatcggctatggaatatattcaaagatttcggaatatctgcagccgatgttatagtttgagcctgagcgatgagcagctagcagatctcgcatttcaaggattgtcagcacatatcagagagagattcttttgctacgagtttgatagcccggctcatctaatgcagacagtatcggctcatgaaagtcgactgcacgaagcaaaggaagatcagttttggagtcaccaagacaagaaatgagataagattgaagcatgagctttcatactccaaaatttggggcatgtgttaacgccaaaatttggtaagcccaaagtcatcatcggcctaaagttagtatcggcttcagagtcttagaatcggccgatgggagtcatcaaatcggcagcagttgtgttcttgatggagtcggatcaattgaaggaaatttatccagaagagtccgagttcaaggaggatgcggcatggcaagtgtatctattaattaggaatagttcgttagtttccttttatctttatgaaagtgtgtttagtgttcgataaggactttgtgttttccttttatctttaggaaattttctttattgacctacaaggactaatatctacccatgggtataaatatgtacacccggggtcattgtaatctatcaatctctcaatcaatacaactactctcggcgcatcaccaccctctttactaaggttttacttgtcatctgacgttacttggcacctgacgcggggctgcatcggctttccatctctggcgaaggggtaagtcctacgttccgctggccctggtgaatctaccgactacattggtgttgttcaagactgcatcgcttcgatctcttggatcgctctggtttggttgatatatttgcctacctgatacctcaattctatccctaattgcattgtgtttagagacacatcggtttagttgggactgtctcggttaggtctgatcttttgtcttagccgatatatctctacaatcacaatgaagttctaaggccctctttgtttaggcttaggcttattggcctagacttttaagtcagtttattggcttatatgatttataagtcagtggatttaatgtcctaagtttagtggtggagtcatacatctatctcatataagccaaaaaagcttctccaacctagcttttggctaatagtgttagagtggcttatggcttcaaaaaagccaaataaaaaagctgcttgtttgttttggcttagacttttcgacttataagttggcttataagcctaaacaaagagggcctaaatagatttgctatatccatcatattagatagatctatcggcttaccgagtattagattatcatatacaatctcgtgctgcattggtaggttcgacctactagattgttgttgataatataaatcttgctaagtcgataggttcatgctaatgttttatcggggtgctagccgataagttatctggatgttgcatcggcttataaggattgcatatacatataagttgtatttagccgttgacaacaaaggtttcattgatttatctaatcttgtggattttatgacatcggacctccagccaatgcatgctttaaccatcggatcagtacttgttctatcatatcatcttgttagccgattagtttctactggattatattgttgtatattgcatcatcatcagccgactgcctttatatattatctacatttgacatattgccaatagctcaaaaccctatcggcatcggctaatatcggctatcgactgaaactactccatcggcttgtcagccgatcggctcattaatctactatttgcatatctaccctatagttaaacaaatgattttattcatttactcattcatcatatcacatatctaacggtgtaaaatcatccgatgtgttagatcggacgtcccacatgggcgcgtgtcggtcctcatcctctcccgcacccccccccccctctctctctctctctatttgccgcaatcgacgcgcctcctccgcatcggcgcgaccgcgcatcctctcccgcatctccctctcttccgcattcgccgtgcctcctccgcatccctcccctccgcgtcaggatcgagcgccgcctcgcgcaggggttcaccggcctgctgcaggcgcagccgccgcagttcccgtggccggcggcgtcgcacaagcggattcccttcgagatcgacctccccgtggtccccttcggcgcctcccggggtgcccgggccgggaaggagttcttcctcgccgcggccgtcgcctccatcatcgacatcggcaggaggccaccggcgccagggaggtgattctgccactccgcgcctcaccggtctccactctccatctcgccgccgccaccacgtccgccctctgccgcagatagaggtacacatcccctcacccatccctaatatgtcagctctcttccaaataagtccccccgccggctatatttcaattttattatgctgcaagtaatccgcgtcgtcacattcaatactatggtgatcatataatttggagtacatgtttagaaaaaaaaactaatgcactaaacacaatgatgatttgaatgaatcaattattgctgacgatcgcatctgaatcaatggtagtttacccttgaatgatttgtctctgttcttctatgtttggtgggggtggcattatatacatgtttagacaaataaactaatgcagtataatttgcatatgt

SEQ ID NO: 72548 - DNA, 14392 bp, Oryza sativa
ttgactgagaactatcaaaatgatgaaatttactccattctgaagtcagaatatctttcagatgtagagaatctataagactgaaaaaaggacataaatatgggctagtgttgttgttgttgttagtcaggcagcataaaaagggtgtgaattatagatacttatgtaccactgacgtagactgatcaacattttgggttacaaggaaattaatgattaaagtgcccttagcatagataattatgcaccactacgatagaccgatcaatcttttggttaggaaattaatgacctatagagctataggaatggcataatactcagagaaacaatacttgtaatggtaggtacaattgagttcatttttgtcaagaaaggtaaaccagcatgtttctttgtcacttggaccgttagtgaaatgcaggtacctttgcagctttgctgaagcaatgaacttgcagaaaacaaaaatgtcaaaatcatcgaatgcgactatttacttgaggaaacatgtaggtgaaccattattggtagggaatacatagagagttccgaaaatggcaataacatacgcttagtaaaaagaactttaatgaatgatatggtacgctgcatttaacccacttaggtatacacaatgatgaaattgtaaatcacaatgaatcaagaagactaaacacctagatagaaaccaaaaatcaacatgcatatgaagttctgaacatttcagtgtaattcattctcacccatgacgcgaatgtcttgtcatcctgctccctgtgggctggggctgagagacccttgttgaacctttgcacacatcttgaaataagaatcaatcaaaaaatgaagattggagtaacaagcagcagacgcgctgagtaaatagtgacaaggtaaataatgattgattggctacaccggagtaggagcaccaagcggacggcaatgccatgaggagtaggaggatgcggcagcccaacagatgaggaggatgtgccgacaacctcaccgctggcagcaatgccagctgctggagtcggagcaccaagcggacaacggtcagcggacagcggcgctgagatctgaccgaacttgatctcatggccccattgacaccaccattggctcgggcgggctcaccagacacgacgtcgcctatctctactaccgcgccgcgggaagccacggtggggcgccacctcgcgcagcaccgggcggggatcgaggcgcgcgcgcgacgtcttcgccatgtcgggggactttaacctcacgctattcaacgagctcgaggtcgagctcgtcgggggagagcctagtcgtaggtgcttgctgcaaggagctcaacgccgcggatggagggatcggcgatttctctagaatactcgattattttgccacaccttttcttcgggagagggcagggccgtgaggctgtggaagggcgaaggcgaggcttgattcttgaccctgaaatcgtatatagagatatctataatcaatctgtaaaccgaaattactgtttactggccacgcacggcattttaactcaaacttttgtaaccgaaagcacaaatacgtacgttaccgcgcatcaagcgtggtgatattgtctacaatctactatacagtgcggttatgaaaatgtcaaaaaaaacacaagactaaaactgaattatttgaatttagttcaaaaaagaaaaggaaaatcttagcccaagctttgcgaggtacaggtatccaagcaggctgcaaccgaacaatgggccgacccatgcggtccaaccgtccagtttttgggcgcatactgtcgaaccgggcaaggcccacgagtggcctaaacatttttttaactttacgctaaacgccgtctgatcgagttgattagcccttagcgtagcacaaaacttaaccaaaaaatgaaaaaaaaaattaatagcgccgttgccggggatcgaacccgggtcacccgcgtgacaggcgggaatactcaccactatactacaacgacctcagtgactaaaaacagtagtttactactcaaattcaaaaaagcttaccatgttttttttagaggaaataaaactactgtttttctttttttttttttaccttgtttaccttcgatcataataacaggaataatcataccttcatagaaaattggcctcgcttggcaatgctttttctgaaatgctaacatttttaaatgtgattattgagaataagtttaggtagaattgttttttttaaaaaaaaaacatggtaaccatgttgatgctgtaataaaggggagattcccctatacctgccattgtgcccgttcaaatacagagtagaatgactgaattttttttttaacaattgcttgtctcatcatgttttaatatctaactatcaatttgactctaattttttagtttacatatttgaccttgcttttcaaaactgaaggtcagaattaaccatattcgatgaatgctagagaacagtgttaattaaggagtaaattgtccttttacccttgctcaattaaccatattatatcatagctttttttatccggatctttttgaaataattataatgaatttggtatagctttgacagatttaaaacaagtttaacagatttgtcttcaagttgaaaagtttgattctatttgacagattttttacataaaattgacagcatattgtccaatagcaaattcagatccaaacccaacaataaatacatatccaacagcaaattcatatccaaacgcaaacaacaaaagcatataccaacaaatccaacagaagagagctcggtctagtcggcacaaccagaaatgagcagtcgaatgagcaaccaagagagctcgccgttcccttctccttccacacggcggcgccacccctccctccctccattcgcatgcagcaattgccgtcgtccctcacttctcacgccttacgcttctgcgctcctccgtgcaccatagccaccaccgctcctttctcccaccacatgccgtgccacccctccatctctccctctgcgtagcaacaaccgccgccgctccacctccctctgcgtgtcgatgccatctctcccctccttccctccctccacatagcaacagccatcgacatccctaccttcgtgcgtcggcgcctccgcccctccttcctctgcgtgccggcaccgccgcctctccctccctccctgcgtagaatccaccgtcgccgtccctcccttcacttgctggtgcacgctactccttcgcgcgcatcagttgtcactgctcctcctccctccatgcatcagccagccgtgccgctgagatgttgcatgaagactctcgatttgtaagtggcctcatggtcaagccagaaaggaaacacaaagtctatatcttccgtcctctctattactcgcttggaatgtggttatttataatcatgggtattttggtcaggtcatactggcatttttttttctttttcctaactacaaatctaacgattttgaaaagcgaaatcaaatgagcaaacttgaaaaattagggtcaatttgatagttaggcttgaaaataggataaataagcaattgtcccttgtttttttatggtgcaatgcagcaatgggcgatgtctaaacatggcattgccttaattttgtttcatgatatcccgtagacaaggaattatgttatctgtattccatctatatcaagaacctgttggggagcttttgacagatacaacttctcccataagtaaaaattctctaaacaatctaattttcatccaaattctaagaatatgtagttgtataattcaaaaatgaactagaagttttcccaacttgtaaagattgttcgagccatggctgataaacataaacaaaaataaacaaaaaataatgagtaaaatgtttatatatgggtgtttgtagcaatttaaaaggaaatgctaaaaagttaaacttcaatgaaaaaaccaaataaactttttgaactttactatttttaactgcggcaaataagttaacgaccaccgcttatgttgctcatataatagttcctgcactaccgtaggcaggagtcacagtacagctcagttcaggtgctgctgcatatggaagcaagtataatactgtagcccacggtttcgttttcttcagaacagggagaagctatgggtgcagtgcagtgcccacggtttgaaacctaaaatttgtattcccatggagattagagaggcactgtcacaacgtgccatgcttcattgcttcccctttggtaactagcaacttgacatcttctgacgctgcctgcctcgtgtatcaccagataattaaccggcccccaaatcctatttaggagtagtacatatcgtactcacactgcaccgtacgacagtcttgaacccgtgagccggcagtgcatatgttcattttttttttgtttttttacaaagatttttcttttcatgttcgctgattgtttgtagcatatttggaagacatgtacaatattcattgaaagatatgatatgttgaatgacacggacgtggaagtgcattagcggatcagatcatagttatagagaaccagaatttgggaacctttggtcagcatttcccctttggatgctctctgtccaagaacatgaaattgaaaaagaaaagaatcttgcagtactagagcagaagtcctcaaggaaaaggagcaagggcaagtggaccctgattattccaagattgatcttgaagctctcgagacatgtctggagatattttcgcctctaggagctatagaataatgagaatctttgtaaccccaagagcatcaacaaggatgctttgatcataacaacaaatcaggctttaattcccgcaaaattccttcattccaggactaaaatgatacaagggtatatataggttctgagcgtatggtatgagatattgcaatttgatttcagaaaatagaataatgcacctttgcaagtagcatctattgtcatgttactgaaacaagacaaaccataagctgacaacaaaaacaaattctattgctaggttgaacttgtgggtattaacccacagcattgagggtagcagaaggggaagtagaccatggtaggtatagaggatttgcaaaaatccaataagaattactcgtggagtcaaatctcaaaggaacacaatctatttccattcatgatgagctttcgctttcaaggctgtttaacaatttcccccatattttttaaataatggaaagccatttacattttcatcatggagtacgagttgcacaaagagaagaaaagaacatcgtctttcgcacgcttcccaaactaagtatttttcgaaaaaactttatgtagaaaagttgtttttaaaaatcatattaatctatttctcaagtttaaaataattaatacttaattaatcacccactaatagcttaccttgttttgcgtatattctcctcttctcaaacactcaccaatgtttactgccatccaatcagagaatattttccatatcttagtttcatgttaatcgccttgttgttaactgggttgttttgaaataaactttgaaggagatacatcgtgttgtgcatccaagtaaaaatttctggacatcacatatgtgcatgtcaggcaagaaactattttagcaagagacaaccaggcatggaaccaggtttacatactagagaactatttttgttatgcaagaagacagaaggcatgcgtatgcaaaggacatctcacatgtgatgcaagctataaaccaccagtggcgcgaatcacgttggacaggccatggtccaagatccagaaagccaggggagccatcttaagaatcggacaaaaacaccaaagaaatggctgtattttgtacagcaacgcaaagctggtcagggcacaaaacaagtggtgcaggaaaaagaatataaaagtttctttgcaatggtagatatgtagatcaggttgttatcatgattttctttttctcagggaagccccataacagtaactgcaaataaagacagatggaagattaacagaaccaaatgatcacaaaatctaattgggagccagtaacttttgaaggttagtgtaggttaatcaaatgaaaggtttcaaatctgatagcttgactcattcaaacaatcaacgacccttgagaacttgaagcaacagggacaagtactatgtgacatactatccaatatttgagccagcaatttcagagacatgcattggcaaattaaagatttcaacgcttctgacgatgaaaattagatgttggagcatgtagtgcataaatatgcactagaatgatttaatattaataatcattccaatagataggaggttcccgattagcaaatccaatcagctctagcaatagaaaaaaaaatacaggagtaccagaaaacattaccaaccatttattaagcttacaatttcatcaacttcaaccatccacaatctgggcatgcaagcaaaatgaaatggattttactgaagccacaagttcataatataatgcaagtactatagatatagttaccgtgataatgcgaagaatcggacaatctaatacatgaagaacaggtagacaattgaagcataaacccactcttcagctgcaaagacaagacacttgccaacacgaaaaatccgatccaactccaacgggtaaaggtaaaaagatcaatctccctacacaattaagaagcattgaggtgattgcatgcacacaagcagttgcctcaggctccaattcatccatgagtgttcacagcttcccaaaccaaattctttggcgcagcaccactagtggctttcctggcctgcaatgcagcagccctcaatgtcttccatgtcaacacattagcctgccagaacgaggcggcggcataaggcagcccatgcttcttgcaaaggtcacgaacaaatggcgaaaccttcctaaggtggcaccgcgggaggcgaggaaacagatggtgctcgatttggaactgcaggccaccgtggaaccaatccatccatggcgagcactgaatgtcgagcgtgcccgccgtctgcttctcgaaccagtcattcccctttggcggcccgacatacacctccgaggagaagtggttcaggcagaactgaacatgctgaatcccggtaatcacgaagctcgcgaccacgaacgccaccctctcccaccaattgggcaagcaggacaccaccattgggtaccaaacccagaacgcggcgacgcccgcgatctccagccccctctgtggcaccttcctgctcgacagcaagaagacggccgactgaataaggaggtttatcctggcgaagcacatgaccgggtagaatgtccagtgctggtagctgatcaagaacttggacgcggcgtcgaacaccagggtgcgctggtagaagtaggaccagaggccgaacagcttggaggagacggcgaagagcggcatgtgctggaggtccgggtcgtggtcgaggctgttgcaggcaatgtggtgggtgttgtggttgcacttccaccacgcgatgctgaggccggtgaggcagttgccggagagcacctggaggaggcggtcgagcgcggcgtgccccgtgatccggtggtgccccgagtcgtgccccatccacccggactggatccagatgaacccgatgagcccgccggcgaggaggtgcgcccacgcgctcgcgcaggcgaggacgcagtatagcgcggcgcataggaggagcagcatcccggcgacctgcaccttcgggggtgggccccacccgctcgaacagccccccgaaggagagctgcgcgaggaggcggcggaagtcggcggacgccggcgagaccgtgtagtcctctagccggcccacgaggaaccttcccaggagcgggcgcccccacggcgggtggtagcggcagaacgcgtcggtggcgtcctgccccgccagcgtcaggagcgggatgtccccgcccgggtggtggggcacccacgccgtgacgtcgtacacgtccccggagatggagatccacaggtcgtccctcgacgcgtgcgcgcggagctcctccgaggagatcatgcggacgccggcgccggcgcggctctgcgcctccttgggggaggccggcattgtggccgtcgggatcgccggaggcatggtcggcggcggcggcggcggcggcgggattcggagatgggggaacgtgaggaggaggaggagtaggaggggaggagatcggatcttaaagaggagggtggtgcctcgctggtttctcgccttcgttgagaggggaggtggttcggtttttttcttttcttttctttttctttttcttttttttttgtttgggttggtgggtttaataaagttttttttctctcttatcttttattactctccaaaagtttaggagagagagaccatacggagttgtgctatgacaggctgacactgacagcagggttaacgtactactccctccgtcccaaaaaaaaagacaaactctaatttccgtgcccaacgtttgaccgtccgtcttatttaaaaaaattatgaaaaaaattaaaaagacaagtcacgtataaaatattaatcatgttttatcatctagcaacaatgaaaatacgaattataaaaaaatttatataagacagacatttaaagttggacacagaaactcatggtttatcttttttttttgaaacggagggagtacggattagcagtaataaagtgactaaagcaaactgcttgttgtgagtactgtgcttatttgtttaggatcggtttaatatttgaatcgtagtttgaaatcgattgtagttcgtttctagaaataagagttggatgactatacaaggtatattatcgtttattactatccgacttatatttccctgttttttttccccagcacagcactgtttgtttatcttgtttggttatctatgccaatatacattgtaatcgaaatattgccctatacgaacacagcacggatccgttcagaacgttaggtgtttttgtttagttaaatttcttccggtttgattaagtttataaaagaatatttttaatacgaaataaaagtatcatagaaacatccataatcgatgatggacttaacgaaattaatttggtgttgtacatatttctatttttttatataaacttggttagacatagggaagtttaacttacaacaaaaccaaaacaccattattatataaaaggaagtagtttacattttttcaagagtagattatatttgatatatgactcttgcttcacagttttttataaatacaattgtactgcgtatacatttagcgagtaatctaggatatgttataatatgattctaatttgatcaaagtgacacatatgctatttttgtataaacgtggtaatttcaatgttcttagagcaaatgtaattttatgaaaatgacaatggatttatgcatggagcttttagatgctaaaatgaatgttatgtatcttttagaaaaacaaaatagcagactcaaagaatgtaatgattaaattaattttagaaaaaaaaaacaactatgctccaattatgttttctttataacacatctcaggtcttttttttcgcgaaaacacagattggtttcaatctttctaccttgagagatattgtggtacttattcttgcgttttgtttttggcagaataaatgaagaatggtatactctgcatgtccagataaacaagaaagtgatgtgcgtgggatgtagcggtgtagctagggggcaaaatatctaacgtactgattttgatgctcaagaatatatccttttggatcatttaataaaaatccttagggtgaggaatacatatatttttattttctcaaggacattcaataaaaatggagaatgagacaacgagaactcgcacgcacgatgcctgataaggcaagaaaaccattatctttaacatacaacaattctcgtcaactcgatctcgtggtgtttttttctctttaacttcatttcacataaaggcttaatttccttctcttttagaggattttcaatgaaatttttatcctataattcaaacgagccctcctaaaaaagaggtacattgaaagtcagttttgctcaaatgtgcatgttaacctattttgagtttactacaaccaattcagctcgttgtgttagagcgagtacaataacaagttacaagtcagctgtacgacacgtggaggagattagagaagagagaggagagcggactacagatttgtagtcagctataacacaggctccaatacgttatgtgtgtatgagatgtgagactatatattaacggtgtagtatatgattataagtaactattgtatgaataagctattagattggctgcagaagttggctatactattaaacttgcatagtacaatatcatcttcaattcataggagtgagtgtctgtgttttactatgtaatcctaaaaaacagaatcatccttctaacttacttttctgccttaaattcagagggaaaatgacgatgctgacgtgtaaccagcatcttaacggcatctcttttgggcaaacccagcgtgatgcctttcatcatctcttcttcctaactctctctctctcccctcgcgatacacatgcatacgcatggtccacagttgtacacgtgatgcccatcacttatcagcaaaacacagcgatcgttcagtgaggccgtgcctgtagatggcttctcatgtggttcgcaaaatcacaattggcacgtttgcccgcagaaacgtcgtcacttgcgtcgacgcgtacgtggtgcatgcccatacattcgtactgcggctttgtcaaggggaaactgtgtgcagaacgtgcaagagatttgcaatgcaaccagtggagtagaaactgccgtgaactagtgatgttattttaggggaacacgctacctaggtggcagataactctaaaacatgtactccctccatcctataatataaaacgtgcacacattcgaagattcaacatttaaaacatttgaccaaccttagtataatatgaaataaattttatttgttaaaaaatatatcattagattgagatttaaatttattttcatatgattataattttgatgctataaaatttatagtatatgagaaaatataagctaaagattagttttgaagaccgtgccaactttgaccgcgccttatattatgggatagagggagtaagggtattcacaatgcgtcaatgtggtgtaaccctaaccagccagcgaggagaatcccctccacacgagcgacattcatgctcccatgcatggaactccttatgtccactctccaacctatcccatcctatgaagatgcatgactcccattaggctttgttagggtggggtcacgtcacacacgcgtggaacaatgggtcaaagctgcgatgaggaggtcgtgcccctgcgacgtggtgtggtccccataccccatgcccacacccacaccctagtgtctcctcaaactctgatggccagagaacaagagcagagaggaaagaagagcgacctacctttccaacgtcgacatcaccgttagggtagacagagaagacatcgacgatgacctcgaccactccacatctaaagcccctaggagctctccttctcgttgcccccttaatccagctcactgagcttgtcaacaagccaccaagtccaccatcactgcccatcaccatcgagctcaatctcgatttgacgctcatcacctcaatgccattatatctattggtgcaaacatggcgagaaaggcatccagagcgacgagaggaaaataatcgaggatagggaagggaaggagaaaaaagataggagagaagttgatatgtagattcggtagaagagttaaggatattttatatcctttttattgttgtatgctgtaaactataaaagttttaattagtttaataatagaaattattataggggctgatatagaaataattagggactgaaaaaaggggaaaaggtctattttacaccctcgacctcttatgcttgtctaatacaccatcgaaccacaaaaccgggtataatacaccctcgaactgtcgataccggacacttaatcccccccaacccccacaggtgtttttacggtggtttttttgacacgttggatgccacgtcaacccataagaatatatgggccaagccctttttctctctccatgccctgttcatgcttatcaccctcacgagcattggcggcggcggtgacgtgaagttgcgagggcagcgatgttgccagggttgcggaggcttgctatggacaacggtgtgggaaagaagcatctctgacaggttgcgcgcggtcgccggcggaagctctaggtgtcgtcgccgcacgcgcctgtagagatggctcaacagggaagaaacagcttgatgcgggggggggggggggagcaacgacgagcttgagcttgtggagtgttcagccgacagaacaagcagatggaggagcacgagcagctctagaaatggcgccagatccaatctagacagaagcaatccacttccgattcaatacagagagggtccatttgattattctccagctactctatgcgagtgtcgtaggaaggcagcaagatgaatttcttggaatgtggataatccatctcggaagcatctgacataagtgagagctcgggtgagttggtaaaatattagtgtaatacatttgttgtttaaatagaagtaatattgtgcaaaagtttcttatgtattgagcaggatggtgacggctctttctggagttggtatgagctggaaacaacaccttatttaaggcaggtgttaaataatttgcacaatgaaagagaagtcagggatgagagcatatattgtgagtgcgagagcacaaatcgatgagctaacggctgcgtgcaatggagatgtggctgattggacaagaaaactaaaggagaaagatgattcagcttgtaaacttaaagctagagctattgaattagaggagggaaggaaatttcagcttgtaaaccctcaaagctgctgccgccgccaacgctcgtgtgggagagaagcactaacaggctcatataatcttgtggattgacgtggcatccgacgtgtcaaaaatcacgataataacagccgggtgagggggggtgttaagtgttcagtattgatagttcgagagtttattatatccggttttgtagtttgagggtgtacttagactacgagttcaagagcgtaaaatggacttttcccaaaccaaaaaaagtacgcctctatcgtgggtcagggtacacaaaagcatcgtacactgaatggcctaatgcacttatatatggatctcacgagtttgagggccattttgatttgaagtcaattatgctaccaaaatatagttgccactttaaataacacttaactagtgtttggtttgtaccaaaacatgccaacatcacatataagttgccaaaaggttcgcaataccaaaacatgactaggtttcggcatgagagcaaaccaaaaccaaccaaagagagcaacataatgtcaacattgctagaaaaccaaaataacagataacctggtgtgttgaaattataatgtgagcaccaaaatatatagtaacagcattatgccagtaactccaattagtatcttaaagggtttcaggcaacacagtaaccactcaagcattcttatttcgtgttggggtattctagctagagaacaaggtgctaacctagcagaaaacattagttgccagcctgagagctggcaacttggcaagtgaacagatgtacaatactagctgattgtcttgacagaactatcacatggttcatagaaatgtcttcaccaacaccagacaggcctgaaaaaattcaatcgcacaccaaattagatatcatatatgccattcgctgttttttctagtgtaaatttgtttacagtaaattttgattggttaactaaattatctttgtactatatataatatgatctgtagcatttaagagaattgaacaacaaaaataggatttctggagcatcctatgtaaggaacgtgtcaggaaataagaattaaatattgagtgaactgcaccggcggtccctaaacttgtgcaggtgtgtcacttaggtccctaaattctcaaaatgtatttttgggtccctcaacttgtctcgggtgtcatataggtccaaacgagctctaacctgtttcgtgggatgatgtagcatgccacggtgacgcttacgtgtcagtgagatacacatgtcagtcacatagaaaaaaaat

SEQ ID NO: 72549 - DNA, 2036 bp, Oryza sativa
gcatgtcctggaggcatgtcatgttttgtcgcatggtttccatgtcggcttcagcctgtgtttcagagtcatggttgacttgtacagcagcaagcgcagtcgaggccgcagccggctacgacggggcggcttggggcaccagtagtttgcttgccaaaaggatctccgccctggtctggagtgcccttgccaccgcgactgcttcgccatgtcagccgtgttcggcacctggccagaggcggcaggagccgaaggtggcagtgatggcacaggcgcggaggcagacggcgctcctccatcttcggcgatgggcaccgaaggctctgctccctcctcggcagccatcttcccccagcttcgctttccttttgccttgtaaccttctccttcacgaccctcttcggtggcattcgctctcagtggtttcgctcggaggtccccacggtcggcgccagctgttgtcaaagcgacaactgcatacatcgaaagacatgattactcaacagtatttggaaaagaagtaaagtgtattaaattgagaatttttcttgggatccccctaatacatggccttatgagactatttatagcctcattacatgttcttactactagggttttggttatacaggggaatttacatggttgcccttatgaaagggacatttacatgggtatatagtgtaactgtagttcatgggcccctaatgggccattaggcgatcgtcggcccaatagcccctaggcttgatgggccaggatggcttctttggtccttgcgggaccgaacttgctatggcgaagtcgtctcccttcggcatatactcttcgccctacacccttcgcccaagaggcctctggcttggcgaggtacccgcgcgattccccgcctctcaccgtccttgttccatagtcttcaccatgggggggcttcgccttgactaaccttgacgtctcaggcttgaatccccattggtcgcatggtttcggcaggtttggtcgaagggcctcatgccataccgccaacaatacccgaaggtgcataatatcctaaaaactggttcttgcttttattggaaagaaaacttaccaagataatctggggtgtctcccggcagtgctttgtttatggtcacaagctcgaccatggagacatctcgctacaagattagtgccacaaatacatacgagatttgcaatatttatgataaataaaagcatccacaaccacacttctaatcattttagaaatgaggaccataaggtggttatggttctcgcacaagtaagtggtactaatcggacaaaactctgaggattctttatgtgagcatgattctggaggaaatttgaaagagaaaccttcatgctcaaaagtgtcgttctcatcctccaaagttgatgtctcaaggttgtccatggcctgcaggttctccttctcaagagatgcatcatgcaagaacaaggttgtttcttgacaaatatcgagaacaacattttgatggccagagggacaaggttcacgctcgataagaggttgtgaaggtggttctttggagtgcaattcaagggtctcaccagaatctttttaaatgaaatgaagatcatcctcttctagaatagacttaggagactcatgaagcagaaccgccattacttcctctatcggcgtattatcagggaggatgcccatcaaggttttctcataatcggtatgaggatcatccctgaatttaggagcgcaacccggagcttgaatttctttggaatccggcgatggctccacggaggactctttagtcagacccgaagatgttgaaggcttgggttcagtcttggcaaaagaaggttcctcccttcctgacacaaatgtttctagatggagttcaacatactacccgacaaatgaggtattttttgatatgcgatcgagaatttccttgccttcagcgggagttttgtgcatgaatgaccctacagcagttatgtcaaggtagagtgcagcctccatatctaaacccgtatgaaaatgttgc

SEQ ID NO: 72550 - DNA, 16946 bp, Oryza sativa
agacaagttgagggacccaaaaatgcattttgagagttcatggacctaggtgacacacccgcacaagtttatgaactgcccgtgcactttgctcttaaatatttatctgggcctttaaaagatcatgaattaaactgcaaaaaaaatcgaatgacttcaacaaacccagtgaaaaatcagttgacaggtagatacataatatgaacaacactgatggagaatgacatttaaaaatagccacacagaagaggaaggcctaacaaacagacaggtttcaagaaaaggactgattgggagaagaattcaaaacatgatgtagtaagacaagcaaccacataattcaaaatttgccactgtaaaaccaaaggcaatattatgaacaaaatttgcctgtctgctctgtttgagaagtgtttcaaacaagattaggaagttctatgtaactactattatgcaacgcaatagcactagaaaatagaaactaaatgttgccatggaacacagaaagtcttggtagagaatacagtcatagatgttcggaagcaaaaccacagagcaagagaatgaagttaaaaaatttcaaacaggagacacaacagggagtagtagatggaggacaaagtgactttgcttactccaacatagaaatggtaaaatttgcaaagtattaagtcagtagggaaccgagagcttgagcccctccatattattaatttattatcagttcaccatgcagtatcaatcagcaccaatcaacagcgagatattgtcttttggtaaggtttacatgcagtccaagcaaataaagcacgctctcaaatttcagcaattgatgacaaactattagagatattatcttttggtaaggtttaaattcagtctaagcaaataaagcatgctctcaaattttcagcaagtgatgacaaactattgacaaacaaaaaatctcagtagtacttaagaaaaatgaaatcctgtgaccaatattcaatattgagctggaacctacagtccagctaggtggaacatgtgtcctagagccagaactaactctatagttgtagtcttgtagatttatgcacacctaaaaaaagaaaagaaaagaagagcgaactgcaaagccaacaaaactcaacaaatttatggaagacagagcttataaccactgctctaaacgcattgctgcataacattgggacgctaactttgtcttgtgctgcagtttgtttttcattttaagaaatgagatatagtagcggaccctcattgattagcttgtgcaagtaagaactgatagcctgagatttgataggtgactagaaacatcaatgacaacccaaacacccaacagtcatattgacttattgtcatgtagccaagtttaaccatgtgacaattattggtaatacaatccacgaaactttggcatgtcaaaggatgaaaagcatgctctgaaattccagcaattcatctggaacaattgtcaaacaaaaagacgtgaaacaacaataagatgaaatcctgctaacaaaggtaaacttggcgactttcttgtattgatcccttggaagcaagacatttttccatttttttaacagctgatacattgataaaaatgatttatctctgcacagtggtgttactttgttctgaattttacctttccttttggcatagtgagaagatctccaaagtaaatgaatgtacactcagaactaatcactgggaaaacattgcgtggattgttatatgctcaaaacgtgccacaggtaacctatcaaattcacaatgtgaagattcatgggtgcaaggttactcaagcaacttaatagcagccatagcaattccacatctcccttatgaaataattatgaaataaaacaggatatatcacaaagcagcagagccatgtacctatctatgtgtccttccgtgcacttcaaaagcagccagggattagctctaagtgaaagctgtctcagtgctgcgcccactggatactcttgaggtcaatgcctgccttggccatctcatacagtggactcatgtcacgaagcttcttcacctgatgcacggtgagctcaattgctctgtcaacctcttcctcagtggtaaagcggccaatgccaaagcgaatggaggtgtgcgccatgtcctcttctacaccaagtgcccgcagcacataagagggctccaagctggcactagtgcaggcactgccactcgacacagccacctccttcaggcccatcagcaagctctccccctcaacatatgcaaatgacaaattcaggttaccagggtaccgatgctccatgcttccattgataacaatatcatcaacctgtccacggatgccatcaagaaggcgctgctgcagaaccgaggctctcctgtgatcatagtccatctctttagccgcaatttcgcaggcagcaccaaatccaacaacaagaggcgttggcactgttccactgcgaattccgcgttcctggccaccgccactcatctgcggctccacacgaatgcggggtcgacgacgcagatagagagcacccacgccctttggcccataaatcttgtgcgcagacaaagacatgagcccaatccccatttggttgacatcaatcgggatcttcccgagcgcctgggcagcatcagtatggaagggcacgcccttctccttgcagattcgaccaatctcctcgagtggctgcacgacgccgatctcgttgttgacggccatgacggagacgaggccggtgtcggggcggatggcgtcggcgagctgcgcgacgtcgacgaggccgtcggggcgcacgggtaggtaggtgacctcgaagccttcctgctggaggtacctgcaggagtcgaggacgcacttgtgctcggtctgcgtggtgacgacgtggcggcggcggtcgcggtagaagcgcatgacgcccttgacggcgatgttgttgcactcggtggcgccggaggtgaagaagatctccctggggtcggcgccgacgagggaggcgacgcgggcgcgggcctcctcgacggcggcgtcggactcccagccgtagaggtgggtgcgggagtgggggttcccgtagcgggagaggtagaaggggagcatggcgtcgagcacccgcgggtcgacgggggtggtcgcctgcatgtccatgtacagcggccgccccgagatgcgcacgcccttgatggtcatcgcctcctcctccgccgccgccgccgccgcggcgggagcatcggccgtcacggcggccgtggagagcgcgcgggcgggggagagggagggggtggacccgcggcggaggaggagcgggaggaggcggcgggagagcgccatgggtggagggggggagaggtagggttcggggattggcggtggcggcggagatcgagctcccgtttcggcggaggggtgatttggggagaaaaaaaaaaggagagatagggaggagatgggttgaggagaggataggcaccgccgtggcggtgaggttggcaactgggccacgcaaggcgacgcgtctgactctgagcccgtcgcggtcgcggtcgaggcgacacaccggttcggcccgttgtttgttgttgggccgtggactactggtgagtcataaggtcatatcatattaacatagccaatccaaaatttatttctcttctttaaattttgcttttttaagaaaaggcaacctgccaatttttattaaatagagaaggagtaaacggagagagctacaaatcggacgtccgacgttgtaataaaaattggacagtcaaatatttcggttgactgttggtgcaacattaagttatacatagtgaaacaaaacaaaaaagtcagcctatgaaacatatagaactttttgtgaaacataataagaacacatggtgaaacatatttctatcacatatgaaatttttattgtctgaaatatatgtttttctttcatcaaaatataatcatgcaatatcttgttgtaaagatttaattataacgaatttaacggtgcgatcaaatcgttcaacgaataagtagtttaaaagaaaaaataatttttaagatcactaaatacttgcatcatgcgtggtgtgtgggagaaagctaatagaatagcatgagagagactaggggcaatagcgtctcatattttttcggtcattggtgaaacattgagttgcacatagtgaaacaaaaaaattagttattgaaacatttaattttttttatgaaacataacaaaaacacacgttgaaacatattgctactgtgtctgaaacattaaatttaacggattgaaacatatatttttctttcatcggaatgcaatgatgtgatatcttgttgtaaagatttaattgtaacaaatataatgatgtgatcatatcataaattggataaatagtttaaaagataaaacattttgaagaccatcatatgaatgtgtggagacatggggtactattagtagtttgttcatccgatcttttttttcgttggacatctgatctcctcaagcatttcgggagtgaactgtacaaagacgaaaacgagctcaagacctttgatccgagctaactaaaagaaagccaattatgaagatttttcacgcccgctaatgcccaatttttggcctgtcacgtccggaaattcactagtaatttccgaacttatttatgcataaaaccctcatctaggaatcagccgaggtacacaaactgacaatttaatatacaaatccatcataataataacgttacatacttacagaagaaaaaaaaacagcagtggaattaacggtctagcgatggcttcagctccactcccacaggcagctcaactggggtataagccaaacgtcttctctttctggatcctttttcttcaactgaggtttgatgattattgcaagatgagcatatgacatactcaacaagccacacagcaaatatgcaagtgcacaaggataccaaaggatggcataatataggctcatttgcaaaagcagcatttagcaaagatttaagagtaaaacagtagagtaattaattagaaattttaattaacactgaacagcacacccgtgctgctcaggcccaaccatcctgaacaaccatacccggctgtacagatctaactccaaaccaggaactaaacaaattattaccagttattgcatcaataattatttgtgagaggtgtgagactaatcacgaaaaacatttctcaacccgcccatgaccgcgggcacggccattcgaatagttttactctggccagagatgtaccactgtacccacaagacacaattccacacatgttgccatgccccgaagtaccaccacggcactacaaagggggaaattgtgacaatacccttcgcacaacacaactcaccacagtgcaccattcctggatcataatcaccccctcaaaaaccagaggcatggactccccagcgaccccacggacttctcgccgcttcttagtctggcaccccgcaatgaatcatgctatacaaaaggtaaagccgttgcccacgctggcttgtggttggcatggtaattgtttcacaacagtagctcgcgaaccggtccttaattatcatgagcatgaccttcaaaaccatgtgctcacaacccgccattgtcaagttttaattgtcaattaattatcataacacaattaaccatcgtgagctaccattaaatataaccataaataataatgtagtatgattcatcccattagtgagctaatgtttctaagcatggctaagcaattatatatatatatatatatatagcatttagctgaaccaaaccaatatataaggttccagctaagcaaattataacccataggaaaataaagtcatcttcggccattaattaattgggaaaggctcaccacccgatgacattcgaaaataatgcataagttgaaataaaacattatctttaaacgggttcaacatgctcaaagggttgtttggaatctgtgtgacttgccttgagcttccacaaacgcttccaaaccttcctcaacgaaaacgttctcctccggaacgtcggaaactaaagcaaatgaacaaaatcaacaaaacagtacaaaaacaagcataaatagtacatgtggatatttttaacatgtagatctcgattttagatgaatttagcaacttgaaccactcgaatccgagttatgatgatttagttatgaatttccgaattttaatcgattttcatctaatagagaaaactaagaaaaagggattaatgacgtcatcgctaacatcatcgccggccatggcacgacttcacgcgaccaccggcaaaagagggctcggttgggctatctaagggcacctacgcgtagaggacgacgacgcgaactcaccggtacaagaaaacacgacggacgacgacggacgacggccggcggcgaggttccaaggcggcacggttcgggttgacggcggcgatggcgctccggtggtcttcggcggctgcgaaggggcggccgaggttcttctcctccgtgcgcacccgacggcggcgacggacggcagcggcgacgatgctagcggcggcgcgacgcgaccggaggatcgccggcgacggcggcggctagagcaaggcggcggcggctctacgggcgacggctctacttgggacttggggcaaacggaagaggacatcaaggggatgctttatataggcttggactagagagatcggactccaaacgagaggatttgaaccggaaaatcctagggttagtttggagagataaactcgaaaacgaatccaatttcgcgtcgaattcaaagggataaagtcggatttttgggggaagagatagaggaggataagaggaatattccccctcaactaattttggtaaatacacgagataaaagaccggatttggaggggaaaacggcggctgcacaggtacaggacggctggctcgggctctgtccaagcttgaagacgacactgtagcagggaggcgtactagactttcggctgggcttctgctaccaagggctaattaagggagggacaccaagcagacttcgggaaagagagggaaaagactgcaggctgagagagagattgggcccagcaagtgagaggacttttcctaattcggcccgaaaaggaaaaaggggactttaattacttttctaattaaattaatcactgaaatgatccttgaattgttaaaaatacttctattgctcaaataatttcaagaaaaatcctgaaaatacttggacactcaaagtatttaaaaatattaaaactagaccatttaatgattaatttaatatgtggataattactgaaatgttgtttgtatgattaaaattaggaattgagctccgaaaaatccaagaaaattccagagagtataattaaccatggataatttaataaaaattaaatccatccatgctttatatttaggaaattttatttcccacatttaacttctcttgtaaattaatgaacatttaatataaattctaataataatttattaactaatttataaatcctaagacgaaaatcaggatgtgacatggcctcttccttgattttggccagaagggaggtggtcaatagctccttttgctgaaaggttttgcggtttctctcattccagatctcccatgcgaccaacagcgtcagtgtgcgaagagccttcttggtacctcttggatgtttgaggtagcctcccaccattttaacaccgtggaggtttgctgccaccgacatggtttcgatccctcacacgccgtccattccgcaattgcctcccaaattttatttgtgtatctacatcacacaaagagttgaagggcagtttcttgagatcgacgacataagggacatatggaaccgtttggccatcctctagttgctagtctatcggaggtctatactctgttttggatgattagccatgcgaaggttttgaattttttcggcgcccaggtcttccaaattaggttattaaagttggtggcagtggtgctgaggagttgcgtattgtaggctaatgttgctgtgtattcgccatggctggtaagcttccatgttattttgtcgacctcttgctcttctagttgtagcgtctaagtgacggtccagattgtgacaagttgatcagttaagtctatcgtccatcctgcatttgacggcaggtccaaatcatgaagccattggtcagattgcaaggcctgttggatcgtcctgttctttttcttggatgctgcatagactagaggagctacatttttcattctccttccgtcccaccaggccgaattccagaagcttgtcttcgcaccgtttccaattgctatggaggtggcagccaaaaaaggagtttgtcggtgtcttctttaaaatttgatgaataaccaaacgaaaatgcaacgaactgacaacttaggctgtctggctgtggctgtgttcgtttattcccaatcacaacttttactctcttcgaactactgtacttaaaacgggatgttcgtagaagtgcataggcggtacttaaaattgtagaggtgtgttatctgggtccctaaactctcaaaatacagatacaagttatataacttgtaaaagtgtgtcatcaagatcctaagtcaccacaacccctctaaaatcctacgtggcgctaatgtggcatgccatacggatgtgacctggcattatcttaactgacaaatatgatccacttaaaaattttatttttccttttttcttcttctccttctcttttttttttcttttcttctcctttctttgtgacctgagcaccccgtgtggcggtggcctgtagctgcagtgagaggaaagagaagaaagcaaaaaaaaagagaagagggagaagaaaaagaaaaagggaaggaaagaagaaaaaaaggaaaaggaaattttttaagtggatcctattcgtcagtcaagattataccacgccatgtccgtgtggcatgtcactttagcgctatgtaggatcctagaggggctgtagcgatttaatacctagatgacatattttgataagttataggaccttaattaacattttgagagtttagtgacatatgtgacgctacctatactctttacaaaaatattcaactttgaaatttatattaatgaactattccattttacatgcgcggaagggaaatttcccaaacttctctcccgaacacacccttatatgttctccctccataccaaaatactccctctgtcaacgtatatgaagtattttcttggttatttgatatagattaccattgaaggaaaaaactttaatatatgtcattaaataaaagatggttggaggtaagatagggagggaaatttaaatagaatgttatatttatgtgcaaattttaaaccccccaaatactccaaatatttatatttatatttatattatatagaactactattaggagcattccaagcaccaaacatgcatcggcccaggtccaccccaccccacgtcccgtcatcccactcctaccgttgttggagtaaacgatttactcctatcgcgcacctcaaccacccacctttattcgagtaaatgatttacttcgataataaaaacaactcccccgcttccgatcccaccccacgtcctgcatcgtgcacccaccattatcggagtaaatggtttacttcgatgaaaacaacttctctgctggcggtatatattctatttttcccgtacccaaccaaccactctcgcccccactccgttttttcctttttttcggatctgaatcgattcatcatcccagtccacagatcggtgacacaccatggaggaggacgactacaccgtggcggttgatggtggtgtccggtgagcgatggccagcggcggttgaggcgaaggcactacttcgggcctcgctgccggacgcaagacaacaccttaaccagcaaggaggtgttcacctgggccaatagcaacaatcagcggttgctccacgtcggcgacattgatagaacaagcaagtaaggaaatgacactttgatttgcatctgcatactctccttcaacttcacacatgaagccctaatttttttttgcaaatcaaattaacatgtaatctccaatattacctgatctcaattgatgggctgcacaggttctacatttgcacatcgtgctccatgtggctggccgtagaggatagggaccggtgatggagattgtttgctagttttcttttgctcgtcatctgtattgacatgaacgagaatgtttttgcattttttttgtgcttgctagatgatggatggctgcgattgcgcaacatcgagctcatctcttaccacaccgctacatccttccatgtttccataatggatttttggctgaatcattttttttctagtttgattcacctgtgagtaattttatcgcttgtgtgtgattgagcccgtaactttttcattcatacgactattttgtgatacagatcaacaatcactggtggagaaaccgtttgtagtcccggttcataaccccctttagttccagttgtccaaccgggactacgaatccaggactaaagatagcgatctttagtcccgggtgaaataaccggcactaaagattgatctttagtcccggttggtaacacgaaccgggactaaagatcggtgtactattttttttatttgcatggccttgtttgctgcatggttgattatatatatatatatatatatatatatatatatatatatatatatatatatatatatatatatatatatatatatatatatatatatatatatatatatattaatatatatatgtatgtatgtatgtatattacaatacatatatattacaatacatatatatgcattgtaatatatatattatgcgcatatatagaatacatatacatacatacatacatacatacatacatacatatatacatacatacatacatacatacatacatacatacatacatatatatatatatatatatatatatatacatatatatatatatatatatatatatatatatatatgtatgtatgtgcatatgtgtatatgtataaatacatatattacacacatatttataatttaaaccacttaacattttatgtgcatatatgttaccaaaatatatattaacactaaagaaaatgtacatacatatataaatatatatatatacatgcatgtatagtataattcatttgctcgctagctatagctacgacttcgacgccggcgttatgtcagaagaggaaggaccgatgttatgaattgtcgatccgtcgtagtagaattcaccatcgggattaaggacttcttcgttgatgaaccccatctgttgttcttgaacagccgtgataaaatccttgtgtgggagattttccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggcatactcgcatacgtagtagccgcataagttagttccctggtcctgctttgcacactacatgagaaatcatgagagatttaatatactctttatattaactgtaattagagattcaattcaatataattttggatcatgcatgtactcactggaaaatgaaacctccgtccaagtttttctttccaagtcccgcggaccaattgacggaaccgatcccaagccctacatgtgcagttgcaagctatgattaattaattattacccgagatcaacataatagcaacagagtcccgcgactttggaatagatggcattatattacctgtctatcagttagaagaccttgtcaaaaaccttctcctctttattcattgagtcatacatagtgactctgcatgcgtccaagtcgaaaaataacaggacccagtggataggggtgggcagaagaagaccgaaccgaagaaccgaaccgaaaagaccgagaccgagaccgaaaagaccaagaccgagaaattcggttagtaattcggtctcagcatgttaaagaccgaaatttattcgggtaatttggtcattggtctcagttaaccgaactaaccgaaaaaaccgaattttagcccaataggctaggaggcccaataggcccactaaaccaaaccctaggatggacacccaactcccactcagccactcctcacagccgcaccgcactccctcagcacgcacagcgccgcactcccatcgtgctctccaccttcctgcctccacaaccaccgcgccggcgccgcctccagcaccgcgccggccgcctcggcccgacctccgcccgcccaccgtctgtgccgccgcccttcgccgcctccgcccaccctcagcttccaccgccgctttccgttaccaccgcggtcggaacgcgccgccggcaagcagccacgttgtccctccctcttcttcggtcgccaccgccgccgccgctcaagctacggctgctgcggggtctcctgctgctgtggggcgtggctgctgctgcggcagccggtcatcgccgtcgaggccggcgggttcctccggggccttctgctgctcgtctacccgctgctgtgcctctcctcgtcggctacggcgacgacgacgacgacgacatgctggggaggcccatggcgacggtggcgctcgtggggctgaagaaaaggaaggtgacgaggggtggcctgggctgaaataatttggtcagactgagaccgagaccgaaaccgaaaagaccgagaccgaatttgccggtcctgagttttttggaatgaaattcggtcctgagttttcaaagactgaaatgaccgaaagaccgaagaccgagaccgaatttttcggtctgaccgaacgcccacccctaccagtggaatttggaatatgcgtgagatgagataaatatcagaatgtacatgttatatggatgggaatgaaatttgttcgaacgacaataaaaactcactctgtgttgtacgatagtagtatgaacgtcttgaaatgctgctgcgttaggagatagacgagattgtcctctgtgtctttctcgtacttgtcgatcatttcagtgttgattttccgagggtcgatgaacctagtatcgtaaactccccgccgtcgggccctttgaatctccattctacaacgatgaaaggaaattattattgctttcatatatgccaggagctaattattgaacgaaacaaatcgaactcaaagatacttacaaaatctatgcgctcagaagagagacgtcgagggcgtccagatggtacagatcgaagacatccttgaaatggatccatagaacatcttctccttgcagaaagtcggggtttctaatcctcgctccgaacatctctctacccttggcgctcatttccatgtaccgttcatggaatttgtacatttgtgtcagtggggactgcagctgctcaggcctgacaagcggtttaccgagttcaaacttatatgccacttccgccttcgggattggtgcgcttccaaccaactgatccacagttagactggtgtccgaaatgaaatccgttatgccaaagtcttcgccagtcaccaacggctcgacctcttggtttggctgttctccaagctgaggaactggtttggacttcttgtaataggctttcctaagtgttcggtcatagtccgatagctttaagacctccttgtttgtggtggacattcccttgaagaacttcttcacgctcgggtcaataggtatcttctttttaggactccaaggcttgagttgcctcttcacttctcctgccacataagcatcaagctcctcttgactgcaatcgtacggcggctccttgtttttggtggcgtcaactttcgccttcttcgttgcccttgtgcgggcaagaggtggagcttggcgagaccttgtcttgggaggtgcaggcggacacggtggaggtggaggtggaggaggcggaggagtcggaggagccggaggagatggtgtaggaggacatggcggaggaaccggaggagatggtgcaggaggagacggtggagccgaggagatggtgcacgagacgccgcttgtcgcccagggaggatgatgtaccgcttgcgccatagtataatggcgtggcttgtgtctcgtagatacgtctcaccgtctcctcctgggtagtccaactcagggtcctcgtatgcggcttccaccagctcaacttcgaccctcgagtatcctgctggaatcggcctgcagtggtaagtccctgaaatgtccattgggatggccattccagacgccaccttcacgtgatgagaggttatctattagtaatcaacctaagcagcaacttgcggaatgtacaagtcaaaaatcacaaaactacgagcataccttgattaataagttcttgaagggaatatgcagctcacatggtgtccgctgcgtgatcccatcaacggggcaggtggtttcgtcctgggtttgcatggcgtccatgctctgtgatcctacctgccccgttgaggcgcagctactacgattgcctgatgggctgaccattggaggaggtatgtacggctagggatcctaggaccgatatgctgccatgcgttcatccaccttccttgccacctcctcttgcatgttgagctcgtagctcgataccctgtactcaagatctgcaatcttcgcctcggtatctctcttgctcctcatccgactcctgtacgtgtggatgtcctccttgaatccaatcttccagggaatcacgcctttccctcgtgttcgtcctggatgctcgggagtctgtagggcaagtgacagctcgtccttctctctgtcgggtcggaacgtgccctgagaagaggcttccactgcatccgttagtcgactggcagcctcgcgtatctgattgctgaagacaagggagccatcaactgggttaagcgttccaccgtgagcatagtaccagaacttcgatcgatccggccatttagcggtggccggttcgatacccctctcaatcaatcttgcctccatctcctcccacttcagcattgcgacgctatagccgcctgaccccaagtggtgatggtacttcttcttggcggcgttttccttgtttttgaccatcatcgcttgcccttgttggcctgccttgtaagcaacgaactcgtcccaatgatcccttagctttgggaatacgttgaagttcggtgttagtcccttcaagatgtatttcttgtagagatctccttgaagctctggaactgttctgccattttctttagagtccactgtttcactatgttctccgtacccgcagggagcgtgacttctcgagcattgtggtccacagcatctctttctctgattccgggacaaagctgtcattatccccgcgtgcccttgttctgcgccagtacaccctgctgacaggcacgttatcccttacaacccaaccgctgtggcgtacataattcttggctgcttccgccggggcactaggtcggccgtcttcgtccacctcagtaatgatgtgccgaccctctatctttttcgcgacacctcgttgtccgcgtgccctcttctgtccagcggagggatgacttccactagcctcctcctcattcccctccacatgcctctccacgttcccctcctcgttcccctccgcatccctctccacgttcccctcctcgttcaagtattggtttggatcctcgttcccctcttcttcgttccagtactggctgcttccctctgcgattgtatcgtacaatatctgttcctcatcgcgatcagccatctgttcatagaagaaatatttgctaagttcataggtcatatttgctaaccgtaatattaaaactcaaataatcatatatgctaagtctaagtgtcgtatattagaaccctagataatcatatatgctaagtctaattaagtttcgtatattaaacctctaataatcttatattaaatctctaacaatctctaacactcacatatgctaagtctaattaaatttcgtatattaaacctctaataatcttatattaaatctctaacaatctctaacactcacatatgctaagtctaattaattaagtttcatatattaaaccatattaaacctctaataatcttatactatatctctaacaatctctaacactcaaatatgctaagtctaataatctaataatctctaacactcacatatgctaactctaataatcttatattagaaatctaataatcttatattaaatctctaacaatcacatctttacatcacttgcctgcgcgaattctttcgagggctagctaccacttcggcttgagggacgacgacgacgacgtcttctctacaacatgcaaaaaaatgtattagtctaaacgcaaaggaacatatattgtatttcacgttttcaagtatatataatcatatatatatatatatattctaagttcaagaatcttttaattatctcgttcatacacgtttcgctcgtgttcgttctcacacttttaattcaagtgcattcacggtcgtcggcgtttcgttcacgttcgttcgcgtttcatttacgttcgttcgcgttcgttcacgtttcaatcacgttcgttcgcgttcgttctcgttcgttcgcgttcgttcacgttcgttcacgttcgttcgcgttcgttcgcattcgttcacgttcgttcacgtttcaatcacgttcgttcgcgttcgttcccgttcgttcacgttttgttcatgttcgttcgcgttcgttcacgtttcgct

SEQ ID NO: 72551 - DNA, 36466 bp, Oryza sativa
tcatgaatgaatgatccatgttctatcctattcacttgtctttctgagctaagaatcctttggagttgttactagctagacaaaaaaatgtaccggcagtgagatctctgctaaaaaatgtaccggcagtgagttgttggttagtatgttttgttatccgcttctctataggatggaaaactggaaatggaaaacttccttttcttttctttttttactacagatgattggtgcatattcgtgcaaattgtagattaaaatatactccctccatcctaaaatgtttgacgccgttgacttttttttaaatgtttgaccgttcgtcttattcaaaaaatttaagtaattattaattcttttcctatcatttgatttattgttaaatatacttttatgtatacatatagttttacacatttcacaaaagtttttgaataagacgaacggtcaaatatgtttaaaaaagttaacggtgtcaaacatttaggaaaggagggaggatatacaagtctgttgctattttcctttcaaagaggtacttttgggactgtttgagctacctgctccttagaaaactatcttaggataagttcgtggtgacgtcgatcaattatccatgtactgaaaaggctggattcgttatgcaccaaacttttcagagtacaactgtacaagctatagcatgcttatgccgtagtgtactattgtccataattttgtcttggtgtagtatgattcatgcagggaagagtagaggctgttacagtattgaccaagtgtgtacttcacccactagatagttgtacttaatttggtttctgtacgaccctatacgagctaatctgtgacgactacactctacagcacttggtctgtaagttgggtctggttgttcccaattttttctttaaacttttaactttttcatcacatcaaaacttctaattttttcgtcacatcgttccaatttcaatcaaacttttaattttaacgtgaactatacacagccttggcagcatttcaagtcaaaagttcgaaccagctgatagatgatgaatgaaactgagttcatgtcacattatttaagggcacccaagaataaattaagggcccctttgaatcgtagggtagaaaaaacagaggaataggaaaaacattggattctgacaggaattgaagtgtaaaaaacagaggattgcaaaacacaggaaaaacataggaatggtcgtttgattggagcgtaggaaaaacgtaggaatcggatgagagagatagactcaaaggaaattttccaataggttggagctcttgctaaatttcctccaaaatccacatgcaatgtgccattccataggaatttcatagaatttggaaagcttcgatcctttgaatcaaagggccaaataggaaaatttcctataggatttgaatcttatgaaatttctatataaatcctttgattcaaaggggccctaaatattagaaatttgagaagtttatttattgaagttctctatgtaataccgttgaaaggttttacaaacatcacaccgtttagaaattttggaaacctgttgggggataatccacgatgttgttctgaactaaaattgagtttggaattttttttcttcatgtgcaaacaaacaacaacgaattggcgttaagattgtgacatcgagattgaaaatatatgtcctcatcttttagatagctgaaaatgatgaattatttttatggtagctatttgagggtataactgaatgaatcaatcactataaagttaaaatatttgctttagaaatctattacaagaaaattttatataacctttaacactaaacgcaagcgcgcaaagaaaatctagaatgagaaaaggaccaaacagggcctagcacatgtatctccaattgcagcagaagttaaattctctcttgcaccaagaatacgccattaggccattcccaacccaataactagaatggtgtccatagtattaaataagctgccacataggatgaaaagtgatgtggcaagtgaataaacgaaaaaagagaaggaaatcatgtcttgcatgagacatggtttctacacaacatctaagacatcatgtgagataagtagtattaaatttatgtatagaatagtagtatttgtattggaagagtggtgcctactactagttttttgatgatgtggagtttatagaaactatgtcagtgttttgggttgggaatagccttatgctacttctaaacaccttccaattcacaacgttttgactccgttttttttttcataaatctggcatctcagaccccacttcatcaaactgtcctgcataatgtagctgccaatctctgaactgcagaaggtccaaccaactggcagaatcaaattttgctgctctctttgtaaaataaaaaaataaaaaaaaatccaagaaatacttgactggttagctggtcttgttaattaatattaatgggatcttggattcccagctgactttgcaaagcaaacgcattcgagtaagtatcacgctggctgtacacggttgctcatgtaactagtataatatcctgaactaaccccctaattcatcattatctttgtgctactatgatttcgcccatcatgaaccataacattatttctgattttttttttgtacaatactacaatgtgaattataatacatttgatactagctacctggatgggtgtttagtgtcatgcatgcaagttcataataattaattaaaaaaatcaacactgaagaaaaacacccataccattggtaggtacgtagacatttccccccttaattatcacttttttttctagcgaaatgtacaagaaagtctacatcttgacaatctgactatatgtatattttatatatatatatatatatatatatatatatatatatatatatatatatatatatatatatatataaccaagaagcttaatcttaatttaatttcaaaaagaaaaagaagagaaaatggtcccaatggtcgagtagtagtaattaattaattaatcagagaaggagaaaaaaaaatcaggcgatgatgcagccgtagccatcggcctccacctcgtagaggacgacgccgccgccgggggcggcggcgcactggcaggcggggcggcaggagttgcagccggggcagcacggcggcggcggcggtgggcagggcggcggcgggtcgggcttcttgggagggtcgtcgggctttttgggcgcctcgggcttcttttccggctcgacgctgacgacctccgccgcgaacttggccttgcggagctcgcccaccacctgcaccacgtccacctcccccaccaccgtcatcgtccccttctcatcgtccgccgccagcgacttcacccctgcaaaattaatcaattcaattcaattcaattcagctccatcgatgatgattcaagctgcagttgcacctgattcatccaacaaattagtacctgggatcttggccaccacggtcatggcgacggccttgcacttggcccggacgaagtccaccttgatcacgatcttctgcaagatttcagttaggattaagtctctaatataatcgcaatgcatatagccatatacgacgaactggaagtggaagagaggaagagcaagctgaccttggacgacatggcgggcgatcgatcgagctagcgcgaggaggaggaggaagacgaagtggagcaggtgaggtgagagggtgaggagctttgatgctaagaaagggaggttgcgtgtatctcgccataattgaatcagtatggatcgacatcgatctgcgtcattatacgagctttgcaaattaaactaattgtcgtaactattccaattcgattgattagtgtgttaaattgctgaaatggtcaacagctttaacgaattctttgttttttcttttctctctctgagcacaatgctttgcattagagaacgcatttcacatttgttcttctcggaggtaagccggcggtgtcagatcacccgtacttttgtaaatatatttctttttggtgagttgttctgggtgattgatctgatatatatatgagattaaataatcagaagggattataaaaaaattacagctagtgttttgttctctcaaggcagagattgtgtgttgaataaatattttattgccgatcacaatcttataaagaatcagtgcactttattttgagcgataacgatttgtctcaatcagccgcctcttgcctttttctaatcttctcctgcaatctgtccctagtaatgcacaggataatatataacctttaactgattactcgttaagtttcataatattatctcctttttttttcaagaatccagatgcggcgcgctcttgttaattgcttcgagaacgtggatgcatgtactttctctgaactcatcagaggtcaagcacgaagacttttgattacgtagatcgaggtgaagcctgattaaacattgatcagtacgtatgacagtattcagtcagcagtcactctctcagaggatgagtataatactacagattagaatgttagagagatgtttcaaaacattttctctacactaatctaaggactaataatccatccacgggaacatcgtgtgcgtgacatgagggattggtatctccaagccaaaatttgcattaatttttggtgctacggaaaatcatgaagaaatcgagcccacaagaagtttgttaaggaggcctaataaggtactcccccgtcccattttaagtgtgttcaatgtttgttcgtccgtcttatttaaaataattttctgattagtatttttattgttgttagatgataaaaataaatagtactttatatgtgacttatttttttatatttttttttcaaataatacaaatggtcaaacgttggacacagaaaaaacacatgggacagaaggagtaataaatagcacataatgagtcagtagcagattgatatctatgtagcgaatcgcagacaacgagcattatagcggacgctaggttccaatagcaacatttaataaccacgcataaatttgagtatatgccatgaataatgatcttataaaacattaacaaagcaactgagaaacaaattagaagcaatactcatataactgagtataaatatagatttagtagcaatcgaagagttgatgtcttatttcaactcaaattaaattaagaagtgaacatatatgatgttctactcattatatgttccgactcacaagaatacaaggttttaagagacaaaacaactaataaactcgtcatttgttatgggttagtagttatataaaatggccttatgctatagcagcccgcgaaacaaaaatagttgtcatttgtacttttttttttaaaaaaagcgatcacttagttccaacatgctatgtcatatcgggactacctatacatttgtcgacaaattttctcctaaaaatttgacagatgtaattatagtacaatcgtagtataattatactgtaacttgcatgtaactgtagtgtaacttgtatgtaagtttcacgtaatttggaatcattagatctattacaagatttgttctggtgaggaagaaaaaaaattacagcacacacatatgtgaaaggatttgtttccacgacctccattttaccgaaataacatgttacagagagatttttgaaagttacattatagttacagtgcaattacatgcaagttatagtgtaattacactacgattgtactgtaattacatctgttaaatttttaggagaaaatttgttgacaaatatatagtaaaattgtgtcatatccgctatcgccatgacgccggttatgaacactatttatttattagttgggcttaaattaaacgaacggatagacaattacgggctgaatttacccacatttttgggctggatttacgctccactttaggccggagttgcgagcagttctggaccgaaataacgctcgtggttgggccgaaattatgcgcactattgagccgaatccgctcgaagaaatgggctgaacgaacacgcacttgtcgtcttgtcgcctcaaaatttcctctctcctcgccaccgtcttttctgtttacgagctcctctccaaatccccaaaaccctaatccagccagccgccgccgccgccgccgccatgggaggaggaggaggaggagggcgcaagccacgcaacttcgccacgttccggctgttcccgcgcgccggcgccgccgaccccaacgaccgcgtcttcgtccgcgtcgacagcaacgactacaccgtccccggcttcggcgacgacgacgccttcgactcctcatccctctccctcaccggtgacgccgccgccggcgatcacttttcttccgcctccggccccctccccgaccacgtccgccgcgagatcctcgagctcggcctcccggacgacggctacaattacctccaccacctccgcgagctccgcccctccgccgccgccgccgcctcatccttcgcgcccaaccagactgccccgcctctccccctcgacgtgaaggtctgcgacttcccttcccgaaaccccaattttcgtttctcctgctattcggttgtctgatgcttaggatgatatgctgttgttttgggcgtgcaggcgtatgatgccagtagggtgcggattgcttctggcaatgttgaggatgagatggacgaggggaggacgatgtgtaaggtggccgcgaagacagcgcctgtgaggcggattgagagggcggttgatcctgacatcgcgaggttgctcgacgagaccgatgtctcccatggcgggtcggaggatgagggactggaggaggattttgtcatcatggcaaaccgggctgagggggatgaggaggaagatgatgatgatgaagaggagaaagtgatggatggtgtgttcttaagtgatgttgaagagaaagaggagtttgaggatgatgagggtgagcccaagccgagggtccggcggttgctggatgaacagtttgatttggtatgcttcgtttgcattttgtgtttccttcagtatgatttcacatacaccatttttataggggcagtataactttccttccttttattctataggggcatattacgggactacccttatagctgcataagtttctaagtatttatgtgcttgtcaaatatatatttttagagtaaatttcataaaactacagatactatgaccaaattatcacaaaactacagatttaactcagtgtatcacaaaactacacatttaacaccaaatttatcacaaaactacacatttaagatgaagtgtcacaaaactacatgtttagtaactaaattatcataaaactataggtttagaaccaatttaatcacaaagtaataatgtttatagctccacataacaatggtgctagggatttaaactccaaaagttgtagttttgtgataagttcaatattaaatatgcatttttgtgatacttaacctaaaatctgcagttttgtgataaatttggtgctaaatgtgtagttttgtgatacaactccttaaatctgtagttttgtgataatttggtcaaaatacctgtagttttgtgaaatttactcatatttttatcattgtgtagatggtagatctgaagcttctagattgaagattacgcataatggatgactgtgttcatatataatgctggtcatcaaactaattgagcataccataccggatgctgtatcttgttcaactccctctagttggaagcgtatgttgttttagacatgcatccagttgactttcgaaacttcgaatatcaatacactatatagtatatttgtctcaagaactttcttgaatattatactttttacacggtctgatatacataatgcactaaaagttagtggtcaaactactgttctagatagtgtcccattgtccaaaattacatgtattttatgaattgagggaatcatcaccagacgcctaatcagtcatgtctttctacgattagaagttcatcgtgcaaatttggactcgtttgttttgcgaatcgcaaatggtatgcccaattctgacttgttgtgaatcaacttgcagcttgctttggaagaatatggtgacagtgatgatgatgatgatgatccaggtgttagaaatggggaatgtgaactgcctactgaggttattgatgaactgaaactgttccatagtcaaaatgtatctgtcacagaagaatatagaacgccggcagattttgttcgtagaaaattggattcaagcacagcagaggaggtggatgaatctgctaatgtaatccaaaaatgtgctgaatatgctgaaaggtatttaaatgaaactgctgaagaggaagaagttgtacttgtttcagaaagcagtgatgagtctgaagtttgggactgtgagactattgtttccacatactcaaatcttgacaaccatcctggaaagattcaaacaccaggaaatcctaaaaataggctccctaaagtttttcctggagaaacagctacaacgaaagatatcatcaggcttcaaggcaaagagagacttccagtagaatacctaccacagaggaaaagaaatggtgagaaggagaagaaagcaaagccaacagaaactccaagtgctgaaagttttaagaaaggagctcaaaaggaaacaaaggaggaaaagaaagcaagaaaggtaaaagagtggttttaggatattcttgcaatcatgtactgttattccttaaaacagtagagaataccgggaaagcattttaattgtgtttatttgattcatttggaggcttcaacggttgaccaaatgtatgctgcattatacctgcgacctatgtagtcatttcatcatttgtagtataaaaatcttgaagtactaatctttaagttgtctgtaggttcaagtttagtttaaacttttttcaagataaactagcgttaatttatggtacaacagttgcctagctattagcgtatttcttggtggttatgttgaattgataagtgttcttcaagattacaatgtgttcctagctggagcagtgttgtaaaatgatttgtaaatcggcttaatatggtgaaccacttttttttgttttaataatttttaaattgtttattggtatgtgtaacatccttgtcatctgggctgtttcttggtatacatgtaggctgcagtgaaagaagagaagagagaagcacggaaagcaaagaaagagctgaaaggcctgtacaaatttgaaacacagaaggctcagaaggttgctgctgttacagggccagcttctatacggctaatgtaagtcaccctgttgccacgttacaccatctgaaatgaatatgcccaaaggttttgacttattgctgctggaagaaatgaaaaagaactccgccactgtttgctccttagataaagaattcagcggtagtgttatgtcaagtgaaatgtagatatacccatcctgggtagtactatctactgcagaatatgatccaattgcaagtttgcaacaactttgatttgggcatcgaaacagctagaaagaaattcagaactcagaacagaagatatttgtgtagacagctcacgaagtgttgtcaccttttaatcttgagtgaattcttcccttcccatttacttgaattttattttgtcctgtttttgctgccaacatcaaaaacaattaagggaagagaattaagaactatatagttggcagtttctttgttgtttgatgttgtaaaaccaatttggtttcatgattgcacctagctctgctctgctttgcgctacacgttccttcttaggtttgatgtaaacactttttagtggatttatacaaatactctctactctctatactgatttgactcttttttacttgatcaggtaataaccatgttgatttgtaaacatgttctgcacgataacgacgcaatgtgagtcgtaaggagatcctcatcctacaaggtacgacggcaagatatgatacactgatacctcctgggtcatcttgtgccatgtttgtggtttttgtcgactagatacccagtgtataccatgtttggacttctgtatgagaaatatgtcgtgtaagacgtaggttatctaatggacacagtggcgctattttgaatgtgattttacactgaagttacccaagattttcaatctgcatatacgcactgcaaatttcctctagaaaagttgtgctctaagcacaggctgcaagaagggttttgaagactggttttgccggaaaagaactagtacaaacaaaagttgctaggcagacaattttggcaatgttttcatagatctaggctagtctacataatagatccgaaatggatcaaagtgttgataaagtatctttcataggacacttcacaaaataagatatacatacaactgtaaaaattgatacaactttgatagaatggcgtactgggaatacacgtgagtacgttgttttaatactccctcctattttaaaatagaaaaaaaaagtcaaaataactccctataattagtttgaaagtccatctagcattctgaagtttaaaaccgaacattcaattccctaaactttacactaacattcatttaacaacctaacaagcttaggtgtgtttggcaaatgggatttgagagatgaatggctagggtatgtttattaaatgggatttgagaggtgggattgggaaagtgaaatggatgaatggctaggattaaatgaggtgtgaagaatggatgactatgatgcaatattgtcttttggagggtgagatgttatttctcaatcacatttgtcaaacaaagccttagttggagggggtaatatgaagtgaactgtattataaagttggatgggttggatgtcctaatttaacaatggacttttcatataaagtttagaggggttttcagacatttctttttaaaatatagggtgtttttttattaagtttaactgattccccgatggatttggatacaccatcgtgctcttcaactcgttctgccgtgccgccgtcggtaacgtccaaggtctcctcgcctggggactggggagtacatcgaccctggtccttggctcctgagacagcgtgtggtctgtctctgtgtcgagcgcggttacgaagcctccgctacatgctctggaacccgtgctccactgcctgcgccactgtctctccccccgggccagccgcgacggcggccatgcgcttccaccccctgcaccgcttccggcaaagtccgcaggtccccttcccctagaatccggcatgtttctcccgactgcctactacctccagagaatccgacatggttaggaaggcgaataggtaggtgcgccaataacatccatctctctaagatgcagggaacccgctccgtcgtcctgcactggctggttgcagctgcaggtgctcgtgttcgagctcatgcctggcgcacgagatcaagttccatcgcatttgttgccaattagcattcgggattgctaaaaaaaactttcgacagatttttgggtagaaatatactctgagattcgtgctctgtgtgtgtgtggtgggggggggggggggaatgatttcatctgagattcaactacagattgctaagtcttgaacccgcgacctccccctcgcgcgcgcagcctttgagctttgccaagtttactgtacttgcaccctactccctccatatctgtaaaggaagtcgtttaagaaaatgtttaagtcaaaccttagaaatataaatcatgaataactcttgagttgttgagtttgaaaatgttaaaattatatgaatagatatgtcttgaaaaatactttcataaaaatatacatatatcacttttcaataaatatttttatagaaacaagaagccaaagttgtattttagagaccgtatcgctgtccaaaacgacttcctttacgagtacagagggagtacttacattctatttacattatagttatatattaattatattacggtgcaactgcatttgacatatttttggggactttttctgttgaatgttagatagacattcccttagtatttatacatatttatttcacgatataccaagttaatgtggactattcattgggcattgatcaatttactaaaagctgtaacaccccaattttcgtgtggcattaaaaactaatttaataaaattatatatacgaaaattttgttctttgagtgttgagcttaagttgtaccctagatctcaagttaaatccctcctttgttatgtcttcatgatgccaaaaatcaacccctccaaattttcgttccaaagtaatatcttccattcagatttctctactaaaaccctatccacaaatttcgtcgaatattcaaattcaagttcggttcaacaattcacctccaaaccctaaactctctcctgggtctcctgaaatccatactcgaatttgaattcaaactctcaagtttcatccatctctctctctccctcgctctatctatctctataaccctttgaatcctttcccgaatatttgttccaactccaaggaaaattccaaattcaattcctttatttgaaccccaatttctaagattatttcctttctccttaaatccctcccaaataattctccaagccccaaatataaaactatttcaaaaatatcaacctcccacttcgatgtcccatgcttgactcctacatattttcctgagtccaaatatctaatttgaattcaaatactcaaaatttgaatagtcccttaatacaaaacaaacattatattaaaatatatttaatgctaaatttaataaaattaatttcgtgttgtagatgttattaattttttctataaacttggttaaacctaaagaactttgactaaaaaaatcaaatgacttataatatgaaaacaggggagttttttcaacgggggagcatgaaaaaacttgcttgctcaccccacttgcatccatggagaagcggtgcttttgcagttatcccacccttccaatacttgcccacaacaaaaactcacgattgtacgcatccaattcgagggtggtttcccgattgaagatgggactagggctgtcaacgagccgagctcgagcgagctcgcctgcctaggctcgagctcgatacaagcttgagcctatcgagctcgagctgagcctataaaatgttcgaattttcaaacaggcgcggttcaagcttgactaccaagctcgagctcgactaccgagctcgaattttaattagaacaatttatatttcaaaggatattttttaaaaaataataatttatggtttatcatattagtagaagaggaaaaagaataaaataaatatatgctgccaatacaaggcatacaaataacatatttgatcttccaatttattaaatagcaacaaaaaaatcataaattactagtctcgttagaagcttgagctcggctcgacaaagctcgcgagctttggaacaggctcaggctcggctcgtttggagctcgagctgagctcgaatcgagcctaggatgagtcgagctcgaatagctcgcgaacctcgagcttttttgacagccctagataggactatagtatgcaacgcacggtgcaagtgcgcgtgaaagaacggtgtttctttcctctccctctcttctattttagcaagtcttctgtgtagttggagatgataacatatttttataatgggaaactatctaatctctcgaaagtatatcccttcgttgttcatatgtcactcaaatggtagtgaaaaaaaatatgagaagatatattaacacatgatatatcacgctataaatatgcaagttaaaatttaacttctatatatcataacggaaaacaaataaattaaactaagctagttagatattgactgttaaatttgtttttttttggttatacgacatgtagaagggatccagaattttattaggacctggcccattccttgaaaaaggaggcctacaaagaaaggaataagttcatctgaggtcctttaacttattaacgaatccgattttcgtccttcaaccccaaaaccagaaacaacgggtccctcaactatcaaaaccaatatagatggcggttttggttcacgtggcgcctacgtggctggtttgacttgatcttcatttgacgtggctctaacatggcgcttacgtggcaattcgatccagaaaaataataaaaccgatgggatccacatgttagttttagacataaaaataatagaaaaggtgggacccacgtgggccccacatgtcatcctcactctcccctcccctcttctctctgtctatctttttcttttctttttcattccttttcttctttttctttagaagctggtatctggcggccgacacgagagggcgaccgacaacgcgagcgccgcgtcggcggagagggcggccgaggcaggagaggagcggtgacgcgcatgggccggcgggagaggaaggggacgcgggaggtggccctagctgcggcggccggtgggagaggagatggtgtcgacggtgaggaggatgctcgtcacggtcggcgagcgcggcgcacacgcggcgggccgaggaaggtagcggggacgacgatgagaggaggtggagcacgaatctggacagcggactgtggcggcggagcgactgaggtcgagcagcgtgacctggccgcgtccccctcaccagccaacgcgggagatctggtggtggtggtggccggtggtggtttctgaaccaccaggcgcgtcgcaatcccagagcttgggccccgacagggtctaggtcatcgcacggaggagcatcggcgcgggcagtcgtcgtcgccgaagttggcacggaagagggttatccttgttgtcgccggacgggcagcggccggaggcccggactagagcgtctgagcatgccgactaccaccacaaccgtctcttgctgctatggatcgccgcggccacctcctcgccggccatcccgctcgaacgccgtcttcttgctgccccaaaggctgctgcaacattgcgcatggaggatatggggcggcgcccctggccccaccgtccgcccgcgctagagaagcggaaggccgagcaccgccttggccccgccgtcctgcgctagagaagaggatgggcggctgctgcctttggccccaccatctgctgaggaagaggagtatcccattgttttttagtctaactggtatgcgggccccacatttatttttttttaatattttgcttttagtgatcactgccacataggacgaggaccaagtcaaaccagccacatcactgtcacgtcagcctaaaccaccatctaaatcgagggccttatttgcaccggttatgatagttgagggacccgttgtatctggttttggggttcaaggacgaaaatcggattcgatgacaagttaagggatctcaggtgaacttattccacaaggaaatcattcacgaactagattatatgcatttttggaagcccacgggacaggaaattaccggccctatccacatcacttcccagggggataggatttcccggccctttccacccataagctcgcgtcattcgctgatcgcatctccgtcgtcacgagcagccgccgcctccgcctctcccacccgcgagattccgccgtcaccgaccgcaagctgcacttccctcttcttctaactgatgtcaggcgacggccctcgatggtaatgttccggtgagacaaaaatgaacttctttttaatttctttcgatgaaaggactaataatcctcccacaagtttaggactcctgatcatggtttaattttttggtttggccgattctattggaggtcaccagtataaggaaatttctgtccgaaattttgaacaaatgttagtcagatttgaacaaaatattatcaaattcacaaaataaaaataaaaattttggtcgaaataatatcgtatcgggggatccgaaatggctgaaatttctaaccatgctcctattcctgaatgaagcataagttccgttacagtttgatctaatctcggcacatttgaatttgatctaatctcggcacatttgaaattgatttgtctctgcaagagggctttgatatctatggggtgaaattgatttgtctctgcaagagggctttgatatctatgggcttgtttggttctttaccctaccaattcattggtagtgccaaagtctaggaaaattttggcactaccaaaatattggtagggtaaaattatttagctaacatttggattgctaccaatttaaagccaaattcttatagcatagtgaagaaacttctagaatatgaccaaatattttaggggcactaccaaatatttagtctcaatccaaactaacacacaaactattcaatttgccaataaattggtagggtatgtttttggcatcaaaccaaaacggccctatacgagatgaaggaaaatgcctgacctgccgaccatggacgacgacgacgacaagatgggcactcacgcacaggtgcagcagctgcccgacgagctgctcttggagatcctgctccgcctgccgccccgcgccatcgcgcgctgcctcgccgtctgctcggcctggagctccgccgtctccgccgcggccttccgccgcgcccacgccgaccgcccggccgccgtctgcaaggccaccgccacggcgatcgactgctgcgaccgcgacgccgtcgtcctcgacgcgttcctcggccgctggcaccgcggcaacgtccacaccacgccgcggtctccgcgcggcctcgtgttcccggcggccatggcccccgagcccgacaccccgtgggtactcgatacgctggtcgtcggctcctgggacggcgtgctctgcgtcgagcgaggtgctcctctgctccggggaagccgctgggacgccggcgtccatcactggcccaaatccggccggctccgggagtacgtgctctggaacccactcgccatgacccgcgccaccgtctctccgccgcccggccgcggcgctgtcatcggaggctacgcccacccggccaccatgcgcttccacctacttcacgccgccggcgaggccgcacgccgtccaggtagcctcggcctgttcgtcccgaccgtcttccgtgtccagcgagtcggagacggcgcctggcgcgaggttcccctccctctcctggaacaacaagacgatcacgcgcacgcgcagctgcagatgcacggcgctcgctccgtcgccctgcacggcaacctgcactggctggtgcagcggggtggatcggccggacccggacggctgcaggtgctcgtgttcgagccggcgcgcgagaggttccggctgatggaggcgccgccacggcgccatggcgaggaggacgacctggcaagatcgcggatcgtcgtcctgtccaacggcaagctctgcgccgtggccgtgcgcccggccaccagcacgatggagatgtgggtgctcgactcctcctcctccgacgcgccgcggagatggcggctcgacgcgtacagcctccggcgaaggaagtggacgagggtgtgcgccgcgcgccccaggagtggttccgtgggcgtggcgctgctgccgcaccgggagagcgttgctgatgatcagcccagcttcggcgaggcgtcccggctgctcgaccacaccatcgacatcgacgtcgatgaccagtacttgtctatgaacccaattactttgttttgttactgaacaccgattgagttatttatatcagcttagttttattaattttaggaaatgaataaaataagaactatcttataaagaattaatttgttggtggtatttttgtttgtttgatgttagaagttaaactaaccaacgtcaaatataaaaggaaggacgtagtaatatgctaggatgattgaatctgactctgctacatgcgccttcattgggcgaatcgatacgggaaactgttttaattaccacccgtttattacatgtcatctaaacggttatgaaaataattgatatgataagatagtttaatatgtaaaatatcactccacaaacatataagttaaaattcgacttctacaaaaataacaaacaaaacgttaattactatttgtataattgcagctaaatttgttatttttgttacaatttgtagaagttgaatttgaaattgcatgtttgtggagtaatattacatattaatatattttgtcatttttttgaattttttcataaccatttaagttgacatgcaataaacgggtggacgtccactcgagtgattagaatccatctcgatacagatatcttactcagtaacgcatgcttgactctccacacacacccagataggtgttttaaaattcatatacatagggaactctagatttcagatgattgaaattgtcaataattttagtcatttttctcgtccctttgatggcaatccaatgatcctcgttgcttctctttttcacccctttttaaaaggttgacctacatacttaaacatacaaaatttacaagaaataaatctataattaataaaatttacaaaattacatgaaaatgatgcaaacttagataaaaaaaaatgaagtgaagccacatataacaataaaattgcagttaagaagtaaaactacacattacatactaccgcaattttagacataggaatacatatatggtgtgcagcggtcggatccaccgctagctcccgcgcccctcgcagtccgccggggtcgccgccgtcgccattggcggtccgccgttgtcacgcgcccgtcccacggccggatccgtcgtctgcgaccctgcagcagccggatccaccgttcccacgcccatcccgggcggggatttgtggcccgagcccctcgcaggtcgtcgtggtcactgccgtctccgtcgccggtccgccgaggtcacaccgatcgatgccgagaggaggaggagaagatgtggacgccgagagtaggaggagaagctgtggcctgtgggaggagaggttgggggaggtaggggagaggtaggaaatgaggaggaggtgaggtgagaggagaagacaagatcgtcggtgggagtggaaagagataacatccgtgcgattttgatatagggaatttcttttcacagtcggtgctccttatctaccgccagctaaaatcaattttttaccagcggttgtttaagtgggctgccagcgaaaataggttcttagcccctcacccctcgttataattttgtaggtggatttcacaaaaagccgccagtgaaaataatatggtaccgccatgaaaaatcgattttgtagttgtgatagctcttcctgcagaatatttttttttcttccgtctggtccgtgcttccgcgggaccagtataatagtaggtattaaatacctctaagttgacttcttaaaaaaatgacgtcatttgtaatttttcacggaaactaatatttcatggtatttgtatactgtagtccttttctgctttacttacgtaggctatttctcatgtattttcagaaagttttgatccatgttttagaagaagctggctatacaaaagattcacattttactctaccagactttatgaaattaagctccaatctagtactttattcccttggatctctttaacctcaacatacaaatattttctgcaccagtgtatcaggagcatacacatttgattgattttccgtgaatcagctagatgttctagaacgattatatcttgtctgttatttgattgattttattttgaataagctgataatgatctaattaaagtatagttgccatcatctccgtatttgttgtaaatcgttcatcacatcacttcaggtttcatagcattatcgggaaaagttctcaaactaggatgaataaagtttcctctaaagcaaataagtgagaaatgtgatgcgtatcgaggactttaatctttcagaaacaaacataagttgtctacgagagactataagccagttataaacatattttaagaagataaaagaagagagataagagcagtgggctataagtgtagatacaatagcagactataagccagctataaacatattttaatgagataaaagaggagagataagagcagtgggctatagatttgtagccagctacagcacggactccaagacgcatttgtgtatgacaggtgggccagatattgattttgtagcatatgtttatagataactattgtatgaattggatattaagttaactatagattgatttggagcctgtagtaggtttcgccaacccatatagatcctgaagataaaagaatcgactgaacaaataacttcgatttcgaatactgaacgataacccgcatagattctacatatatttaacaacatgctatggtaaagtataggtccaaatagatatttcgaaaagaaaatttaaatggtaatccaataatattatttttagcaaataaaatttagtttacaattaattatttaactatttattgatttaaagagttgaattaaatatggtcgcgccttactgagtggcacggagggggagaaaatatttttatagggagtagagatgctggccatggtcgtcgacgatgagctgaagccgccactgttgggaatagtcccacattactaatctagggggagttgaaccaacttaaaagtggggggagccccttacctcttgacctagcttttgggatgtagcaaggctttctcccaattgggccaacgtctcccgattttgggccaacaagttggtatcagagacaaacccataatctctattgcttgtgcacactcagggtggtgtaaacccaaagcccagtggacagcgggtgtgaggccgatcagtggaccacgggtgtgaggcccgtatgtgcctgtgtgtggggctgatcagggctaaggggtaccaatgtgtgacgggggaaattgttgggaatagtcccacattgctaatttagggggagttaaaccaacttaaaagtgggagagcccctcaccacttgaactagcttttgaggtgtagcaaggctttctcccggttgggccaacgtcttccggttttgggccaacagccgcgacgcctcgccgaagctcacgtcgtgccgcacgacgctgcggcagcagcgtggcgaagcgggagacggacaccgtcgaccacgccctgcgccggcatacgcgtcgatgttggccgtcgttgtggaggatcacctcctcgccctccgcgtcgccctgcaccgctgacacctgcgtcgccgacgagaaagccctcgacaggtcgcgcttgtcccacatcatcaccaggccgaccctctccgcgagccgccacgcccgcgcgccgccggaggagtcgtcgtcgtcgagcacccacatctccatcgtgttcgtcgccggcgagacggccacggcgcagagcttgccgacgccggacaggacgacgacccgcgacatggccaggcctttcttctcctcccccccccccccccccccccgccacggctgtcgtcccacggcggcgcctccatcagccggaacctctcgcgcgctgtgtcgaacacgagcacgttcaaccgcgcggtcgagcccgagccacgctgcaccatccaatgcaggttcccgtgcaagctgacggattgagatgcctgcatcctgagaaagattatggttctccttctccgctgcaattttgcatgtttgcgtcgtcgtggccgtcttcttcttcctgctgttccaggaggggaacctcgcgccaggcgccgccgtctccgactcgccggacacggatggccgtcgcggcgaacaggccacgttccgcctcgccggcggcgtgcaggaggtggaagcgcatggtggccgggtgggcgtaggcgccgatgatgacgccgcggtcgccgccgggcgccgggggagggacggtagcgcaggcccgggtgagcgggttccagagcacgaactcccgctcccgccgctccggctgcgtgttgtctaggtcgggcccgaacctgaagaaccgagaagtgtactcgacgtcgacgcagacgacgccgtcccaggagccgacgacccaggtgagggcgtggtgccgccatggtcgcgagctggaggcggggacggcggcgtggtgtgtggacgttgccgcggtaccagcggccgcggaacgtgtcgagaagcaaggccttgcagtagcgccatggcttgccaaaatatgccaattcggaggtgaccttgacgacagcggccgggcggtgggcggcgagggcgcggtggaaggtcggggcagagacggcggagcgccaggccttgcagacggcgaggcagcgcacgatggtgcgcggcggcaggcgggccaggatgtcctggatcaccttagatgcctccaataattcagagaaacaaacagctcgcagcttattctatgtcagcttattataatctagcttagagtaatctgatttaataatctagattacaataatcttaagctgaaacaaacaggaccttagtatgagaactttataagtgatcgtataaatataacaacttgcaaggtaggtacgattttgatacaataaactaagaaattatgcgacaacttaattatttggagcattttctacatagattcaatttaagtaattattttgacaatatactagtgtggatttgtataagcatatttatatttttattataataattaataacttgaagtcaattaaactggatgtaaaaattattatatttcggttgatatttgagaaggtaaagaaaacgaaaaaaaattttaaggtaattggatgtaaactgtatatgcaatataattactaaagattaaatttaatatctaaggtaatatctgtaggattgctatgtaatggcattattgatatcgggaaaaaaactcacctagcatatgcctagccaaattgatgcaccaaaatacaaattgtcaagttcttgtagtagaacgcacctacctgtcaagttgttacacttggacgctcatttctcaagttcttgcactatatcgcacccacctgccaagttgtaccgtgggtgcaatttactcttctttcttctacagatttttggaagccaaccttgcaggtttcgagtaccattaggtgcatctggtactagcaagtactaaccccttccagctgttagatcttgtgtgatggatggtcaggattcggtacctcctcttcaaaaagggcccaaataaattgattcattattttgttttgtttgaaggaaaatgattatgcacattggctggctatgtacacacaattgacctgttataagcatgaggtctctgttatacgtcatatatcatcacatttatcatttacagcagtaccagaaaagatctccatacagattaagagttctgaatctttagagagtgcttaaaataaatcatttagggaatggaaaaaaaactgcaatcagatgaaccaacatactgcaatgcaaattcagtgcaaacaaactcctagcgcactcaatcccttattttcaacatgctacatgtagatattcagcgtttattttctgaaccaaactgatatacactacttgtgtttcatacttgcagtagtggtctcgtgccattgtgcaacaacacagacaagactaaaccagatcaacttctatagtgtcctaattctggagaaaagggatagcttcccaaaaaaaataaatacagatcaaagtgccagtattaaccacccacaactaaacttgttgttaaaactcaatctcgaaacatgacaaaaaaaagctcatcaagatgttctatgccaactatccatgttgcatcagccaacaggtgaatcttgataattgaacaattaacaagctagcaatccatgtagaaaatctcagatcattggattaagaaggcgtgcatgtatccaactactgcattatattaataaattcacaaaatccagatgtaccacaaagcaaaaaaggcttttactgacatgcagccagagagattgctaaccttaaagcagaaagggccaaaaaatgtatactccatgctggttgtttacacacacaaatactacagaattgacctgttatacatatgagattaacaaaaattgaggagcaaggaacagagtagcagcaagcataaacatgaatataaaagagaacttgatcactccatgttcagttaaataaagtccaaaggagctctgaatatgcagtagcacttaaaatgtcagagatcagaactagcttactaataccaacaggcagaaccgatcatacataattcaggcagaattttcattgggggaaggaaaacctgaatgcagatgatgcaacttacagcaatgtcagcaacatcagtgtaaacaaactcctataaacctacattcagatgcttttttccctcgaaattaactagatagatacaaaatgacactactctgtttcctatacagccaatgaaccacaaactcaaccagataaaattccagtgctctaattcatgagtaaaataatctcagtttattacttgaatcctcaaaagatacagaacaaactacccgtattaaccacccatggctaaacttattcctaaatttgaatccccaaacatgacagaaaaaaatatttaagaacatcttgacaattgaacaattaacaagcgctagcaatcttggtagaaaatcacacatcatcagattaagaaggcatggtcgcatggttatatcttttttttttgaacggaagtcgcatggttatatctgagaaaacactacttcattataaaaaaaatccacagaattcaggtgaggatcgacatagaggtagcacaactgcacaaaatcaaccaaaatgttcaaccaatgtttcagaattcatcggtcaaacgtcacgaacaggtcataaatcaggaacaggttgatcgaatggcaaacacgagtaagagatagacagaccaacgaggaatcaagcataagaagtctcgacggaatcagttggcgccggatacatcctgccgggcgccgacggccctctcggtgcccaacttcgcattcccgatcgcgccctggaggttatcatcggcggcgaagagctcctcctcgacgccagggacacgcgcggatggtccagcagagggaggatcgcatccaggttgctgcggcacccgtcaacactgacgtccttgccggcttcatggagctttggttctagcgttccactccgcgaggtaccaaggaggccgatctcgcccagacgcgtcgatgggttgacgctgccgtcgtggagcgcgaggagctcggccaccccaccttcatgagggacatcgcggaggagagatttctggacgcgtcccccgagctctcccatcgcaagctggatggatcctggtgcgcgcggcggccgcctcctcctcgtccccccgcgtgcatcggtgacgtcacgtgcgccagcgccttggcgacgtagtaacaaacagaactctaaagcaaattggtactaagtcttaatgtattgctacaactagaactcttgaagaatcagaggaccaaagtcgtccttcccatttccagtagaaaaaaggagtataggacttcatttcagctgaaagagaacagcaaaagtggagatcagtagcaaatctgagccgtatgttcaccatgcgccggtgcagctagttcagtttcttcgccttgacaacagaatcgtccaggcatcggacaactcctgagcaacggcttcctgagcgcagcgcatctcattcgttgccatagtggcctcgagggcagcgactgccgtgaatttttcggcctccgatgcccacacatcccacagcgggcacccgtaggcaacgctacccatgatgacgagggcgaccttgcccgcctcggcgtttgacaccgtatcgatcaccctcttcagcgccttgctgatgtggtcaacggcttcctggtggtggacgtcccagctgcggtacgccgggtcatcctgctgggcgccgaggtgcgcgacgtagcgagcgaggacgtgccttgtcttcgcgtggagaacggtgctctgcgagatctcgcggcgggcgtcctcaagggccacggtggggcagattccctcgggatccagctggtaggcagaatttccttcgacggggacggccgccgccggcgtctcctggcgtaagttcacgcgcagcatagcgacgcgttcctggagcttgccatgggcatctcggatcaacctgagcgctttcagcccgccggtggcgacgagcaggaaggctccagggagtgtcctctcaatctcttgccaccacttgtccaccgccgccggtggagctcttccgcgacgcagaatcgctacggcgtcgaagaactcgagagcaacagattggcgcgcccggagcacctcgtccagcgccagggtggcctccaaagcggcctggtccacgagcttctcggccgccgacgtccactctgcccacagctggagcgggggctggggctgggagaggagggtctcggcgatgtcgacggcgtccttggccgcctcggcatgcgacgcggcttcgctaaccttctccagcgccttatcggtgaagcggatggcgtcctggtggtggacctcccagctgcggtacgccgggtcatcttgctggacgccgaggtgcgcgacgacgtagcgagcgaagacgtgcctggtcttcccgtggcgagcgccgctctgcgagatctcgcggcgggcctcctcgaggatctcggtggggatgactccttcggcggccgggtcgccgaagaggttcatggcgatggccgccggcatgcccaagtgtatccggcggaacaaagttccgcgcacttgtagattgctgtgggcgacttcgatcaacctggtggcttccatctcgcagctgactagcatgagcgtctcgggcactctccacgcaagctcctcccactcgtccattgccgccgatcgagctctctccttctccctctccctctccgctctttctaagtttctagcttcggcttgggcggtttggatggagacgaagacgaggacgcaatttatagagaggcgctgctggagggaggaggggaaatgtggcttgccggtgaagacagacacgggaatctctgtgtcactgacaactcctgcacccgcagtttcaatttttttaaccttacaaccgtgggccccacgtatcttccaggctggctatttcatatctcatgctcgcgagcggcgaggagaaggcgcggccgccgcgcgcaccaggatccacagcttgcgcgcgatgggagagctcgtggacgcgtccagagatctcgcctcagcgaagtccctcatgaaggcggccgatctcctcgcgctccacctccacggcggcagtgtcaacccggccgtcgacgcttctgggcgggatcaaccaccttggcgcccagtatgtacctcgcggagcggaacgcctgtgactaagctccgtgatgaagccggggaggacctggatgcgatcctcctcatgctggaccatccgaatctccctggcgtcgacggcttgatctaggtggagcgcgccgccgccgatggttacctcctggccgcgatagggagcgcggagttgggcaacgagagggccttgggcgcccggggggatgtatccggcgccaactgattccgtcgagtcttcgtatgtttgatacctcgttcttctgtccatctctttttcgtgtttgccatttgacctgctcctgctttgttacctgttcgtgtcgtctgtctgatcgatgaattctgaaacattggttgaacattttggttgcatttgtgcacttttgctagctgtacgactcgatcctcacctggattctgtggattttttttttttgacgcggattatgtggatttttgataatgaagtagtgttttctcggacatatccatgcctttttaatccgatgacgtgagagtttctacctcgattactaggttgttaattgttcaattgtcaagatgttctgaaatttttttgctgccatgtttggggattcagatttaagaacaagtttggccgtgggtggttaatacaggcagtttgttcagtatcttttggggttccaagtgataaactgagattatttcattcacgaattagagcattggaacttgatttgattgagtttgtggctgtataggaaacagagtatggagcgatcaagctcttttatatcttcatgttttatgcctgccgctactctgttccttgctcctcaattttttttaatctcttacgtgtaacaggtaaattctgtagtatttgtgtgtaaacaaacaggtaatgagtaaaaatgttttgggcactttctgctcaaggttagccatcactgtgactgcatgtcagtaaaagtcttttttttttctttctcctacatgtgggttctgtcaatttttgagaatgcagtagttctttcttggatatatgagtgccctcttaatcaaatgatatgagattttcctcatggattgctagcttgttaattgcacaattatcaatatgcacctgttggataatgcagcagggatagttgagatagaacatcttggagcgcttgttcttttgtgtcatgtttggagattgagatttaagaacaagtttagctgtgggtggtttgcactggggattttgttctgtttcttttcggaatatcaactagcatgaactgggctatccattaattccagaactaggactgtaggagactagaagttgatttggtttaatctgtgcctttgttgtacaatggcacaatggtcgcgctgctcgccgcatcttgctttcgtagggctccatttgtttggtcgatagatcactgaaatcgcttgcaatttcctctggcgcgtgcgtaccgaactaccaatcatgcgaattcgtgtgcaaacacataagtagatgatgttcatcacaatctgagattcagcagcagattcgcattccatttgctagcggcagtgttccaaatttgatcaaccacactagtaaatgcgtcacaactctgaaatttttacatgggcgcggtttgaatggagacgaagacgaggaacagcccattacggttcattatgccacttgggacaaattaacgtcccgaatttccccaaaaacttaataggcccatcaagccccaattaaagagcgcagagttgtgaacatgtacgttcagaactcagacgcagaaacgcgtgctgttcctaactgtaaccgcatatatagatacaaatagaagcattattgttttttcacttttgatgatatatagaagccctaacgcccgtaacaacaactaggcaatcaaattagttgccttttttccatggagtccaccaccaccacgcgcgaggcgaaactgctgcggcgaaatccatctgatcaccacgacagcggcggaggcggaggcaacgacctgatcagtcacctcagcgatgacatcctggcgcacatcctcgcctccctacccagcatgacggacgtgatgcgcgcgtgcgcggtctcgcggcgatggcgccatcttggggcgcgtgtccccgtcctcagattcttctgcctcgatcacgacttcagcgagcaggagaagctcgaccggttcatcgccttcgttaacaatatccttgccaggcgcgccgatgatggcactagtactactgtagtagaggagctcgagatctcctttaagttgttcaatagccgttgcatgagtggcggcagcaaacgcgtcgtgccatcagtggatgttgcccaagtcgacgcgtggattcagtatggtatgcagcatgtatccaagtctttcaccctacaacttaactacatgctgccattgaacttgcacaacagcaatagcagcaacggctgcatgcaggttttgggtagtaataagcttatgattacctgcggcggcggcgcgacgaggttggagagcatggtcttgtcgttgaacaaagcgtgtctccgccgccttcccacgaacgtgacgctcgattcgcttgtacatctcacgctcgaggatgttgatgatctcaatcagctcttgtcaacagcacgctgcccttctctgcggaagctatgcttgcacaagcaaactgtgagtccggcgacaacgacagatcagtcgttgcatctggagtccaacgagcttttaaaggtgtcgttggattggatctggagccgtgctttggtgttggagctcaggactcccaggctccgtgttttccacacgaggaacgcgtccataggaaggttggtgatatcagcgccgaggctagaggagttgacgttcttctacacgagggtggcttccattgtccaagtcgaggatatgccgtgcgtgcggatctttgagactgagatgagttcactacgacgacccgaatgtaatgaccacgtaaatcaaactaggattcggctcctacgatgctgcaaattccttcaatttctcacgttacacctaactattacccaggtacgtacgtgttgtatatacgagctagagaaatttcatagtccttgaaaaagtgcctcgagataccaaaattttacactaaattttttttttacctcgaggtacttagtacccagagatattaaattttacactagaaagggtggtaattcctggtacttttcaaggatggatgataaaattatacatgttacaatttttttcagactgtgattagctttagtttcactcgcatatattatttataacataatactgagttttcttttgttatactccataattttactatataggacacttatatagagcaccaaggtatcaaatacataaattcacttaaatttttaaattttttgaaattatgagttcaaattcagttcaaacttgtttgaactagttagtaaagaagttaatgtttatacctaaatattttaaaaattttcatactcaattgaattgagtatatacttaatttgaatcttggtgcccgagcaccatgatgcagtgcatgcatgtgagacataacagaaataaagtatggtacaaatattcgtcatgtcttcaactttaggattattaataagctaacaatgatcctttaatttgtgcagaaagacggtcacgatagtgcagaggttgagctgataaaagatataccacaacttcctcacgctacatctttatcattacaggtttttgcacaggtttatgatattgctagtgtgttatgtcttcttactcggtgcaaatttctcaaacatctcgaacttaacataaaatattgttcgatggtaagctgctactccgttgtttattaactgatcagtagtttaataacttacatcgatttaattcatcgaattgatgatggttttccataggcagaatattgcaaaagacctacaggtatcggtacccaaaatcagagggatcatcatatcatctcgttagagcatcttcaggatataaagattaccagcgcttacaaacgacagtacgaagctaggctcctgaaattcttacatgcaagcgcaccggccttgaagaagatgatagtagcattcatatcagcctttatgctatcccagagcttacaaatatgtgcgaaagaatgcgaagaatttctacatagcattccacttaataaggaaggaaagtgggcattttgctaccatggtgctcatatgcaagattttacaacgttcgagtggacgccaataaaaaaagtagagtgcagacagatagtacatatggattaatcaatcgatactgggtatgctatttgttagaattctttttttttcctatcgtaaacgtgcaaaataattgcatgtcaatatattagaagaaaaaaaggttttgttacacaacgcaatcggccagacagacctatgttggaggaacaataataaaatgaccaaaacagaaaaggaaaaaaaaaaccactacgaagaaaaactactccaacaaacaagagagaggaggtggagccgcactacactcccaggagatccccaaaagcggcaatgcctacggaagctcacagatggccttccgagcggatggactcaaaaagcatggagactgaagagagtgcagagtcgaaaacagttccgctccttccacagttgccaagagaccagaaggactaagagtcgaagccggaggaaagatgctccggtaagcgggccctagaatttgttagaattcaaaattttgtacaactagtactgagctctagtttgagttggatgctttcaccagttcccttttttcccccctcaagaatttatcgtggttattttccttttctcaataggaattttatggtttttacatggtatatattgttgtggctaccctcgacagtcgcgaataatgccttgaataacgtgacaacacatgcaacatgtttaatgtcagaatttgcagttttcactagctgcatgaaaatgcccaaaatatttatgcacatttactggtagtgtacacacagataaaaacttgacctgttatatgatattaagaaaattcgagtgcaagggacagagtaattacagcgagaataaaacataaagataaaagaaaatttgatcactccatattgagttaaataaagtccaaaaaagggttctgaataagcactagcacttaaaatggtcagaggtcagagctagtatcttattctcgctaataccaataggcagaacagatcatacataatgcaggtagaattttgattgggaaaaggaaaaactgcacgcagatgaacaaacataggcaactgcttcagaagaaacagatggacacaatggcactagtactactctgtttccacaaaaaaactcaaccagatcaagtcccaaatctctaatttgtgaataaatgaaaatctcggttatttatggagtattactcgaatcccaaaagatacagaacaagttgcccatatcaaccagccgcagctagacttgttcttaaatctgaatccccaaagatgacatgacataattttttttgtaagaacatcttgacaaatcaacaattaacaagctagcaatacaggtagaaaatctcgcgtcgtcggattaagaaggcatgtatatatccgagaaaacactagtacctcattatcaaaaatccacataacaatccaggtgaggatcgacatagagctagcacaagtgcacaaaagcaaccaaaattttcaaacaatgtttcagaattcatcgatcagacgacacgatcacacgaacagtaacaaagcaggagcaggtcgaacggcaagcgcgaaaaagagatggacagatgaacgaggtacgtatcaagcatacgaagactcaacggaatcaactggcgccggacacgtcctgccgggcggcggtggccatctcggcgctccgctgaacggccactatcgcggcctcgaggtcggcgacggcggcgaggcgctcggcgttgatcatgccctgcacgtctggtagacgacctacatggtccagcagaaggagggccgcgtcgaggtggccgcggcacccgtccacaagggcgtacgccttccgggcgtcactctcggcgtagctgagcttgattgcggcgctctgctccgcgaggtagttcaccctgagaagacgcacagacagcagggttgatgccgtcgccgcggagagcgaggagcctggccgccaccgtgaaggaaatcgcggaggcgagattgctgcacgagctctcatccccgaggccgagcgcgtccagcgcgagctggatcgtatctcgcacggtgttcgcatcgcccgcgaccatcgacgacgacgacgacgtcagttgcggcagcaaggcgtggaggctctcacgcacgccatcgacgcggatcgccgcctcctccacaagcctcccgaactgcgccttccacacctccgccgccatctcgctcgctcgctcgctcgctcgctgggtgttcaacaatttgtttctggaaggatttcgagtcgaggcgtggcgtggcgtggttgcggttggtatgaaatattagcaagcggccagcctggaagagacgtggggcccacgactgtaacggatttctcacctcgggtggggtgagtgaaaaaatgtaaatactcgctgttaaaaatttgaaacagcgggcgggtgggcgcaaagctgcttgtcagtgagacggtaatttcccgtgttcttatccagcaagccacatttccacggaaaaaaaaagtaaattgcgtttagggccaccttttatcacaaaagtttcactttggactacccttaaaaccttttcactttggactagattaatttgccttttccccgcaaaaaaaagaagattaatttgcctttgtttcactttgaaccacccaaaaactttttcgagcacataaatgattttaaccacatcggcacccataaaccgataatcttcccgatttacatgtagactattcttcgcaagattagagggtagatacaactagaaaagtaacttggggtggtccaaaccgcaacaaaggtaatcttacctagtctaaagtgaaaatattagttagagggtggcccaaagtgaaactttagtaataaaaggtggaccaaagtgcaattaactctaaaaaatgcacattctcttgcatgttcttagcctggattcggcaaacaataagatgctgatcataatcaaacattaagatgaatttggtagttatatgtatgagatgtgaaacctgaatttggtagttatgtctaaaacctgaatttgggcccccatcggttggtctaggcttattataagccataacggcttatttgcgattaaaacatgatatgtgagtaaaacttttgtatatatgttcttagtgattgaaaagccaaagttaaaaaaaacctattgtaacgctccgcttttcgcgtggcgttaaaaagctaatttacaaaaatcctaattgcgaaaattccgttctttgagtgttgagtctaagttgtgccaaagatctcaatttaaaatccctcccttgtctcaataccctgatatcaatgatcgcctcctcaaaatttccgctccaaaataatctcgaagttcgaatgcttctattcggatttcaatccagaaaccctaaccacaaatatcgcctaattccggaatccaaaaccagactccaaccctaaagcccctccgatcaaattccctccttgagctagctctaacatccaagcttctccctctcctcgtctccatcgctctatctatctatctatctatctatctatctatctatctatctatctatctatctattgcattctaccgccacatcctttgtttcacccccgaacattgatttctccttttgtttccctctcaaataatccttgagctgccaaatacaaacatatccctaaaatatcaattctcgctttgaacttcaaccacccatcgacatcgaaaatcacgcctcatcgaaattccttcccattaccgaaagtatcgaattcactctttgaatcccctccttggtttctccatattttgttgagttcaaatatccaatttgaattcaaatccagcgtcaaatgctcctcatattccttaaagaaattttctgggtaaacagtctattatacctccgtcgatcttttgggctgattcctccttccccggcccaactctcctcttttggcatgtttcctccccccaataaaattcggtaccggaccaatatgggccaataaatcaccccactcggccccatgggttttttttgcgcccaaccgttggaccatttgtattatttgaaaaaaaaatataaaaaaataagtcacatatcaagtactatttatgtttatcacctaaaaacaataaaaattctaatccgaaaattatttttaataaaacggtctaccacacattgaacacacttaagatggtacggggaagtcctttattaggctaccatacaaacatgttgtgggcccaacttcctaatgattttcccgcacccccaaaaattaatgcgatattctggcccgggagacttccaacccctcactgtaacccaccataatttcccgtgcgtaggataattagcgcccatcaatacctgggaaaaaaaaatggttcagaacattccttcaacattctaaatctgaagataacaaaccaactcccttaaactatcgcccgtcgacctatacctagtcatccatcccttctaactcttttaactgaggttacacctctcttcactcactccagagacttctgcgtctcacccc

SEQ ID NO: 72552 - DNA, 71818 bp, Oryza sativa
tgacaaaatcaattccataacccctaggctattttacgagacgaatctaacgaggtatattaatctatgattagcggatgattactgtagcataactgtagcaaatcatgaattaatatgcctcgttagattcgtctcacaaaatagcctaggggttataaaatgggttttgtcagtaatttacgtttaatactcctaaatagcaagattctggagagctatttaatagcctgaagcatccaaacagggccatggtttcctcctgcaatgaagagatgccagcaaagagccagaattaagacgtgtatgcattgcacagttggcttgcattatagatagatgatgggtggtagatgatggattaaagtgggtttatgacaattattcaacgataaagataaacaaatgaattaaatgatagacagttgaaaatttattaaaagtagagtccacgagaacactccctgattgtgaataattactcatcatcggagctcaagggtataaggattcctaccggtcatgaattgctacctaatatgattaaccgggaattcttgccaattgatgatgcatatacaatctaacttcccaggaaagttaatacaaataatctgagcacaaattagtagttaaagaaagtaaacatatgggaggcgtacgttgccgtttgctgcttcaagcagcatctgctagaggatgaagcagaagtgcaggagagagactaaacttggggctacatgtcataacagcatgtttagatatatagttaaaagttattatattttttttacggagatagtactattcttgagaaacagagaactcggtgtgttagaactcaaccataaactaagcatgcagagtagagaaacgaagtaggcagaaggctacatgcaagtgcaaattacaagtatgtgctgtttggatatttagctaatgtgaagagtccttgtgtaagagaattgaaaaaaaaacactatatgtcataaattcatcttccatctttttctagttcctttttacttttaatttctaattcaaaatattggtatcaaggatttgttaattcgttcaatttgttgatggatgagaaaatttatttccacacgttacggtgtacgggtataatgctagtaaaaaaataaaaatgagggggtaatggacacaatgagtatacaagatgagggtcatccagcaagaagcctttgtggtggctggactgcgaggcagcaacggcgaagcagaggtggtgccacatgaggcaaaggccgccggagaggaggcggtggccaagtgcatggtggaggctagcagcgaagaggcaacgtcacctgagatggaggggcccctaggagacgttatagtgcgactgtgcgaggtggaagccaccgagatagaaggcgctggagtgttgccttgtgttatcggcggaagagccagtttacatgtttgggcctgagtgagaaggttaagaatggaaagagatgggattttttttaatcggttaactgcacatgacattcagcccttgcaggagtaaaaagtctatatgacttaacgtcttagcatagcttttcttttaaaaccctgtataagtatagtattttccgttttattcaatgaaattagcatgctttgcactggttcattaaaaaaattgcacacatggcatgagtcccacattgtttggtgttagcaagcgatatcaaaccgaacatgtgagattttatactatttgctagctgcttcaataccacactgtcaaatggtgctctcctggtcgactttgatttttttttcccatcgagacaccacagccaatgctctcatgtcattttgaacacaatatactacatcactgtcacatcacatgagccctgtcgcaccgaacaaaaaataaccatgctacccctgcccttcatacgcagatcctcctaatccccatcgctgccttctcactctccataggtactctaacccaatcttcgacgatgacgacaatggtggcgagcagcgctagaagaacaaaaaccaccaacaagatggcagcggggttcgtggagcagttttcggcgaggagttcaggacttcggggtaacacagtgctacctcaacatgcatactagcgctaccctagcctaccagatgatccaccaaaaggtgatggcaatgctgaggacatgtggtgcgaggtgaagatcatgcatgctacgtccacctcgtcatggtgctttgcgagagcagcaagatcacccctgcagcgtggggagggaaaagatgggcaacggtggggagatggaggaatagagcacctgaagtggaggcacagttgaggtggtcagggtagatctggcatcttcgagctcaatagcagactaatatgaagccctcgggctcgtcgcggctggctctggcaaggagaggcagccaactcgctatgtggtgctctgcgttggtggtggcagcggcgatggctcgtcatcagagaaggaggttggtgccgtcaccgtccattagttgttgccaattcgtctcctcccgcatgaactatgtccaaaaaagtggaaaaatgggcaagagagtcaatttccccgaattgcatacttatcatgctgtgttagaagaagtgataaaataaaaacaattcagagttcatgagtgtcaaataatcgaagtcactcaaagatggcactcgtagggttgacttctcctgcctggttcggttgccaacatcattgtgcattggtagagttgtgcatacataacttaactcatcatgattaaaatccgactatatccataaattgaattatatgctctcgcagagtctgtaagttatacctcttttgtgaaaagaaaaaataacctcgaaagcctaaagctacatcaatgtaagtcaaattagcatatagtcctgccaagccgatttgccatgcaacactacacaatggattaaaatttgcaccaaatttatcgagccagatccactcatgcaaatggtgatgatattacattgaaaataattgtcactctctgtctcccccatgtatctaaggcatatacaattataagagttttatttcaactcagtatcacaaaagatttgatagaaaatggctcttagagtatcaccttcccaaaactgattttgagggattttaggtgaaaattttgatcaaatcccctatagtccaacacacgttttggagttttttggagttctcttcccttatttctcgctccgttgatttaggggagagaaagcgctcccctccgactcgtctctcacatgtgagggaggagcgtgatctattctgcacgagaattctatttatagtttaacagaagggtccacttttagttttttttataaaatttaattaggtttctcttgaagatatcagtttatttatttctatttttagtttaggaaaccaaaaacaaatttttaggaggagattattcataatctcttggtaatgcccttagataaatgtgcaattgatgtctggtttgggccaactatatcaggtctactttacatacctcaccttaggttcgagtttcagttgcattcctcaaccgttatactaggtataacaatctctcatcttttaaaattagtataaatatagtctcaaggcattactgaggctgattttggttgatatcggcgttcacctgacgtattaactaagttctcgtcccatgaggaatttatgtggcacttatggttagaaaaaaaaatatggtaagatccacgtggggctcacctgtgaggggtcttcttcttcccctttcttcccatctctctctacatctcccctatcttcctctttgtctctaggaaggcaggcggcgaggataggggcgacacctagcaggagaggagcaaggcagcggcaaactcgcctccgtgggggtgggcaaggtagaaggagtgtgatcgattgcccatgtgggtcctatcgttatttttttttctaacggtaagtaccacgtaaacgctacatggcacaaagaactagtgaatacgtcacgtgagcgccgcgccagctaacaccaacctcaatattgccttaaaattatatttacacttgttgtaaagatgatagatgtgttgtattcggctttagagttgacaacgtgattgaaactcaacccttacacgacgaatgtaaagtggacttcttccttatggcaaacatgccacgagagcctctaaatacaggcccaacactgatctaacatggacatgctcagctcatgcaaatttacaggtgggctcccagaattaatgagaattttgttgcaggcatcatcgagggtgctggctcaatcattgtaaggggaggccggtgcggtgctctgctccgttggcttgtccatggcggtgctctgctcctaggtccaagcagtgcctcatgttcaacaccgtggttgccgctgaccatcatctacaacttcaagatgctcctcctgcactgaactctgaaccattttggacagagttcatctggaaaatatgaaacatggaagaaatacttgtactgtactatgtatttagtggaattttgagatgttatggaacatatattcaaatgcgggatcaattgtatatttgtatcgccaattcagtatcatgtaaagattgtttttttccagatccaactcaaccatgcgtgaggctagtggcatgtacatgtataaccattaactgacaggtcgaagaacagaaattgtcagcgactgactagcacatatttttttagataatgtccatgctgatcaagtatatatactatacatgcataattacatatatatatataaactcctaatttttcgtatgcataatttcaatccgccgcctacagagaccagcaatttctcagagcaacatcacaacgcatgattcccaaatttacacaaatagaaacgaacttcacatgagatcgacggacaggagcagcacgcgagggcagcggcggcgaggcgagcgccggaggcgccgccgtcgcggtggccggcgccgccgtacgggctgaaggcgctgctgggcccgaacgacgagccgctcccgttgaagctccccggcgggccgaaccccgacggcggcgtgccgaacccgcccagcggcggggtgccgaagccgcccgccggcggggtgaagccgccggccggaggggtcgtgccggccgccggcgggctgagtcggtcggtgggctggtgccgaccggcggcgtgaggcccgccggtggggagagcgtcgtcggagggctggctcccggcacgctcgtgttcgagcctcctgccatcgagctgcacaaagtaaacagaaataaatatgatatttatccttgtcgcattcttgcattgctaatttgaaaagctaaatttcaaacaatcttttattattcacgtttcgttttcagctatcctttaaacatttaacatttttatctttatgatactctagatcattttcaactcttttatcaatctatatccaatttattatatgctgaaaaatggtggttacatatagctattgaagttcattgacgaatatgaaatatcggcaataaaacatgtctaaagtaaaatttactctcgtatgaatgtaatatgtggctgatttgttcaagaatttccacatttgagctcactcaccttcctgtgaagacgcatgatcctgagcctgagagtattcaaaagaagaagaaaaaaattaaattcagcaaaaattcagtgaccgaggagggagtgaaatactccgtattacagaagaaatggagcttactgggatcggcggtggtggtggtggcggtgccattgaaggagcaggtggcgccggtggacgccatcttctggtagtagtcgttgtaggcgtaggacgccagcgccggcaggttgttctgcttgtagcacgcgccgccgggctggatcgccgcgcagtccgcctgcccgggcccgcacgcccagttcagccccgcctgcagcgccgccgcgtccgcgttctgcagcgccacgcagaacatccccgccgacgtcgccagcgaccgcctctcgccgccgccgacgccgccggaggcctgcagcaggtagctgtggtacaccaccgtcgtcgcgccaccgccgaattcttctgtctccaccggcgccgcgatcaccgggatggcgcccccggggaaccccagcgcgcgcatcgcgccgtaggccgcgtcgaccatggtgtccgtggactccgacggccgggtcttgaggaacagcggcgcgccggtggcgttcaggaaccggaggaggccgcccgccacggcggcggcggcccacgccgggggagcctgcagcgcggcgccggacaccgcgctcgacaccttcacgcggccgtcgaggcgcgacgcggcgagcgcggcgtggaggttggccatcgccgggaggaggaagtacgcgttccccggtgacctggccacaacgtcgtcgccggccaccacgtgcgtgatcctcgtcgccgggaggaaccgcgcgacgttggcggcgacccagagctcggcctcctccgggaactcggccatgtgctcgagctggtcgttgggcacggtgaggatcacctcctcgccggtgttcgccagcgatcgcagcgaccgatggtccccgccgccgatgaacacgcgcgcatgcttcgtctgcttagactgaacaatcttggcgaactccgacggcgagttctccggcgaagggatcgtgttggcgccaacataagtccctgctcatcattggagcagaaaatttagtgtagaacaggcaaacacaacaggtgatttctgaatttctgattagtgacgaagtgcagaaagataaaagttcagttggttcagtctagtctacttatcctgttaatccatgttagtaattgattggagcagaaaattttagtgtaagacaggcaaacacaacagatggttttgaattctgaatatctgattactgacgaagtgcagaaagatatgaaagtacagttggttcagactagtacttaatcctgttaatccatgttggtacttggttgtagtacatgatggttgtgcacttcatagttcatacaaataatgcatagaatgatagtactcttgttagattaagagtgttagatcatgaagccctggaatcatttgctgtcatcagggaaagaaaacatgacctgctgcatgaaagatcagaactggctacagttcaggtttcagagtgttcagtatttgaatgtttgttttctcacagctgactgatatgatttgggttgtatcaaacaaatcattggctaagtatatattattcgcaccattctactatttcttaagcatgagataactgataagtttctagatgtcacatgtatggcgtatgctttttgtgactgaagataaggcatgcaaagtggggaaaagcacaagcatatcagaaaactttgtactagcttaaaagtctcctataatgttctgcactttaggcatgtatgttcattttttttgtaaagaatctcagtgatgaaaaagaaagtgagaaaggaacctggttctgttgttaactgaaactgaagcaaaaactaacaagagaacaactgatacggagtactaattagtaaatgataatgctacttttgctactacagagtgcacatacctgatgcattgcagacaagacagatgagcaaaagtatggttccccgccatcttctgtccaacatcattgatgatagatggtgctacaggaagggcaacttcttgatgcacctcttggacctgttgaacctagcaataccatcagagaattccagaagattatagaaagtatttgcaattggacgcttgcatcattgcatgctcattttggagtcaggggaaaaatgacctgtttccagatcctcatgaactaaagcacaaaattcccaaaagaaaatggggcaatacccccttgcaaaaaagaagaagaatacccaaaagaaagtgcctcttgcaaagtgcaagcaaagctaaaggacttgcaaggaaaagactacaatataataaaatcctacaaaaaagttcctatcaaattctccatcattgttcacacaacccttagcaattacatgccaactctataagaacaatacatgtcaaccagccccatgcattgttttgatgattttctacttagtaatatagcaacctagtatcgaataggacatatacttcatagtacaacgaatctgaaaagaaagcatgtccggatatggaatttccagccgattcagcgagaagttccatgtcctctgaataagtccggtagttgggacgttgttggatcagaattcagaacagaacagaacaaacacagcaatattcataatacggatgctgcgttatctgaggtcggccgggccatacattgtagccttggagatgcttcgagagatggaaccgtatactcaccaaacaaccctactagtcctacatggcgacgtcatgaagaaattaagcagggaaaataattgagatgcgacacgacacacatcgaagaaagaagaagaagaagaagatggacttgaattcgccggacccagccggtgatctgatcgatcaccgctgcctggtgtcatcggcagagcgacacgaactaggctagtcttgaagccaagtgtccgcgtcttattgggttgaccatgaatgatccaaaacaatttcctaagctaaaacaattattagtagtaaataattttacggttattgagaatgtaacgtgaattactacaatttggtacattttgatacctaggtactatgagataccaaatctatctatctatctattatatactaaagttcattaaacttcctacaaacgctctcaagctaccacgtggcgctctaataaattagagaaaatcctagaaattctaagaaaaaagcaaaacatctacctcttgattttcacttaaattggtgggaccaatattatacaccgttagataaaattgatcttaaaacaaaccaaatactatggggtcccacctctcctcctcccgtgcatatgtacgtgggtatatatatatacacgtacataccatgtacatacacccttcttttcttttttttttctttttttcttcttttcccatttatataatatggatatatacctttttaaatattcataaaagtccattaaacttcctacaaatgctctcaagctgccacgtggcactctaataaataagagaaaatcctagaaattctaagaaaaaagcaaaacatctatcccttgattttcacttaaattggtgggtccaatattatacaccgttaaatgaaattaatcttaaaacaaaccaaatactatggggtcccacctctcctccttctcccgtgcatgtgtacgtgggtatatatatacgtacgtaccatgtatgtacacccttcttttcttttctttttttttcttcttttccatttatataatatggatatatacctttttaaataatcataaatttacaacacaaagaatctaccatcatacaactcactggtaactaaattagctctacaatttttgaaaataaaatttaaaccattatatgtgaccattaaattaataatgtaatatagtttccacttaaacatgtgtattcattattttgtactattattttcaaataatgcactattttaaaataaagtttacacaattatattgtgtacctatcaaataaacaatttaagatctatattaattgatttatacgtgcacttaaaccgatggacccattacttaaattatcggaactatttttttattacattggactattattctcaaataatgcatggtttcaaaataaagtctacaccattatattatgtacctattaaattaacaatttaaaatatatattaactaatgtacacttacactataaccggtggacccattatttaaatcatttgatatattatttgctaataaataaaacgtccgaagttctctttttttgcccgctgcacaatgcacatctgcacctttaccttttgcacgcatgacaaagcatcatgtctggcactaccgttttgccacatatcaaatcatatatggagatgattaattttgtcaataacatgaaaaaaaaattaaaggtgtgatgcagcgagagaagaattaagcactgtgggttgtgttttttttctaacacttagctttgtttaagctgaaaccgagagttgattacagaataattataacgtattgtgttatgtcgtatttggattttgcactatttgttcgtatagatgaaagaattcattatgttataaatgtgagcacaatattaatgaatatcaatagcactcttacaaagactagggtgttataaaggagtttaagatcctctttttttccctgatttcatagttggattttcgtttgcacgctttccaagtttctaaatggcgtctctttaaacaacattttaactttttataagtcaatttattcgtttataccctcaaatagctatcacataaataagataattcatcaatttcagctgtcctaaaccctaagtagtacatatttttttatgcgagtcatggtgatcagtaaattagggatcaactgataatcaaagtcgtaagatgaatatgtaagagctactatgaacaactgtaatcggtgtcaaaattaattgctactaattagacatctaatggcttgctagccacatcattaatttctctcaacatgtatataaacatgcacgaagctagaacaaatattaccatatgccctatacatatatatattaagcggttaatattcttattacatgtgttaagtcctttaaaatttcttaaaacgctctcaagctgccacgtattagaaattctaagggaaaaaaatcaaagtatccattacttgatttttcacttaatcggtacgtccaatattataaaccgttagattaaattgatcttaaaaaaacaaaatactataaggtctcacctctcgtcccgtgtcataggtatacacctacgtacatggttatgtacgcttcccctcccttttttcttttttcccttttttctttttttccatgcatacacttccctccctttcttactatatcatgcgccttcttgagacgatttaatcacaagaattttgagtatcttgctctcgcatttttcatttgtggccatactatacggtatatatatagatggactgtatgataattaactagcaatggtttcttatttactcgagaaaaaaatgatttaaaactcataccttaagaaaaagtttttgaatggttttttaagataccttaagaaaaatagaacccttaaattattataaaataacattatccgaactttagtttgcccttaatctataagacaaaatttttgaataaataataattttacctttcaataatataagtgccgcgcatacgcgcgggccactttcctaatttataatagaaaagtggtacctcatagtacctcctcaagtaccgtaaaatttatcttagtagtagcaccccaagattctgacttcaaatcttcatatgagcgaatttcagattgagttatttgagggctatattttctatttgataggttcctaatttaaaaatattgtctatatctggttggatgtagagcccgggtaaaaaatacccttctctaaaaaaaatcagtagtaatcaggattagcggattaagtgcttagctatccccatcaaaggatagatatgatatgataaaaaagaaacaacttttaaaagtactctacttaatcccgtagctctcgtatcttcatcaatttcagtagtattgctttaagcgtcaaggtcactgattgatgctcgagagtgaaatgaaataatcatcacaaaatttccagctagaaatatactacgagtttaaattggtggagtaacagtaatacggacaactcggattcaagtagcctattgggtatgcgagaatcccatgcaaagctctacgaggatttttacagtgaaaataaaatcgctccaaattaaacgctttgactgacagaatatgaatatcgcacatgaagtagccagctgattgataggagaaatgaagctcaataaatttgaaattgagaaaaggttagatcatactgataagaattaacaacgctagcataacgaggatgaactagtataattcagcagatagcaatacagaaaccgggcaacacgatcgattacccgacgatcgagaggaacagaaacaagaagcagaaacaacagagtaaatcaccatgaacgaacgaatgatttcatgctgcaacaactggaatttcactgatggctgtatgtacctgggagtagcagagagctctcccagctcgcagcctcggatctctcctcgtttcgcttcgcccggacgaaaagcctggcctcggaactgccgctaatttatgctaagcactctcctctgttactgtgttcttggagctgatgagccagccagcagatagcaactgaagctgaagctgcagctgcgaaccgagcagggaggagcagagtgatggcaaggcgactgccattttatacgcaagctaatctctccatcaaatattcaattagtacggtaatgacgcacgctaaacgacgctatcatcggtgacaaaggtggccccggaagatggctacgaggcgttggaccaaaaaaaaaagagagagagagagaggaagagaaaaggaaaccagaaaggagaagtagatgagcagcggcggcgtacacacgcagacacaccatccatgcagcgacatcttctgtttatctcgtcagtgaaactgaaacgtgtttggtttgcacttgggcgccggcctgcctgcctgcctgccactactgtagattgcatgctttgcttctttctgccggatagtataccgacggatcgagaattgtctgaccaagacggcatgctttgccttcgagcctgttcactttggtgccatttttaaccttagcaaattttaataaaattgttaaaaaagtggctacatttagtttgctgccaaattttggtaactatataagaaatcctgctaaaattttggcaagttgctaaaattttggtaatgctaaaatttggtaaggtttttttttcatcaaagtgaacaggcctttcatcttagtcttcagttaggtttgggatggattttacaatataaaattttggtacctacatacaaatattcagtctcatcgttctatttatgtttatatttgttagctaaaatttaaatttagagttgattttaggtttttttttcatcgtagtttatttttcagtctttatttttaagtcgttaagaacgtgtatatgaaaattttattcacaaactatttttcatttgtaaatatacgtgatggagctgattgctctttggcttgtactttgaagttatctaggctgatataaattcagagatgcaatttcttaacaacagtatatcatggatctcatgctgatgtgacatggcaatgccaaaaaggatcggagccattgcctgacaggtgtgattgggtgccaacccctaaccgaaacatcaagagaagcatctggtcaaaccggccggacagtaacatctggctacgacttgggagtttcggacttcaaaacaggtgatccatcttcagctgaacggcatatccattacagtactatcttccaaccaaacttaactgatactctttcatccggccgagtaattaaccttaagcaatcgattgattgattaattagtccctctctaatctttcttgaggcttcaaaagcaaaagagagtctaatttgccatgtcattagccgactgcttttttgctaatcacccaatgcatgataaggtagcatttcgttggtgccctgcttctgcttctgctttgcgccgatgagccgatctagttgcaccaaaaaggggcaactaaaagagacgcaatgtggaatttgctttgtgctgcattggggacggataagcctcgacaagtagtcgacagagagtgcttgatgcgtcgcgctttggacctgctgacggggtttctcacatgcgctgatgcacggcacacaaaaaccgactagatttcgccgttcttttatccggctatatcctgcaacctgcattagaaaatcgtcatcattctaagggtccaagattaccacccatttttattctgatacactgcacgttcccaatacattatactcctgcgtaaaagttaagggtctcattggttgtcctatcgcttataagtcagagccaaaatttaaattttaaaacttgattttcaatttgattttgatgttctttaacatagtttttttttcaattttagcttttaagtcgctaagaacatattatatatatatatatatatatatatatatatatatatatatatatatatatatatatatatatatatataggtaaattaactggtgctacatggagtatgggctccaagattcaaattgagtatatacccaatttaaatgagtatgaaatttttttaaatgtttagatatgaacatcaacttctttactaacaagttcaaacaagtttgaactttttttttgttagattttggttctaggtatataacatccaaacatataattcgttaggtatgtaataatgaattgtgaaataaagttgagtttgagttgttttgttgttaggtatttgtatgaatcaaattcatatacctaggtatatactcacaatttaaaaattttaaaaaatttgagagaatttgtgtgttttatatcttggagcccgagcaccatggagtcccatatgtgtatcatatatatatatatatatatatatatatatatatatatatatatatatatatatatatatatatatatatatatatatatacacacacagaaattttactcatgtattttttttaatcgttaatagctcgttatggcttataagtcataagcaactgatggggataatctaatttattttaaaacggatgaagtatcaaacaaacaaaagtatcaacgttatatatggccattggaaactcgatgacacactttggccgaaaagaacatagttgtacatcaccggatcacccctgcgacaccatacgtggattcaaatgcagtcgcactcatcagcacggagcacgtaattaagtaaaacattatcttgtgacaaggaaaaaggagccggcacacgttgcatcatcatatgtattgttgatatacacttcttcaattcgttggcttttctgcagagatccatcaatcatagcttaggaacaaaggaaactttggctcaatctctccctagcctctatgtacacatgggtcgttgcattctgcacacatcgatgcacatggctcgattgctttgcttgggttggttctcgacctgctggccggtgatggacaaatggcggtgtggcgcccggtagccgtgtctcgactgttctctctctaaaactttagttttgtggtggataagtgtaaagttaaggtttcgttattttcggcctcatcttttcacttaaattttaaattttcaacatttaatttgaagctgatgttgggattttttttatcgaagtttatttctaacctttacttttagatcgctaagaacacgtatataaaagtttttgttggaaatttggtcataattcggcatattttaatccaaaatattaagacaataaacatgacatttgcaatatgagtagatctagtgacagtgatagatgtatacagcttgagtatgcttaatatgaaataagcatcaacatttacatagtaacacaatactgccattgcgaagagtattaacaaagaaacatctaatagaatcgggagaatgaaagtataccccgaaaacatcccaccgctggattttgaagcaggattgcctccgttgatgtcgttcatcatcttgtctccaatctccgtcgacatcttggtgaaggcgtcgatgcagcagcagtagccgtgaagaacaagagcagtcgcgcttgaagcgttacccaaaaacttgatcgcccgcctacccatacaggttctcaagcggacggagtttcggaggcacctgctcatcccgtacacctgagcgcgcaggtgaacagaaccggggaaggattctacagctcaagaacagaggaggaggaactcgaagtgcaagagaggtcgggaagaacttctttcgtccttctagtcgctgtggagtatatatatacgagcgtgggagtaacgttcggaatcatcaaccacggtgtttaatttcgtaaccgacgcgctcgttaatacggaatcaattcacgacgtttaattccgtaaccgacggaatcaattcacgacatttaattccgtaaccaatgtgttcattgatacgaaatcaattctccgtgtgtttaattccgtaaccgacggaatcaattcacgatgtttaattccgtaatcgacacgttcattgatacgaaatcaattctccgtgtttattatcgtcaattcatgacatttaattccgtaaccaacgcgttcattgatacgaaatcaattctccgtgtgtttaattcgcgttcattgatacgaaatcaattctccgtgtttattaccgtccgttacaaaacgagagagcgcagcaatagctatctgcctcaccccgcctggttgtccgcgcaccatcaatagagactctccactagctctgtatttaagttgagacctcttcacttatatttctaaggtggtattattacccatagcacttaatgtgggccaatggaatttattaggatttaattgggcctaacccattaatctaacagttttattaaaaaattactctttgttgcaaatatgccgtttggcttatgatgggaacctttgttttctattttctgctagtgtgtttagaccattttcagcaaacgtaagagttttagcgaaatgaggttaaccccctgtaggagctgagaaaattcatttgttacaaagaaggcgttgtaaaacgagaaaaaggaacaatactgattgagaggatggaaaaggcagaaatgggaaaaaaaaagaatatggtatgaaacaaagaaaagaggggagaaagtcaaagaaagaaaacataccaaactttttcatgaggggaaaaatatgccaaacttttcctgagaaggaaaaatttatacttctaccaaactcgaaagacaaaaaaagagaagagaaaatgaaccagaccgaaatgggaaagcaagaaagtagtcgaaactggaaagcgagaaaacataccgtcatgggccaaatttctctacagatcaaagcccaacaagagcccgtttgtgtacagcccatcttacccgtcacggcgtcacctcccgcatccaccgtccaatccccgcccccccggatccaacggtccacgcgacatctctcccctcattaaagccaaaggcggcacgcacgcacccctccccctccgcgctcctcctctccctccccctccgcgcaacatccggaagcttctggaaatctggaggcgacgaacccaggagcggcgaagcgcctccaagccctaggcgggaaaggtaatcatcatccgattcgcgagtcgagattcctatccccccgttccccttctcctccttctccttcgccggtgaggagatttctaggtttggatttgtattggtcgcgggatttgatgcggtttgatggttgattcgtgcgcgcgcgtgttacatacacgtcgttgtgtgccgcgcgccatcggggaaaccctagctcgctccaccgcgcggtgtggttgcggtgtgatgccgcccgttaggctgcagcgtttgcttggagggtggtggtgtctttgaggccggttttgtgagcggcgggccgattcgagggggttgcgtcgcctgatttggttatgttttgcggtttgcgtgggatttccttttcgctagggtttgggtgttcttggcggtgtgaaggatggagtgtttgctggtgggattgaatggcaatgatcgacagctgtgtggattggcggcgtgctcatattcttttctaactcttgatttagatgccataggaagatgttatgcattcattcacaacagttatttcttatacttaaacttgattgatatataaagtatgctattgaacgcttctaatcatttcatcagtacggaagatgttatgtattcattcacaaccattgttaacaatacagttaatagttcttatagattattaagttgacgactcttaagtcttgaatgccttgtgtgcgttcaaggcactacttaaatttaccattgatggatgtaaattgggagtggcaattatttgatgcatagaaatatattgtgatgtctatttttctcgaatgctgaaatgttgtagcttgttttattccctaccagcatctaccgaacctttttagctaaaaatagctgaatggaagaatgagtcttgttgataaggtcacttgctgttggcattgttctttttagcggaacgagtagcttatgaaacacaatcgcatcatttgaatttcctctaatggcaatttttttcctgtaagcttagatcactatgggaagaggctatgattatggtccatcaccgccaagagaatacaggagaagagcccgcagcccaagtcctcgtgggcgctatggaggccgtgacagggatctcccaactagtcttttggtgaggaatcttcgccgtgactgtaggtaagtttctttgcaccttggtcagtaactgaatgagtgttttcttgttaagtaacacatgcaatcacacattccggttacactagttgtagttgagttggtgcaattcatcatcatttgggccaagataatgtctctttataaaattataatactactgatgtgcattttttaaatccgtaaattatttttcatcttgagcttctattgcatacagctcatgagcttggtttgcaatgccaaaattcatttagtcatcacttataaaccaaagaagcattgctttggcgcaaaacagattggagtgtaaatctaaacattgttcttctgttgtaatgacataaggcaaatgagtaaatgtttgttgttttcctaaggattttttttgtaacctgtgttattattgtcatctgttggatattatatatttgatttacagaagttcgtaactgtaaggatttctcgccttttcatgtcttttaatttcaatgctattttaccactttctccatgttgcatgtctttaccttagacataattatgaatacaggcctgatgatctacgaagaccatttggaaaatttggtcgtgtcaaagatatatatcttccaagagattattacactgggtaaggcacctcaactcaaatagagccagtgttcattttcaactggaggcctacatgctgtttagggatcaaaccatgagatgtttaggatgctgtgatattttttcaatccagtaatatgctatttttggattcatttgcaattggcttaaacatgtgctttggaaatgtttgtttgtgctttagtacatttggtacacctaaattgaatgatttttgcccacctcttaagattaactgtgaaaataattttttgaagacacaagccttaagagtactctgttgaagagaagggaagaaatagagtataagagatatgcaagttatgaagagtttcaagtctatctttaaactctgatgagtacaaggtcagcagcctagtgcttgctttatctgttgaaaaatttgtgtatcaacatccagggaaaggaatcaaggttcaaggatatgaataatcaattgttcctttacttgactaaagtcaagtatccttttcaggattttcttgtatactgttcagaattgtgcaattaattaaagctaaatcttgttatctgtaacagggagcctcgaggatttgggttcatccaatattatgatcctgaggatgctgctgatgcaaaataccacatggatgggcaaattcttcttggcagggaagttactgttgtatttgctgaggagaacagaaagaaaccatctgagatgagggctagggaaagagtcgggtattgcactgctctctttcatcctttttctctaatgttttttgttttgttaaagtattatctcttttgtggcatatgtaaccagtttgttcatcttctgcagtagcagggaccgttcttatgatcgcaggtcgcgctctcctagatactcccgctcaaggtcacctgtgtactctccaagatcacggtcccgtagtcgaagctactcacctgcacctaagagaaagcactattcaaggtttgacttcagtatcctccatggacgtttatattagtttattcacaacaaaatcattcacatgttttaccatcttagcaggtctcctgcccgtcgggagagatctctgtcgcgctcaccagcggacagcagatcacgaagtagaagcctctctgatgaccgccgcagcaagtcacctgacagggagaggtctctttctgttagccggtgaggagcttaggacccaaatgccaacggggcactgggttgaaccatgtttcgatgatgactgcttcttgttactaggttgaaccatgtttcggaatttttaggccatcctgatcttctaggaatgttaatgatgtgtggtcttctaggatttccttttcattgttggatcctgaagataaaaagtcgaagcatcgaacaacttatcatattctttgacctcgtgcccattttaagtgactggttattgccttttgtggtcctgtaacgttaccaatgatttccccattggcgagcaggcattgttaatgtaagaactcaagtcaggattactagttgtctcaattctgcttttcatactcatcatctggaggttattttgttggttaataagaacagttttttttctctgatacaaacaatgtacctggagttaaaatcggtatatactcgagagatgtgacatgtggcaatcttcccttcttttggtgccctttagatctggaatttctttaaggaaccaagatcattgcctcacaaaattagacctcacaaaactctgctattcacatgatctcctggtttgtggcggcactgattttgttttgttcctcgcttagacgcgtagtcgtagctttcgcaaacgtagctgaggatttggatcgttcgcaggccgaaaccaggagacgatgaacgacgatgcaaatgccaattggacggcccggcgctgatgcagttatgcttatgcaacatatgaatgtgatgagcgcaaaatgatccactgctaaaaggaaatttatacagatgttgaaaggtcaattgagaagctggaaccgaccatgaccgcgcatggtccagtacaatatagaaatagtagcacatcaatgggttttgaagaaagaaaaaaaaaagaactgggatcagtaataggcttataggcgtgccaactcacctcaccttcaatcaagtactctacagaaaaatggtacttcaaccagcaaccagtgtagtaaaatggtcggtaaagataatgtggcccagcaaccagtgtatatgtaggagcagcttggagttggcgaggatttggtcggcaaaaggaggccaactgccggtttgaccacggagtaataagcactgcattgccttctggttgatctcccggtccttacgagtcaagcagtaaactaatcttttaatcagccggcagcttggccacggttaaatgtcctgcaaatttcggtcgcacgtaggagtagctgcctagaaagagcgtgttgactctccaggaaaggcaacaattaattaagaagaaaaaaccgaattaattgccggacgaggtttccggtcagtttcatcgatatcccaatccaggacaccatgcaatgcaactaacttctccagcagtcagcagcactgcgttgggtcgggtcgtccatgtgacgcctcattcccgatagtcatagacagagatatcatatccacttacacttgattagctgtaggatctgaacaagaacatactaggtaaacagttaacagtcctgaccacctctgttcatgccccagaagaagaaacattgttcagaattttattttctgtacttgatgaaagcaggttacagtgtaatcttccttttttatatagaaaattttgacaacaaattaatccatgatcacacgtatatgcacaccataatctcttcttggttaggtcatgcccaattgtccatcgacactaactcattgcatccacaaacgaatgatgcacatggattactgcttgctggctgcctactgttctacttcagctgttttgctggtgacaccgacaagttcatgattctctgcaggaaatcagtgagaatgccgatcgaagcacaatccatgacatgacatggcatatacgagcctgattgattaccatctagaaaatatgtagttatcatacaaatatatgcggcttgggtctctttaattacgatctgtaactacggtttcatatagcagcagggaaagggcaatgcgtatcatgtcagggttatcagccacccatcaaaatcaagccagccatgtataattgtatatgaagtgtatttctttcaaaataataataataaaatgtatatggagtatatatatacatgcatacatgtccgcatcttgatcgatcggtgcctgtgattaattcaagatcacagaaaaaaaaagataatgcacagtgtcagcacagctggaatagttgttggccaagctggattcctgtcaggtccagtttacatcatctctgacaccctttttaatcgatcaataattaatgttacttagtactccctccattccaaattaatctacatatagttttttttgaagttattcctaaatgatctacatatttgtgttcattcattaagtctattcgttatttgtacattggagtaaatggacattgatgcatgcatccatgcatacaagtatttataacccacatgtaatatcttgatttgctattggctaggaaatagtgagaatggtgtatgcatcgagtttgttgctagagtaaatatagtatgagagatttattagtttttcttggtcttgatataccatgaaatatgtatatcaatttggaatgaagggagtagtaccacttaactgaggaggaggagcgtgtaatgctgcttaattatatagagcagctgatgcatgtgaatatattgatgtttttgtttccgagcggatatattagatgatttgactctctaatccaatccattaattttgctcagatatccaattaattcatgtttctttcatcaggtcaagctaattaagtattctctctatatctcaaccatgtcagtatggttccaagtagttgtggtactaaacaaatggacggtgatggcatcagtttatttttttaagctaaaaatcttaaatgtaaattttaagaacttttttgacactccttccattctaaaatataagcatttctaaagtttcatgtgaaaattaggaaagcaagtggatataaattgtaatggttgtggtgggttgagatgagaaagaagattgattgagatttaacatgttatattctgaaatgagtattaaatgttcgtatttgttccccgcaaaaaaaatattcgaatttgttatattttaagatggtgtaatatatttggactaattatctacttatacatatctaacctgcactaattgaataaataagtgaccaagatctactagattttatctcgatcctacgcgatatagaaaaacatgagtttaattagtttggatgtcaattttttcccttagaatcataggaacaagaaagctttctactccatccgagccctaaatataagagattttagttggacgtgacacatcttattataataaatctggatataatcatgtccaaatacattgtactaagatgtgtcacatcaaaccaaaatctcttatatttaaagataaagggagtatatttttcttttcctcattctttcgaatcaaatgcatgaacgggaacctttcctagtactcctcccgtcccacaaaggaggtcattctgctcgcaagcaaatgtcccatattttttgacattgtacgctgtacttccccaacagcacacagttacgaacttctagaaaaacatccataaaaatgttttgaattgattggaccggttacattagtttaatccattaagtagtagatgtggtagttcattttcactcaaaactaatttggctcaatcattctagaacgtccagcattttgagacggagggagtatatgatttcaattgctctttttttcctctactttttgtccaattcaaatggtttaaaagggggtgtgtttagtgagaataaccatggtttatatgcaaataatttaaaacgggaagtacatcttgaaaagtgtcacgcgtactagtagatgaacactacagcgtccatgtcagctggccgccggcgcacgtgggagtttgccctagcggtgtgacccgtacaagcgtacgtacggacgcacgagtgcgtcctagctacacgcaggctagcagctggctgattaattgggcctttaaatgcagtaacctacgaactgtacccatctttgaccagaaatccccgaacattattactccattatcttcaaattttccaacaacagtagtaagaatgcaagaccgacagtagtcaaacgaatatgcagtacagcaagcatagacgacttcaggtctctttaatttaacgaaataggtagcacgttttctttaaacgattccaatcactcattttgccattcctaaaacagcatgattattaatgtgtaaaattaagtttatcaatatgttctttccagcttcctcttaaaaaaacttcctccgtcccaaaatataagcatttttagaataatgtaaagacgaagatttttaactttaactattagtagaaaaaagtaaaaaaaaacatcaatcatgtaaaattgatgttactagatgtatcattcaataaagtatcataatatacaactcattttatttaaaacgtcttatttttatagatattgttgatcaatgtagcatctcaaaaactgtgtcgaaatctaaaaatacttatatttgggacagagggagtatcttctttttagctatttactatttttcaaatatacaaagttgttaccttttgaacatcattgttgcacaatcgtcttattaaaaataattatgtaaggatcatctattttgttttgaattgttttataattaaagttattttaagcatgatttatattttttaaatattcacactaaattttgaataaaatgaatggttaaacattatgttcaaaagttaataatattatgcatttaaaaacataaggagtgatatatatattctacaaagtaggaaatgaacatactatatcatcatgatgccatcaagctagctaattataacatgtaagtaatcattaatttgcaccataggactattgttgacacgctttattttatcattaagttcgtacgtaaccggcggatcgacgtagactcaattcaaaccttcattaaatttaaaaaggttatatatccccgttttctctccctaatccagtctgtcatgtgcttgctacttcttgatacaatcgttcgtaaagtgcaagtttagaagatcctccccacttaaattaattattatatcatgccgaaagaacttaattagcagggcacacgttgtttctaggcaagatcagcagcatttcataatatatatgtgcatgcatgcatatatgtagatatgtcagtgtcatgacactgaggaagctagaaactctcacttataattccaccacacaccaaaaccatttgtctcatcgatcagtcccctacgccatattaattgttaaaatgactttttgacctaaatttgtggtccaatataacacacattatatgaatacaaaaaacagaaataatgctgtttttaaaataaaatgttggcagaaaaacatgaaaataaattaacaatgggattataggatatttcttagatccttcatgtgtctaaaaccctagtcgtcgccacagcccacaggaaaaacaagctaggcctaacaacagcaacactagtgctgtacatatataattatatatttattcatgctgccaaattaaactagatgcatgtacattagctaggttgtgcgtgtcggagcccataaatccctctgcccttcgcgtgatccaggtagattagatttgccttgctgctgtctctcatgtgcaccgaccccctgtctgattaattaatttattactaatctataatataaaatacttctcaatttatataatattataaaatcgagtatcctgaactaattaattcgtccaaaatggaagcttccacggaagtttcttctgtgttcttctctccttggacgtactcgaccccatgcgattctacgctagcagctgggagatcgagagtatagcagtttttgctacgtcatcgatgaccatgcattaggctaactaataatcaagccatgcattggttagctgattaatttcaacgcatgattaaattagcgtcaagaacaccctggcatttcggactagaaaactgcatatcatgttgctggttaaggtatatatcatcatgctcccaacggagagtacggagagatgagcgattagatcaattaaacagggtgctttcggtgtcttcttcttggataatcttggcacttttctgcataattaattgttagtgcatatatgtatatgtatttgtgtctgtattttgtgatatgtttttgggctcggaggttgtgtgccgtcgggctggtcagcaattgcgttcagagggcaacgtcttagggctttctttttcgatgaataatttatctaggtattaatataattccttctgtcttgtgcctgtttaattccaagagacatttagcatttgttgtttgttcctgctgctagctttaattactctgcatcattaatacggtcccagttttgttggcaacactggtattaatacgcatctctgtactctatgattctctctatctttgcactgggattaattatgagagcatttcctgtggtctaggggctgagtataaactctcagcaaaatgtcatgaatttaggagggaaaagaatgtaacgaaggctttcatccactagtcatcataaacttcagcaaaaacaaaagaaaaagttcccctaagaaattaacccgatatgaaatgggaaaaattttaactgcagtttaatttacagcctcatcgtttgggataagccaaatggcatatttgtaaacgaaaaaaaatttatgaataaaaattttatatatgtgtttttaacgatctaaaatcaaaggttgaaaaaataaactacgatgaaaaaacccccccaaaatcaactttaaatttaaggttgaaaatttaaattttaactgatgagcatataagcataagcgaaaagatgaggctgttattgattttccttgcacaagtcatgaatatacatttgatttgattttttttcctggagttatagatgtcgcaattatgcattttaccaaaattttgattactcgctgtaaggtatttttatggttaatttagtaccctgttgaccatgcttagttacaatcttgttgcagatctgctctatgatgtgctaacctaagtaggatgcacccacatttgggtttttgcttggagacctagcaacattgaaggaaaacaaaattgtggcagtgtccaatttctcaactcatggcccatggtgtccacgtagacaaagaaatatataaaggctgtgtttagattcaaagtttggatcgaaacttcagtcatttttcatcatatcagcctatcatacccacataatttttcagtcacatcatctttaattttaaccaaaatctaaactttgcgctgaactaaacacagccgcaccgtccaaatttctcgacaaatttggagttttggactgtcagtccatcccatttttgagtctcacacggcatgggcgaaagtaaccgaccgaccagcagcgctcaagtcaatttaagcaaaaacaagacaaactgtagccatcaggccatggcgtgccacgtgccacctagaatggcaaccacgtcatcaacgtatatgcagtgacgtgtccatatacagttgatttgcacgataagagtctcatatacaagcaaaactaacgaatatgtttgtttgcgtaaacatcatacactgaccatttctattaggcgtaaaccaaaatcaacttccgtgtacactgatgaagagaaaatggaatcaaaatctagcaatgtggagtacgtacggtaaatagatcaaattcaaggacaaattctttcgtatactagaaaaatgtccgtgcgttgcaatggatgaatgttattttaattttattattgttatacggtttaggtagaatgaaatttactgtgttaaattcgcttggatagaaaatcatgagctgcaactaggagtccgatcgtctcaagttagcatgcgaatttttttaatgagatttcttatgcgactccttttgtatttacaaaagtgaacgaacttaaaatccgactcaaatatggatctgtgttttcaaaagcgaatgaatttacaaaccgattcatccacatatgacgtaccaaagtaccaataaaaatatcttcaatttttataatagcagagattcgtatatatagttcctatgataggctatttggttggtgtttatagattcttcttttataatcctaccaatctagcctagaagtaaaatttactactccttccgtttcatattatgaggtgtttgactttttttagtcaaacttctttaagttgtctaagtttgtagaaaaatatactgatattttcaatacaaaacaaacatattttcaaaatgtattcaatattaaatttaataaaactagtttggtattgtagatgttgctattttttttctataatcttggtcaaatttaaagaactttgtataaaaaaaagtcaaacagcttataatattaatcggagggaatagttaagattgtttatgaagtaaacatgccatctttgggcaatgcacaacacgaactaagtgaatcctaaccatctagaagtaaaattgattaaattcaaaattgctcaagtaaatatgtcatctttggacgaagcacaatacaaactgaatcgtacccttctagaagtaaaagaatttactaatccagattgcttaccaagcaaacatgtcatcctcagatgatgcacaaagtacaaactaaatggatcggataaactgtaccttttgaatccgtccataattaacgtatcacctgtcgctgccatcgtctctccttgtcgctgcaattgactttcagcatccttcctaacgaataaccatgcatggttacaagaaattgccgcgtgtatgtcattacctttagctaattaagtcccttcataagctttggtaaattatggtgaaaaggtccagcactctgaaaaattccatcaagaacatcagtaaacagcatttgaatacttaaaactgaaatatgggctacattcacactcgatttaactatgttgacggagattaagtcagctgataagttttgccagtcaaagcgcaaatatttcgagacgaaaatgactcatgactataaataatcactccacaagcagagtagtagtagtagtaacattatttgaccaaaccgaccgacctatatgctgattcagattgcttgtgtttgtcattttcctcgttgctctgaacttctacgtgtaaaatccatcggcattgccatttcactttcagtgcattgtagaggaaaaacaaaatcaatccaactttaaaacaggtcctgcctgaaaacgtcaagaatttgcaaagaatgtgtaagcagtaactgtacagaggcaaatattcagacattccaagcagaggctcttttgctgtacaagcaataaccgtataccagatcagtagaaattcagacattccaaacaagctagtatttgcagtaactaagaattttcagaagaaagaaatagtagtaaaaaacacgagcagatccatggctagagaagaggagacaggagagaagaggacaccacctacccaaacagcgtcgtcgcgtggtttgatacacgctctcacctcatctcatctcgtcgccattgacagactagcgccggcctgtccagtgccgatgccgagtgacacacctgcctgacaacacgtacgtacgtggaaatcataaacctttttttttattttatttagtttcttctcgccaccgctcgccttcgccgagctccctatatatcgccgtcgtctcgcactgcctccatcggatatccagctcctgcagccaagaaacactcacacgcacgcacaaagcgatcaggcaccttttgttttgttgctttagaggttaattacaaacaggaggagaagatcctagttgtctagttgaaagtgaggtgagttcttgtcgttttgagtttttgatccaatcttgttagtgaagtcgtgagcttgttgtttgtttggtggtgtttgttgctattcttgttcttgaaatctgaaggtgttgtgtttggttggattaggtggtagagaaagagagagatccgggctgcaagcaaatgggcgtcctcttctcgtgccccgtcgatgactacgacgcattggaggagagcgccgcggcggcggcggcggcgtcgtcggagtcgaactccggcggcggcaagccggcggcgatcctgaaggcgttgggatccgggaagctgctcatcgaagggtcgctcagcttcaagcgtgaccagcagatgagccccacctccctcctccaggtggagaccgagatctccatcaagcctgccgccgccgacattgccgccgcgccaagggcgaggttcgccgccgacggcggcgcggcggcggcggagagcccaaagcacgaggcggcggcggtgaagctgcagaaggtgtacaagagcttccggacgcggcggcagctcgcggactgcgccgtgctggtggagcagagctggtggaagctcctcgacttcgccctcctcaagcggagctccgtctccttcttcgacatcgagaagcaggagacggccgtctccagatggtccagagcaagaacccgagctgccaaggtaacaacactgccttttctttttctttttctttttctttttttaccacctgcagtttgtgtctctgagtaatttgatctgaacatctttttgcaaaatttggctgaatttcaggtcgggaagggattgtccaaggatgaaaaggcacagaaactcgcattacagcactggctcgaagcggtgagtactgagttacaagttgaatgtgtgcaaattattcagtttttttttttttaccgctgtgttatcgttcaatgagctaatgttgcaaatgttcagattgacccgcgccaccggtatggtcacaaccttcactactactatgatacctggctccactgcgagagcaagcagcctttcttctactggtcagtatacttgtcactcagatatcacagtttcagactgaatagaaatgttagttcatggatcatgatcctgatttgattatgtaatgcaggcttgatgtgggagaagggaaagagatcaatcttgagggcaagtgctccaggtcgaagcttttgagccaatgcatcaagtaccttggtcctgtaagtggttgcaaacatgatgctaagaattgctagagttagaacatcacgaagttgtaaagtggctaacatgaaaaaactgaaattattttgtgcagaaagaaagagaggactatgaagttatacttgaggatggcaagttcttgtacaagaaaagccggcaaatcctcgatacctcttgtgggccaagagatgcaaagtggatctttgttcttagcacatcaaagagcttgtatgttggccaggtaattttcacatatcttgtgtcatattggctaaaactattgccagccttagaaatgtccgttcattgtgtaattttgtttttgtaatctcaaatgcagaagaagaaaggcaaatttcaacattcaagcttccttgctggaggggcgacttctgctgccgggcgattggtggttgaaaatggaaccttaaaggtatgtattgtttatagtcagtccattgaacaacttgttcatcctttacaaagaactgggtcatgtgttgagttctagttgcagacaaaatgctgacacaatcatgtttcctctttgtctgacaggctatttggccacatagtggacactaccgcccaactgaggagaacttcgaggagttcaagagcttcctgaacgacaactctgtcgatctcaccgatgttaaggtaagcaagcacatcatgtaaattcagacagaaactgaaaaagaaaaattctcaatgctgcagttatcctgtaaattttcaagcaaactgaaaactccattcagctgtgaatttgtaatctgacatccttttgaattggtgcagatgagcccagcagaggaggacgaggaattctggggtagcctgaaaaggatcagttcagagagctaccccaagaacactgccactgacaactctgaagaccaagccgctgaagctgaagaaaccggcaattcccagatgcctcgagtctctgacgaaccaacctgtgcagagatcgacggctgcgacgaaccggcggcgacgaggagggtagattcgtcgtcagctgttgctgctgctgctgagaacactgaagccgaggaggaggatcaagaaggcggcggcgagcaggcgccggtgccgagggagaagatcctggagaggatcaactccaagaaggggatgaggtcgtatcagctcgggaagcagctctccttccggtggacgaccggcgccgggccgcggatcgggtgcgtgcgcgactacccgtcggagctgcagctgcgggcgctggagcaggtcaacctgtcgccgaggagcgccgccgccgcgtccgcgtcctcccggttctcgtcgccgcagcgccggagcttcaacggcgcggcggcgcccgccacgccgagggaggcgctccggccgtcgcccctgcagcatgggctggtagccaccgtcgctgcggctgactgatcatggacggccttcgccgtggaagaagaaaaaaaagatgaaacttttgccgagtaatttgtataattgcatactaatttaaattttagtgtagatcttgtagaacaggtaatatacattaattacatatacattgatatagtactagcaaagttgtttgacatagtgtatatatacaagtttttttcattcttggaagaagttgaccacaagtgcacgaattgatatgatatatgttccaaaaatacgaatgtatttacatgcccatatgttaattaaattttgatatccccgcaaaaaaaataattaaaatttgacatagaaatagcgatttctgaattgaaattgaaagaaattaaagaactgctttgaagtctatatagatacaatatgaaaattttaactgcaaatttcaaatatatagagaaaaatgtttaaatttatttgtggggacctcctcaaaagagtcggttccctccaaaaattagcgtatgctgctaattgcggcgcgcacacggtattctttagtaaaaggcgaaagaatagttcgctctgtgctcaccgcgcagctgcgtgagttcaagcgttggcaccagacccctatatatagcagagctccctaaggcctccgacttggttaggcgaggtgggactaaacgagcagagagcactctactgtctaactgttcgccctgcgacagccaatgcggcccagatgcaaacgggaggcctacatgagccgcccaacctgtaggcccaaaagcgaaggcatcatgctgaaactggaggaaacaagaacagtaatggtcctttattatgttatttttttgtatacaaagcatgagaagagatctcgtgagaaatgatcacggccaattccaataacagaagagatctcctgtttttgtataaaccatgggaaatggtcacggccaattccaaatccaagtgctacggcagtaccatttcccatggcacagtatattctcgtcgcaaaatgaagatatctgtatatttgccaaagaaaaggaacaaagggagaaaagaatcgacattttcacgaaggtgaagcatgcagacatgctagtacacttgctgcaagatcacctagtacagacagacaccagcaatcactagtcagttgacatgccagtgctatcctctacattcccaacccaacagaagccagacgaaaacctctagccaacaacagtgcacgcaatgaatcaacaaccttagttagggcgtgtatttgagttagacaggtgcattcaccttatgcaattagcctacctacactacacctcttcttccgctggagaaaagcagacgagagatgaatatcctactttctcagtttctccctttctgaagcagccgtatgtactttgtccctgtagaacaacgccgtcatacaacatcatccaatggtacaggccgtgatggggagcgctcttgatggggattcttgtggccagtagatatgccatactcttctgttaaaataccttccgactcttttatgtcattcagagctctcttggcgtacaccgtgaaggcgaccgtgaggacaacagcgatgacgaacgagatggcgttgtatgttatctccaccggtgtcatcttgtagttgccatacttcatgtcagccaatgtgcgtatcaaccgcccgctgcaccaaaacatagaaagatgaacaatcaaaagcgcatcactgaacaccatacctagtgcacttagtaactcctgaaagaaaattgcatgtgtcggtgacctgcattagttgattaactgcaagtgtatacactactgaattgctaaagttattgtaaagatagttatcctgcacagataacttttcctatataatataaatttactcttttataataagttatcaatcacaaaccttctgacatgttttcatgtatatatagcttgcaaaactagtatatccaataccgttttactggtgagcttatgcttgaaagagcgattcattaaaaatcagtgactaggtgcactattgttgacaacatgataaataaacagcaatggaatacagtgagtgaggacatataggtagcaaaattggatgtctgcagattggagaggtatgtaaccaacctataaatatagatgaacgcctcgggtatcatcccagcaattgaaccacatagataagggttgaacttgatttctgtcacagttacagcgtagttaaaaattgtatatggaaatggcgagattctgaatagtgcaacaactctaaactgctggaaccaatttccttccccagcaagttttattagagctatctgctgaggccatctttttaaccatgcctgcattaaaaaatgtagagggaagaagagagcagaaaattagggcaaagctccttcaaaaaagatgcaggtcctaaaatagacatcacaagaacatgcagttcagaatttttacatgcagacgttcgcggaacaatgagccaatccaatatggaaccaccatgcctatagtagtcccaaccataataatcaagaaaccccaaccatagccaaagatcattccagctagccacatggaaggtccagaagggactaaagtaactgggaagagggctaaagatgcaacgagaacaacagccaaaactggacgcccaaaggcacttgcttcccattgcatgattggcaagagaacctacaacaaacagatcttccaacataagtccaaacaattttctggaaaatgaatatgattaaaatgttactcctatctggcacaacatggtacaaaaacaagagataattgaaaattttgtaaacttgaaattaaattgcattgtgacagccgtgcatccattaaccatacattcatctagcattccaactggtgtgcataaactagggtatacatgggaacatatggactagtcaaactatcaatcaacagtttgaaatttcataagcagaaacctccactaatgcatggtagtggaggtttcataagcagaaacctctgccgacaaaccataaaaagaactcaagtcaagatttcagtacttggtcaacctatgaacctatgacaaatattacccttgatgctcaccttctcgaaggcaaaggggactccccatttcacgaagacataagatactaatataagaaggaagcagccaagcagaactttcatccaccaaatggaccttgaggtaggttcttcaggtaggactaccgtgttatcatcagctattacactatgagctggtctgaccagcctttcatattcatcatcctttgtgttttgctcaggttgttcgattccgttgcctgatgccactgcggaagagcttggcatgtctgtaactacctcttcacgtctgtttacaaaccaagcagattagaataagaagttactcaaaacatgtaacaaattttatcaatttatctcattgaagtaaagatgccatgtgcttgttttgttttgtgtactggaaaagcatggaaattagttgtatggattaaatctaaccaagatgtgcaacaaaaattaatctgatatgctcacattcacaagcatggctcatatctttgtcatttgatctcacattctgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcatggtatcagagccgaccggccggcggcaggcgacggctgaaccctagctggccggaggcgtggaggcttgagcagggtagagagtgcgcatcagcagcggcgcggaagagcggggccagcgcggcgcgtcgaggaggaagaagccgagcagctgcaggtgcggagctgctgctgctgcttggggctgagctcgcaggtgcagagctgctttgggctgaggcaagaaagaaagtgctggtaaacagctggtgttggtgctcctcaggaagaagtggctcttgctctgtagtggcggggtcacagcacagtgaagactttgcatctcttgtgggtgtgtgattggcaaggaaaccgagataaaagcacagctactgcttttgtgatattgactatttgagcaatctataggaagggaaaggtagaacagggggctcagatctgctagttgggtttctactggtttgcagtttcagaatttgcattatggcagaaaatcaaggaatagaacaagtgatgggtaaattggtggacatgctagcgaaaaaatttagtgaggcctcaactacaagcaatgcaattatccctcatactgaatcaatactgaagattgagttaatgcaaaacgaaatcaagttggagggtgtcaaaaattatttgagttggtcaaggagggcattactaatactaaaaacaaaggggttagaaggatatgtcacaggagaagtgaaggagcctgagaacacatcaagtgtagaatggaagacttggagcactaccaactctttagtggtggcatggttgttgacttcattaatcccagctattgctacaactgttgagactatctctagtgcgagtgagatgtggaaaactcttactaaactatactcaggagaaggtaatgtgatgctaatggtggaggcacaagagaagataagtgctttgagacagggggagcgctctgtggcagaatatgtcgcagagttgaagagtttgtggtccgatttagatcattatgatcctcttggattagagcactctgattgcatagcaaaaatgaaaaaatgggttgagcgtagaagggttattgagttcttgaagggtctaaatccagagttcgaaggaagaagagatgcaatgtttcaccaaaccactcttcctaccttagatgaggccattgcagctatggcacaggaggagcttaagaagaaagtattgcctagtgccgcaccatgttcaccaagtcccacctatgcaattgtacaaggtaaagagactagagagtgcttcaattgtggtgaaatgggacaccttatgcgtgattgtcatgctccacgcaagcctacttatgggagaggaagaggtgttgatagaggtggaacaagaggtggaagaggctatgctggtaggagcaatagaggaagaggttatggatatagaggtgattacaaggctaatgcagttactctagaagagggttcttccgggactacacctgacaatgttgccaactttgctcattctacttcaggtagttttaatcaagcatttatgtctatgaacacttctcattcaagttggatattagactcaggtgcatccaggcatgtcactggcatgagtggagaatttacatcatataaaccatattcatttgcacataaagagaccattcaaactgctgatggcacatcatgtcaggttaagggggagggcatagtgcaatgtactccatccattactttgtcatcagtgttatatgtccattcttttccagtgaatttaatttcaataagttctcttgttgataatatggattgtcgggtttcccttgatcgtgagaattgtttaattcaggagagaagaacagggaagaaacttgggattggtatcaggcgtgatggactttggtacttggacagaagagggacaaatgaggatgtgtgtgcactaatggcttcaacaagtaaagaagtgactgaggtattacttttgcattgtcgactaggacatatatcttttgaaattatgagtaaaatgttcccggtagagtttagtaaagtggataaacatatgctgatatgtgatgcatgtgagtatgggaagcatactagaacatcatatgtgagtagaggacttcgcagtattttgccctttatgctaatccactcagatgtgtggacgtcgcctgtggtttctatgagtggaatgaaatattttgtcacctttattgattgctattcccgcatgacatggttatatctcatgagacataaggatgaagtgcttaaatgcttccaaaacttttatgcatatattaaaaatcattttaatgctcgggttcagtttattagaactgataatggaggggagtatatgaatagtgaattcggtcactttctttctttggaaggaatattacatcagacttcttgtcctgatactcctccacagaatggagtggctgaaagaaaaaatcgccatcttttggagatagctcggtcactaatgtatactatgaatgtacctaaatttctatggagtgaggcagtaatgacggcagcttatctcatcaaccgcacaccatcaagaatacttggaatgaagacaccatatgagatgatatttgggaagaatgaatttgtggttccaccgagggtgtttggctgcacttgttttgttagagatcatagaccatctattgggaaacttgatcctcgagctgttaaatgcatctttataggctattcatccagccagaaggggtataagtgttggagtccatcagaacggcggacatttgtaagtatggatgttacgtttagggaatctgttccattctatggtgagaaaacagatataagctctttatttgttgatcttgatgatttaactagaggtgaccatgatcaacaaaaggaaggtgaaatcttgggtctcaaggagaatgaacaatcaaagggaaagattgtggttggtgaaattccatgtgctataggtgatcctgtacaagaacaagaatggagaaagccacatgaagaggaaaatcttcaagtttacacaaggagaatgagacttccaacaactcaacaagttgaagttgatgatcaagtatcagatgatcttactcatgtgcaagtgtcttcggagtcagggggagaacaaatagaaattagagaagaagaatcaaacttgccaattgccataagaaaggggatgagaagcaatgcaggcaaacctccacaaagatatggttttgaaattggagatgaaagtggtgatgagaatgatatagccaattatgtatcttacacttccttgtcatcgacatacagggcctttgtggcatctctaaattcagctataattcctaaggattggaaagaggcaaagcaagacccaaggtggcatcaagcaatgctagatgaactagaagctcttgagaagaacaaaacatgggatcttgtatcctatcccaatggaaagaaagtggtaaactgtaagtgggtatatgcagtgaaacaaaatccggatggaaaagtggagaggtacaaagcaagacttgtggctaagggatatagccagacatatggaattgattatgatgaaacgtttgcaccggttgcaaaaatgagtacggtaagaactataatatcttgtgcagttaactttgattggccattacatcaattggatgtcaagaatgcttttctacatggcgatcttcaagaggaggtatatatggaaattccacctggatttgctactttgcaaactaaaggtaaagtattgagactgaagaaatccttatatggtctcaaacagtcgccaagagcatggtttgatcgatttaggcgtgcaatgtgtgctatgggctataaacaatgtaatggagatcacacagttttctatcatcatagtggagatcatataaccattcttgctgtttatgttgatgatatgattatcactggaaatgattgctcggagataactaggctgaaacaaaatctaagcaaagaatttgaagttaaggacctaggccagttgaaatattttctgggtattgaaattgcaagatctcctagagggatagttctttcacagcggaaatatgcattggacttgctcagtgacacaggtatgcttggatgtcgcccagcctctacaccagttgatcaaaatcataagttatgtgcagagtctggaaatccagtgaataaggaaagataccaaaggctggttgggagactgatatatttatgtcatacacgacctgacataacttatgctgtcagtatggtgagtcgatatatgcatgatccaaggagtgggcatatggatgctgtctataggatcttgagatatttgaaaggaagcccaggtaaaggcctatggtttaagaaaaatggacacttggaggttgaaggctattgtgatgcacattgggcaagttgtcctgatgatagaagatcaacttcaggctattgtgtgtttgttggtggcaatctagtatcttggaggagcaagaagcaaccggtggtgtctcgctcaaccgctgaggcagaatatcgggcaatgtcagtgagtttgagtgagttgttatggctaaggaatcttctttctgagttgatgttgccggtggatactccaatgaaattgtggtgtgacaacaagtcagcaatcagcattgctaacaacccagttcaacatgatcgaacaaagcatgtggagttggatcgtttctttatcaaggaaaaactggatgagggagttttggaattagaatttgtaatgtctggtggacaagttgctgattgtttcacaaagggtttaggtgttaaagagtgtaatagttcatgtgacaagatgggtatgatagatatctatcacccatcttgagggggagtgttgggctgtaaatacaacagtatgtgtgtgttttatgtgctggcccatctgctagaggcccatctagtcatgtatatgtaaataaggatagcaatacagagaaggtgaagcttccagagaaaattggctgccaaaaaacttcacattctaggccatgataatctacatggcttttccatacagaacctggtaaaatgaggacgacgataaaatgaagtgctagatttcatgaccgaacagagaatgtacatcgatctatagctcaatcaatagatgccatcggggtgctacatttggacaataaagtgcagtaatccctaaaactaatgcaataactgcatatctattctactgaaatacaggtcatctttctcacaccacagcaatgtggcatgaactagacaaaacatttgacatgtgacaatccttgatctaaaatttgaataaccaggtcaaatgttccagttcgtatttttctatttgtttaacacaatacaacaagtatacttaatttacatatctagtcaaactgccagcggccaatttcttcccagtttatctgcagtactcaacaccctacaacattggtttcgtaaagagcaacagacagcactcaatcatgacactccatctttccatgcgaaatactgctataactagaatttcagatatggttttaagctgtaacagtaaaaaaaaccgatgttataaacatggttaagcaagatttcccaaaatagctcccgcttgagttgcaacgattttgaaagaatcccaaatggatcactccatgctcgctgcccttcttgctcgttcatgtgccacattggcctccaaaaaacggggcgtaggtgaagaaacagttaacaacaccccgtgagtcttgtgtccgtgtccgtgcatggtactgctgcgaggggaacatcaacccgtgcccatcacacatcacagcgcccgtgaccaaaaggctcaatgggctctctaatggcggataagcggcaacgaagaacaaagtgcacgccacagcacgcataaatgccacttttgttttcctcttggagtacggaaaattgaaagaaccgaataagcccaaaccacacgccatgacgcaatgctattgcactttggtgggagaacgcaaccgacctcgaggcttaaaaccaacaaccacacccgcaatctttggcatacaaaaaattctccaaaattttcggccgacaaaaattctattttgaatttgtaaaagaacagattaacaagaagcctcccaaacaaaccaccttggatgcatcgtcggctccaactaaacccaaactccttttttctcctactaagaaaatcgccaacacaccaccaaacttcccctttttttcgaaggaaaaaaataactccaacaatctgaacgcgatgaacaagcaaacaaacagattgcagcgagagctcggggaaggaagaatacctgggcatggccatctcccccgcctcgatgctgagggggaggacgcgtgccatggagagacgaataccaaagagagacgcgtggtttgcctttgcctttggcttttccacctcctttctcctcccctttctttctggaagctttgcagcagcggaggggggaggagagacgaaagcagcagcagcagccgcgcggcgcacacgaaacgagagagaaaaacaaaaggcggtagtagtagcagccgcggacccggcgaatttaccgggatgcccctgggtggaggcgaggtgggcgcgacgccgtgagtgaggcggacggaagacggaactggccctgctcgcacgcccgggggaagggggaatattcgtcggcgcgcgcgggggcgtggagtcgctgacgaggtgggcccaccggcgggggggcgggggtcgaggtctcggtctcggtgcgttgccgcgtggtgacgcgtgtcggggggtggctgccgggtggggcccggccgggattgcttccgtgtgggttgtggttggttgctgggtagttgcgcggttgctgctcctgctagtactggtcagggttcataatttccacgaaaactgatggagttttacgaaatttggatacagcttgaaattaagtttcgattaaaattttaaaagttaaacagtatatttggtcgaatttcagttgaaatttatcaaaaaccgattaaaatttatcaaaaatcgtgatatcaataggactcgaaatttagtagtcagtcggtaatgttaatgtaaatcctggtactagtttccccatacttcgaagggaagcagagtagttaaatatggagtcaagttaattaatgggtcgtcattttgtcttggtcaaaccatgctagctgctgctgttgtcgtcgttaaggttttgctttgagaattcttcgcttctagagcagcaagatgtgttgttggacggcttctagaattgacctgatcattttggctggattgctgcttggttttattctaaagtaaaagtgtatgcatggctaggggttgacttttgttaaccatgatgtatggggtgattatactagtggtatagtgggccgtgcttatggtgctcttaaagcaacagtagtgcaggatacgccctaaaacctttagcgaggtgtcacgtgctacgtaggccaagacactgaagtctggtttagtttccaaaatttttttcccaaaacatcaaattgaatctttggacacatgcatgaagtattaaatatagattaaaaaattaattgcacagttaggagggaaatcgtgagataaatcttttcagtctaattagtccataattagctgtaagtgctacagcaacccacatatgctaatgatggattaattaggttcaaaagattcgtctcgcggtttacatgcgagttatgaaattattttttcattcatgtccgaaaatcccttccaacatccggtcaaacgtatgatgtgacactcaaaaattttatttttgcgaactaaacacaccttgaatggacacaggtttcatgttgtatgtggtctcaagggtctatacataggctccacaacaaatctcatgtcacggtctatctctgatgagctcaggaacacgtacctcagctcctcacatagagttaggggtgggcagaataagaccgaaccgatgagccgaaccgaaaagactaagaccgagatcgagaaatttggttagtagttcggtctcagccatcgaaagaccggatttttttggtaattcggttataggcttcggttaaccgaattaaccgagaaaaccgaattgtggcccaataggcctaggaagcccaataaacccagtacatacagcaaaccctagaggaggacagccgagtaaagtcaagcacgccctcaccgcctcacatccatcgcgctgcctccaaaccaatccccaccctagcgcaccgtcacgcctccacctcgcgtttcctccgacccccgcctcgtgtcgcctccgccctccgcctccagcgccggcgccaccttcgcctcggcgccgcgccgccacctccgccctccgcctccagcgacctgcgttggcgccgcctccgcctccatcgcgccttttatttgtgacttgtgagctctagtgttgtattgtcaactgttgctgttgtgaagtttagacttgagacctatcttgtgatatattttttggtgtttgatgttgcctattatttggtatttttgtgatatatatgactgtgataaaatgtctgaaaagaggggaagtgctgtcaatttttttcatttcaaacttatctcctgaaaattcggtcagaccgagaccgaatttgccggtcctgagtttccaaagaccgaactaaccgaaaaaccgaagaccgagaccgaattttttagtctaaccaaacgcccacccctacatggagtacaccgagcgcaaatatggaggatgaacaacacatcaacacaatttctgttgtggatggtctcattgtaataagagaacatttttatttatccacatgtctggttatgatatgcagtgaatgatatattgtgcttcacttattaaaaatgaagtatataaatccacaagtaaatagaaatattatttatccataaagatattccatttgtgcataattctgcacacatgattggcactgatgtggatggttttctaatagtaactcattgtttttcatttcatcgttgagcaaaacgcataggtaggagttaacatttcttaaccttaacataagttaaaatcaaacgcggcgataaattcaaacaaataggatcataaaaaaattgtggcgaacaaactatggttttctttagtttatttttctttttaatgttaatcttcctccacacaaaccatcacatctacctcactcttttgtatttttcaatctgttctacttcaaccatttgttcaattggtggtgtataggtttatcggattgaacttttagcatttgagccaaaccatatcatatggaaggtatcatatggcatgttcgattgctttcgctggccttgtgctcatatcttgggtacacagagcgatttgtttggttacgtggttatgcgctccacctaaatagaatatgtataaaatgcatcccggtcctaaacgagagttgtgagctttgctgtgagatagggatggataatgcaggcagacagctttccctacgcacatatttgtgtagcctcgtactcacgctcacgatctttatcaatagaatcactatttcacactcgacaacaacttcatttgtagatatttttaaggtctcatcccctttattttaagtatatgccatcaaaatatggtacttttaggtactactatcctacctttaaatgctatttcaaaaattaaactaatggtcatcaaatgcatggtcatgcgaggactgattactggaggcaggggcataagagtagtttacaattaattacgcaaactccgttttgagttccaactttgaacggtagagacagaacgaaaattttgattcaaactcgatggctgctggacagctggaaattcaaaacaccccacacgcgtccgcccactgtccttttggacccagatcgcagcgaagaagcggactaagcggtccagacccggttcaactgtccgccaatgaaccgggttcatcccgaccgcccgacccggcccgctgccttgagtcggaggcggcggcggcgaattcgttccgatttggggaaaaaaaaaataaaaaattcgaaccaaacctatccaaaatccccatctcgccaccatctgcaaactcgccgccggccaccccgccgtcgacgaaccccacccaaacctcgccggggaaccagtccaagctccgtccaaccatgcggaagaacttccgcaagcggaacctcgaggcggacgccgccgccgaccactccgacgacgacgacgcccgccggtacccctcccctctccccgctcccgccgccgcgcctctcgcttgggttttggtagggatctctcgctgactgacgcctctctccctctccccccctcgcagcgtcgccctggaggagatcaagtacatgcagaagctccgggagaggaagctgggcatccccgccgccgccgccgcagcgggcgcgtcgtcagcggcttctgccgacggggcctccccccgcggaagaggcggcggcggaggtgggttagcggccggaggggatgccgagaaggaggacctcgtcctccaggacaccttcgcgcaggagaccgccgtcaccatcgaggatcccaacatgtgcgtttttaacttcgcgtgtgattgttcttgccaatctgttgttttcattcatctttgatgatgcggaattgaagcggagcgtatgtgcgtgcgtgggtctgatgtttgaaggctgaggtatgtggagaacgagctgttgaagaagaggggcaagaaggttgatgtgaaggacaaggaggagaaagaccaggtcgatgagctctacactgtgccagaccacctcaaggttggtagccgaacagagcttcgatgcactcctgaaaggatatttcatggttttgatatgtgtgcattgtaatgatggtgccaatcaattttttgcttataggttaggaagaagaactcggaagagagctcaacgcagtggaccactggcattgctgaagttcagctgcctattgagtaagttcttgtgccccttcgtttgttcttgtttataaaaggttcatttgttcatgtttataaaaggttgttaaggtagtcttccatattatgttgtaattcaaaggggaaggtgcccaaaatactgcaatgcatcataaggagatgtgcatatgggcttgttaataaggatatttattaattgactagctgaatgcctgtgcattgcaacagaattttggaaaagaagaaattcattatacacattttaaataccctaaacaaatttgccacattatttttctctaatcatctagatagatgctttcgccatcaccttcacacgggaatttagaagacacatgttactacgccctaacaacaagtagcccacctatcagggagtgggtggtggtgggcggcaaattcaccactcagcaccaccattggagtcttttaaaatggtatagataactgaacctacaaaactccctacaagtatgcactggtcttatggacatctctggttgtacttctattaaaaaagtacaacttttcttctatcatacatgggaatgatgtgataatccaattgagactttttaggacagcatgatagttagataagataaatggtccagtgggatggacaaacctgtaactgttattttcaatctaaagttctaaactgatctatgcatacaatggtgtgctcgaattataattcctgatttcgaaggtctctgaagggtcaacaactcaacattgtactgtcagcattgtgggttcaatataacctaaaaggttcctgttcctcgttaatattctcaaggttcttggtgctatatatgtatattaatctattattctggtactagagtcatgcactcatgcgtttctttagaactgggcctgcagctatatacagattcatgttaccatcttcttgattgttgcaggtacaaattaagaaacattgaagagaccgaggcagctaaaaagatgctacaagagaaaaggcttgccggtaaaacaaaatcagatgctaacattccgtcgagctataatgctgactttttccatcgcggaaaagattacaccgaaaagttgagaagaggtttgtacatatacctttcagttttcaggttatcataactagttttacacttgtagtgtcatcaccagaaactatcgagtcttaagtctatctgatattgtaaggcacataatgctcccagaggagtttaccagtctaataaacagaaacgccttcaaaaagtactatatgtttctaattgtggtttctaggaacgaataatttgtaaaagtacaactttttttaattttatatttacctcgcacataaagttaaataacaggtcaagtctatcagaaatgtagaattgtagacaggcataaattttgtcactagtacactgccgtagtgctgcaccagttcttcaaataaatatatattctattttttatttaaaaagccaaaacaactatcttccaatctaaaactaagtaaaacatgttttcttgtaatctacatatgcacatgtgtaaacgatgaaattggttaaaaaaggatcatgcaaatgagtaattcatatgcataaatacatggatgatcaatgtaaagcacacgaacaccattatcgattcctcttttttttttcatgagtaagagagagatgcaaggtatgcgcacaccagtcttatcagatgccagctttatgtaacaactgatgattggcacttgatctaagccatgaacagagctttcgaatgataatttgcatatcagatattcctcttgattcacttcaatcacctgggcctgctgccagcttttgaccagttgcagagcaacacttcaatcacaacaacttatttccagttttagcataccgaatataactttattcttaagatatccctttttattaagaacaatttgctatataaagaaaacagaggtacccaatggacctacagcagaagtattcaggttttatataagagttttgatcttcagctgtctttaatacagatcaattgttcccctcaatagacctgaattttaaattaacattgaaggaatccactaatcgttacataatacaaattgcaaatagcctgtgaaacaatctatgctgcatcaaaatccacgaatatgggaaatgtgatggtagcaataccatttttgaacttctgttttagaaacaatagctgtggcatatcattgatataatttatcgtttaagtgctaaactgttccattttccttgcagagcatcctgaactgtacaaagatcaaggttcacaggctaatggaactggaggtaaatcaatgggtggtaaccatccagatggtgctggtgcagggcggagagaagctgctactgatgagttgttgcttgagcgtttccgcaagcgtgaaaaattccgtgtcatgcgcagataacatgaaatggaataggatgctaacttatgctatttcctttaaagggcaagcgtgtcagtgtgaccacatgatggccctctatacatcggttgattttggcttttgcttctaaagccagtgtccatggctcatcatgttataggcgtatcttcgaagcatttgggaaaattggacaggtcttcatgaaactgatcaatattgttctgtactgagcagcaatccaggatctcgtttctctcttttctttaaaactgctggttcaaccatggataaattgccaatgatctcagatatgcctttccatcccgatcctgaggcttaccttccatgcttatcatttctgctgcttacacaaccaccttgcggcttgcaccttattactgaaaatttcctggatataagcaagcactggcaatgtaccttatgttatattttcatcagaaacactcagctttgttgatgttgcccttctgaaacaaggaaaagctgtcagtaaagaagttgttaatttctgctccgtgcattgatgtgaccttgcataattttttgagccatcatttgtttggtacattatgattatcgctgtattaatgttgaccggctattttgcatctataactggattggatggcgtaatgcttgtagtgtgcaagctgttagtacatatgttaggttaagagaatgtgggtttgtcacagttcagaaatattatgtcattttagcatggttgcatgtcgtatttgagaccgtactgaagttgagttggtgaatcatccattctgtaatctcaacctgtgtactgaggctgtttatttggaaatattgtgcatgctcatactgggtgagtcttctgcccctcggattgatgagattttggtccatgtgtaccttttcagccgtctgattttctgctcaatgtttcgattttctgctcaaaaggctttctggaaattttttccattgcttgttggaatatttggaagcagagaaatgccttcatttttcagagtgtggatccacatccttctgattggttggttaagttcaagcatgaaattcgatttcatagttgtaggatgaaagaacctctcttatcttcggttattagagattgtttagatcccaaaaaattttggccaaaaacgtcacatcaaatgtttggacatatgcatggggcattaaatgtagggaaaaaacaatttcacaagtttgtatgtaaattgcgagatgaaccttttgagcttaattacgtcatgatttgacaatgtgatgttacagtaaacatttgctaatgacggattaattaggcttaataaattcatctcgcagtttacaagcggaatctgtaatttgttttgttattagtctacgtttaatacttcaaatgtgtgttcatatacttcaaaaactttacacccaaagaattaaacacacccttaagggtgtgttctctattcccggctgggaacttggaaaattaaacacacccttaagggtgtgttctctattcccggctgggaacttggaatagtacgtacggaaaacggaacggtccattagcgcgtgactaattaagtattagttttttttttcaaaaatggattaatttgatttttttaagcaactttcatatagaaattttttgcaaaaaaagtatcgtttggcagtttgaaatgcgtgcgagtggaaaacgagggagatgggttggaaaaagggagtgccgaacacaccctaattagttggttgcaagctttgtaatcatggattttttgtaaattctgtatatctttacctattataaaagttcaaggtgtttttgccagaattttggtacgtcatccgtgtttgaaacgattttagttttatgttttgattttaatctatacctctacttaaaaaattcccgtcttatatacataaaaaaagaaagaaaagtccgaatcaaaaaggtaaataaagaaagaaaagaaagtccgacttaacgagctattaaaaaaaaagcttccgtcgtcgttagtaaaaaaaaaatatctcttgtctgactctatagagaaaggaaaaaaatctcccagtaaaaaacaaaaaatctgtttgattttgttggcaccggtattttttttccttttttctttgcacgcagagttttttttccttttttctttgcacgtagaagagttttttatgcggctaaagcttttgtttttttttatctttttttaatccgatctattcaccgtgcatctcttgggtgcttatagttttttcgtcaatattttttgtcaccggttttttctcccgtgtgctttttgtttgtctcatccggttttataatcccatctattcgctgcacacctcccgaggtgaaccctagcgccacgctgctgccatatcgatagtgtgttttctcctccaatttaattataaaaatcgattccctactcctctctcaccattttctcaatgatttccccttcgatttagctttaattgctggatttaatctctgttctaaagttgccgattttgacggcgatcttccccggtcatttttatcccgaattttacgctctgattttggggaaaacggaaagagtagatcgagtggatcaaaaaccttgaacaattttggttacccaagaaagattcggccggatttgatggggagatttgctttggcaaacgtacgggcacgagattatcttcgggcacgggattatcttcgggagtcttcgggaggttgaagatggtagtcatattcggaaagttaaagatggtagggtcaaagagaagcagaccaaatggagggaggtagcgggctagcctagggctgaaaaggaaggaagtcttttggctaaaaacctaggaaatattttcattaatttttttaattataatctatagcgatcccaatgttaagatttttattaacttttttaattatagtgtatagtgatcccaatatttcaatttattacttagctcttgatatatcactgtaaaaagtctttacccgttgcaacgtacgggtatcttttctagtattaatataatttaaactactgggcgaaccccggtagtctttctctctcttaaaaaaaaagatgatgaaaacaaaaatccgcaaaattttgtttctgccatttgctgcgcaatccaaaattcgttacgcaccaaatcaacacgatggaacaaaactgtaaaatgttggaacaaaaatggaagctagaggcggtagcaacactggccccaggcgtgcagcgaccgggagcgcgagagcacgcgcgacgccgccccgaagctcacctcgtgcggcaatggcaggacgccgtgctcgtgcctcaccatcgacacgtgcaccttgccggcgaccgaccgggcgacgtcgttggcgccccgccacctccctcgccggaggctgtacgcgttcacctggccgcgggtgtggacgaacaccttgtcaccctcctcctccgcgccctgcaccgcctccacctgcttcaacgccggccacaggttgcgccgccagcgccacccgcgctcgtccctgagcaggtcgatcctcctcttgagctgccagctccggcggtggtcgccgtggtagtcgtcgagcacccacatgctcaccgtcgtgccgcgatcctccacggcgaagacgcacagcttcccggcggcggcgggcagcacgctgatccgcgccgtctctaggtccatcgccgccatgcgctccggcgtctccttcagccggagcttctcccgggacatgtcgaacgccaggagcttcagcttccggacggccggccagcggccgcccgactgcaccagccagtggagcttgccgtgcagggcggcggagcgagcggcggcgtgtcccgtcgtcgccatggtgatcttgggtggcggcgcggggcccacgcgccaggcggcgtcgccgatcgtctggacccggaagacggccggcgccagctgcttccggtagtagtagtggccgacggtcttgccggaggcgtgcaggatgtggaagcgccccgtcgccgggtgcgcgtaggcgccgacgaactgtcggcggcggccggcgcggagacggtggcgcaggcgttggtgagagggttccagagcacgtacacgtcggcgccctggccacccgtcgtcatggccatgcacagcacgccgtcccatgagccgagcaccagcgacgagatgctgtacttgtccgtcgtcgccgcggcgccgagcgagaggacgcgccggtacggcggcacggccgcgccgtcgacgttccagtggctgcggaacaactcgaaccggacgatggtgtcggcggcgcgggtagtgttgatcttcacggtgacctttgcggcgacaggccgtggccgtgggacgtaggcgcggtagaattccggccgggaggtgaggcggcgccaggccttgcacgcggcgcggcagccggtgacgatgctgcgcggcggcaagcgagagatgatcttctcgacgatgtcgtccggcagctcggcggcggcggcggcggacatggtcgttggagttggaaaataatcgattgaagaggaaaatagatcaattaacgcacatatctagggcagctagggctggcctgcctccgaagcttaaattttgttgattcaccatgtatatttttcaaaaaactaatactactccattagtcaaggtctatcttagcttagtcttgtataatttctactccgccactgcatatcatgtttacgtcagattttgttttacttatccatcgaataagtaaaaatcctagttgacagtttcagccgttggatgcggccatgtaggcaatttttttttaacgctaagctagatataagggcatagacattaaacataaaaaggaaacgtatatttggttataggcttatagccatcctgccctattttattccgctaactcctccggtccaggactgctatacgaaagatattttttaaaataaaaattactcaaatgtaattataatgcaattaaactgtaattataatgtgattacagtgtaccataattataattacaatgtaattacaatgatacattatatttacactataattatattgttcgtgtgcttattaaaacaaaatcgatacctacctcatctggtaatggctgcattgcatgttctccaccatgagatcctggatcattctcaccccttatgctagccattcttttttttttccaccagctaatacgtgaatcattgggattgctatacacaaatggagctgcacgcccacttgtattggatcaaactaaatggacgggcatgacggcctatatatatatatatgcaatgggaccttaaaaaggctagtacatgaattattaggatcactatacacaagtgaagccacacgcccacttatactggatcaaacaaatggacggcctacatatatgcaagggtaccttaaaaagactagaggggtgaattgtgtgatttttgtatatatttcgaggatgctacgtctctgtcaaaggctcctgatcagttatcggttgccagctgatgcggattggggagttccatgcaagcctatagcacaacattgacatggcatagttgaccgggaacctatcctatgcacacaaactttccatgcacagtactccgtgcacgtacaccaactagcaaatattacagaaaattcaaaaaaaaaatggacacatacttacaatagtattacatctacacgtgaaatcttatcttcaaattcattatattttagctgtaacaaaaaaagataaaattctgatagatttttaccctttaaactgtcagatttttcacttttttgctacggccaaatataatgaatttgaatatggaacttggcagataagtgtagtacaattaggagtaaatgtctaatttttttatagaattttttgtgatattttgctagttagtgtgtacgggaagtttgtgtgcgtaggatatgttcccctctatagttttgtttcagtgtttatgacactgactgcaacggggaggtgtcatactgtcatttgatgatatcttgagcatcttgcgagatctgactggttcttctctgactgagcagcagagagccataagaatttgtataattgcacgtaattgtagtttgtagattattgctcatgttgttacaactacatgctgcggctaaaatgggtacctcacatgtcgctctgatcaagctgatagttatgaagtggtcataaactgttgaacgaccctaaatgccatgcgctggactacttttttttttccatgatcacattgttagtcttgctggctggagtaattgttggaatcaatagagattaatttctacctgcgagtcttttttttttcatgaacgcgcgaaaaaattgcacatcagtatattaaaaaaaatagagttttagttacacaacgcaatcgaccagaccggtcgttgccgggtataaggaaaaggactgcgagaacgagaaaaaaaaggaaaaagagtaatagtaatagtaatgtatttttggtggggctaacactcgtggagaagtgatcttttcccgtggcacccaaagtcataattgtcccgattagattaagaaccgatactaaagatgcttcaaggcccttgaaacatttttagtccgggtttaccaaccgggactaaaaattgttctttagtcccgattggtactaagacaaatttttagtccaagttggtgttatcaactgggactaaaaatacctctaggattagttcaaaaggaaaacatctttattcaagttagatgtgtgtagtgtgtacaaggtgggatggttacgcgcgtgagggatcttgagttcgaatcccacatcccatatatatattttatttgctatgtaactttagtacaagttttctgtagttccgatttactcgtcctgttgctataaccaggagtaaaaaccgtttctccaacagtatacactactacaaaaaccatttttcgtggcggccattttgggttttcgctgacggaaattggagccgccacaaagcaaaggccagtgaaaatcaatgattttcgctggcggttacgatctgtttgcaacaatagatttttcccttgtggacaattaggaggaccgccagcgaaaatctatttgcgcaagcggctaattaggtggactgccagcaaaaatctatttgtgcaggcggcaccactaagaggatcaccagcgatatctttttgcaaaaacaataaaaataataattcacattcagaagaagcattgttgcattttcaaatttcaaatccacatcaggagatcatattcaaatccaatccagattcacatcaatatccaagatcactacatcgatttctcagtattttcaacatgcaaacatcaacacattgaaatgaaaataacatgcaatcatcaacacgtcgtcatcgttggcgaccttgttgctattgccaccaccgaagcaactgtcgccgtctccctatggcaagagggaggagacccgggaggggagggagggcgtcgccggtccctaaccatcttgccaccggatccgcacccgtcgccatcgccatcgccgccacgaccgccgttgtctggaggggaggggaaggcaaggtcgccaccgctggatctgagagaggaagggaaggggaaagtagggtggccgccaccggatctgagagagggagagcagggtcgctaactcaccgtggccctctcgctacccaatccgccgtccgtgcccgtcccgcggccggatatgccgcctgcggccctgcagcggccggatccaccactagctcctgtgccctgcgcagtccgccggggtcgccgccgtcgccgtcgctggtccgccgttgtcacgcgcccgtctcgcggccggatccatcgtctgcgaccctgcagtagtcggatccaccgttcccgcgcccatctcgggcggggattcatagcccgagcccctcgcaggccgtcgtggtcactgtcgtctccgtcgccgatccgccgaggtcacgccgatcgatgccgagaggaggaggagaaggtgtggacgccgagagtaggaggagaagctttggcctgtgggaggagaggttgggggaggtaggggagaggtgggagatgaggaggaagtgaggtgagaggagaagataagatcgtcggtgggagtggaaagagataacatccgtgcgattttaatatagggaatttcttttcgcagtcggtgcttgttggcggctgttaaatgctgattctataccgccaacatctgcctaaagttcagataataaaacatccaatatagtgataggtgcttaatcttacatattccatagtgttggtgtatatttgtatgcaggtgataaaccccaatgttgggaggaaatctagactaaagggagaagaaacatgtatctatacaaggaggggttgtgaacttcatcaaaatatcagtaaatcaacccaaaactccgagaaatggatagaggaaggtccagggagtccaccgaccgaaagccaggccaggagggcccagctcaggttcggccgaacccccctgatcaccgttgatcctggggtttggcgtggtggcgctccagatgaattcccaatgacggttgcggggcagttcgaacatttccccttctcagaaccgtcataacttacctataaaaggacctcacttcattcactctcacacacacttccaagcttgagctgaattataagaggctctattgtactatattgtatactagaataggaagagagtagagtagaagaagttggaagaattccggagctgtcggtaatcttctcctatttcttttattctgtttattactttgaattcaatataatattcttcttgagtaatttagatttatcttgtgagaattatctcttggttagttcctaaatagcatacgggattattgttcactataatcaactaaaatatagtgattgctttggtgagttataaacactaaagtagatagtaattgcttagacgtggtgtttaggtaattgttatctagtaattgctgcatatcccatagtatgtttgaggtaggtgtagaggtggttacagccctcgagatcacttaagtcctccctgtccgggtacgtagtagagcaacatctgggaacaacgggttgccttggtcttcctcttcctaccggcatcggctggttctcttatttgcccttggagtaggcttgaggtcctgggggcataacagccgatgacagggggagctagaccacctccatttagtagaaggcctggagcatattctatgtctttgccgctattgcttttgcgatgaggagaggattctattgtctgcaagacagaagaagaggttagtcaaaatacaaatcggctgacagtcattttacatgattgacaaagtaaggatttacctgagggataacatctgggaatagatctgtcatgtacatggaagccgattggtggaacaagtgctgcttccattcaccccaccatttgtcaaagttcgtgctcctgaaccttgctagttctacattatcgatgctgcccaaagggggtcctgggatgttgagcagtcgatccatcatcaatgttgatgagattttgcctctgcattgaattttatcggcaaaatagaagccgattggcagctgtcccatcccaaactgcctagccgagctcatgggatggtagaactcataagatacttgtatgtttctcccttgatggatgccaacaggaagaatacatggactgatagcagccgagaagacttctctagacttatcatattttttagaattgatttcttcaaatatgaagtctgatggcagttcaaagctcattgagtcttcatatgcaaaccaaactcgggcatctttctgaaaaccatcatagaaactgaagaaccagtccctcagtagctcagccgataacttggatccagaatcggctggtgtggatgcagcctctccatatgacatgcatcggcggtgggtgagttcttctccatcatcatttgtaatcggttctagccttggaaattcagcatatgtcaaagatgaccgattcacagccttcatggcaacaaggttaagccatgtttgcaacaaccaccaagggccaccagcaccgactactgatccactggttatcttaaccgatgcattgtttaacatctgatacagatagccgaggaggatttttcctaaagggatttgtttcttcgcttcaaggctttcggctaagaactaccaattggtagtagggccacaactcgaatcgtagaataggaatttttcaagccacatcagtaggaaggctacatgttctcggggagtaacagatcctttgcccatgtatgcagcaatatagctggaccagcaacctatggttttagtcttgaatcaaactgattcttggagttcaagctcatagggttggccgatgcggtgatgtctaagccagtaatcatgatgacatctagcagagtaggggtcatcggcccttggttaaatataaaggcattgagggtgttggaccagaagtatgttgcagaagccatcaggggttcatccttagctgaatttactaaagtaagagcaagggcttggctgattcctagttcgtcccaatgaacctgcttgctagccgatacacgcttgtaccatacgggccagcttttctcaggagaacttttctcaagggaaggccaagatttgaaagtatttttccagtgacctagatttgggttggccaatctaaagggtatcctgttggtttcggtgctaatgaactcagtggggtcggaatagccgatcggaccaaggaaatactgatgctcatgagatagactgggaattgcaaccagattggaaagatgctaaaaatgcaaaaaagaatagagaggaagaaaacaagatgagataaggaaaaaccaatctactgcacaaaggagaggatctagccgatgggtagttacctctgcgtattcggctgatggcgcggcagacgggctggtggaagtcgacatctccgcaggcggaagcttggccaaagggagagtcgcctcgagatcgccttgcgcaccgaggggatcgccggagagagagagagagagagagagaagacgaagttggcttgagcggtgaaaacggaagtaacggtgtgaaatttctcaggggtgacggttagtatttaaagtgctgtggtaacggtcggaaaaacggtaatgagcgatattcctggagaagtagatatggcaaatccgaaacattaccaaatattccggacttgggggggcatgtgttaataaccaaatctggtaatttcagtatcggagatgaagataaaaccgaagcggaatccaaggatggatcgttccggaaacagagcaagaatcgactgaagttcgaatcggctgcgactagaatcggcagaatttgagtcggacaaggttagccgattaagccgattctgacaatacgacgcagtacacgtcatcgggttaggttgaagtgcttcatgtgggttgccatgcatggattgagtcctggaaagacaattgtatctattacttaggatgttttatataatttccttagagataagtttaggcaaaagtctgtcgtaaagacttatggtatcttagagtttgttagagataagagtcgtgtccgacgaggacatattttgtatctcgggtataaatatcacccgaaaccatgtaatcaaacaacacacgttcaatacaatatcggtgcatcgctacccttttactttcgtttgatctcgacgagttcttactttcgggttgagctgcatcgtttcgatcttcaactagaggtaaacttgtcatggcgacttgcgttctcaggattagtgcttccatctttatgacactctaatattgtttatgtaagttgttgagttagaatatatcctatataatctctggcaatattgttatttaatcctcagtcggccaacatctataactagaaggcagccgatcaggttaaataccgacattgacttagattatataaggtatccacaattctatgaaacatcgaacagcttgattgtctaggtattgttattcttttcatacttatagctgcatcagttgagtttgatattataagtcgtgattagaatctcaatctctagcctgcttttgattgccgattagggtagtatcggggttttagccaatcttatctgatttaactactttatatcctatatgcgtgattgatatgttaaatctgctctttatgttaagatcttgttgcatttaggtatattaaacttcatgtctgatatattctgcttgctttaatatcttaatgtagagtggtaccggagtattagccgatacatgctagatctatctgatcggctatgttatgaacggttataatctttatgttaatgtatatttcgatctaagtgatttatactgtctcggcatgacaaccgatctatcccaatcacttgatttaaatatacatcgacagaaggattatatatcattaatatctacagccgatcgaatagatttagttctttcttgcttacttatgactgccgatcgattagaatatgacatcggctcaaagataaatgatatgtcatcggcgactggccgatcggctatcgtttatggatttaactgctatttttctgtctttgtttcttgttgattgcaggatcaaatcaactggcattctcatgaatctaaaggtaagatttttggacctgcactggagttaagtagatctcccaggcctcgtgtttttcgcatcggcaccttgcgtacctcgtgcagcaactcgacatgcttctggaacttccgaacttgctgatggcggctttgatcaatgtatgccaggcttttcagctcggcggcgccgatgagcacgagggttctcggcactttcggtgctagctctctccactccttcatttccatcgatcgagctagctctcccccgacgcagaatcgtccaggcgtcgaagaacctgggagtgaccaacaccagcgccctgggtgttctggccagggccttgtcggccggtgatgcggatggcgtcccggtagtgggtgtccctgctggtgcacggcggcttgacaactcgtgctggatgccgatcgacaagcccggcgtagcgcacaacgatgtggtcggccatcgcgtggcgagcggtgccccgcgagagtcatggtggggcagactccaacggaggccgggtcgccgaagaggctcatggcaatggccgccggcatcccgaagcgtatgttgcgcatcaaagcagcgcgctcttggatcttcctgacggctcgcatcccggagctgagttgcatgagcgtccattgtcgccgatcgagctcttcctctccctctcgctctttctcgcttcggtttgggattgggatctgagcgtcttctgtgtgtgtggcaatttggatggagacgaagaggagtacaaaatttatagataagcgctgtgtgaagagtggaaatgggaaaaaaaatttggtgcataccggatgtaaatctcaccccgtgcatacccagcttagatacgcgacacgtggacgaggcgtccatctgacggccggcctgcactgcgcgcgcgcaggcgcacggccatgcctcgtactcggctgggcttgcgcgagcgatctccacgctcgcctacgcggctcgtactcgctcatctcggctcgatctaaatccgcttcgcttgtagcggtaggctcccaaaagtatttcctccccgccgttcccctctacgataccgccgccgccagccgcctctctcatccggaacccgtctgccgctgctaccctcttctacgcgtgggagggcgccgtgccgctgtctgcctgctggccgcccctcctcgtccaactgcccgaggtaactgccgccgctttcttcctccacggcaccacctgggtagccggcgccgcccacagccgctgacatattcctcctcacgcaagagggccactgatgtggtgctgtcgtccgtcgtgactcgtgaaggtggctgcttaccatcttgagtggttatgctattgactgtttgtttataaacaataattattttttcatatacagtcatttacagtcagttgcaagcatgctcacaaatcgatatgcttagtcatgttggctgattcttagtgatgggagctgattccaaatacttcctccgtttcacaatataagactttctagcattgctcaatgtaagactttctagcattgctcacatatatatagatgttaatgaatctaaacacattaacatctaaatgaatgtgggcaatgttagaaagtcttacattgtgaaacggatgaagtagtaaattactcactacatttttacatacaacatctttgcaggggagacagacataaggggtgaagcttggctgatgattcaacattagaagactgcaatgaacaagaggccacttaagaaatgccatagaacaatcaacgacagaaaaatatggactgaaggaaattattctgggagctgatgtgtgaaagtagttagttttgcctcatgtctgtagcctttctttgtaagatgcactaaagtagctgggtagtctgtatatagttaagagtttgcagggacagtagtcatagatgctacaaatttgaacccccttttggttcaaatagcaaagaaactcatatctgtacaatatatttcttttatcacctggcgtgttggatgttatgaaatctgcaaagtgattgatttgttaaaaaacttgtggttgtttctctgattccttgcgaaaataagatctgcaatattgtgtaatctgaaatcgtgatgttcaaatctggaatgtggggcctgttcactttgatgccattttcaaccttaccaaaatttggtaacgttgccaaaaaagtggctacatttagtttgctgccaaattttggtaactacataagaaattctgccaaaattttggcaagttaccaaaattttggcaatgctgaaatttggtaaggttttttagcatcaaagtaaacaggcccgtgatgtctagaagctgactttcttaaacaatattagatgatttcacatctcatacataactggggcctcatcgtttgccctatagcttataagccaaagccaaaatttgaatttaaaaacttgaatttgaatttgattctttttcaacatagttgtcacagcccaaaccggcaccgccgtacaatggcacctgataggagcgtgtcgtaggaaaaacggcgcgaaccgcttcatacgaaaccgcgatctcagtaccagtcccaggacatagcgctggtacccacggtgacaattatgaatcattgcaatccttaaataaatagaggacttatttaccttaacttaggttgcagcttagacagcccgagaatgcaaccgacgacacggacgaggcaaacaccaccaacagcagcagcagcagcagcagaaccaacggtctaacacccaacaccacaggcaacagcagggaactaggacaaaaccctaatcttcacttcacttcaacttcatcttcagagcgggcagaactatatttatatagagcaagggtgattacttacgtactcagcaagccaggggaacttaggtggttaatgcaagcttcaaagataaggctgttatttttcaatcggtttaatttgcaagttttcaataatctaagtgtgtgctttccactaccagagcgagacaagtctcaactcggccggggcgagaagtaacaaatttatgtatcaagatttgcacaactcccggagttggcttcgaatatggtttttcccaaccaaaccaattttccaaacttcccgataatagtggtccccaaacgaccaatcacttccagggactcccggtcccgctatcccccggacagctaaatgcttcccaagcattaggtttcccaaaccttaacatcttttcataaaatagggtaaaacaaaaactacactaaggaatcacctcacatccgcccatgaccgtgggcacggctgttcgaacagtttgttaacctctgcagagggggtacactttacccagacgacattactaacccgggtcacccagcccgtgcagaatagccacgtctggtgactttggggctttcatgacaaggcatttcgaaagccgacacaggattgccatatgccaacgagaggggtcccagaccaacaacaagtttggtcccagaccatactgtgccaggaagcccggggattctccccgacaccaccccgttgaatccacatgtctcttggcatcaaggctcccctgattagctatttactcagccaggggcgtcccattccacccatgtggtcgcactattgtatgcttggatgtaattccataggaatcggtccttagatgcgaccgcacaagtattccgcccaggaatggccttgtgtcgcgagtttcatttttaaaactcattttctttcacaaggcaccgatccaagcgtcgggttttccaaagcttttgtaaaccaagttttacccaagaagttactcagattttaagtttgaaggtgaccgtcgatactcgcacagagtgcatgaatatcgaggcacaactagatggttacaagggaacatgatataacaattaacaatggaaggatcagatgcaacaagttaggtaggcccaccggtctacctcgtagacggggcaaacagattaagtgcaatcctatcaatgcataatattttacaagcaatataatcccttcttcctatatagttggtaccaactacaacattagctcctataaaggaagcaccaggttaagccacgtcattgagactttagagccgtagagccgtctgatcaatctattgtcagatgccaaacaccgttagatcttattctcggctggacacagaaatcaggcccaagttggttagcaggccctgtcaagcccgtccgaactcctgcaaacctctgctggacacactccgcgaagccacgcattgacggggatttcgatcggcttgcttcctggtcctggaccgtgcaatcctcacatacttgggagacggagcgacagaggccgttcatatcctgcgctccacccatcctttcctcttcatcaatcactgccaattaaactagaaaaaacagccgctatcaattgcctacttcaactataactgcgtcgatttaccaacactcgcagggtctcttcttactcatatcatcaccacgacgctggtattctcaagcatggcaccggattaatctactctgctttcagtttggtcacatcttcagcagttctgcatgcgagaaaactgtgagttagctcaatccatgtaatttgcttgctttggatggatctaccgagcacaacagttggccgcattctcctcctgcactaaagatggtagaccatacatctctggccactgccgtagaagtacttctgtgcagaaggtatctatctccacttcttttctggttggttaattcagttaatggaaattgtttacagactatattcaaggtgaaattgcactactgcaggttataaatctttccatttgcaacagtccatgttctatctcaatgatattcatacgttcctcttcaatgtcatgccctcatgcatgcaaaaacaaaaaagggtcttcgatctcagctttaaaagggtagcacaaaattttttattggaatattgaaagttcaggaatcaaagaatcatctccatgggcacaggtaactaaacaggtaaatataagctacatatatagaatatttgcttaatttatatttttgttgatctctttattaattatctttttccgacagtagtccattaggattacactttttgaatgcaaattcctatttcaggattattattatccctgcctaatccatgtataagatttccccctattttctgaaaccaatgtagcatttgcctctccatgaactccggcagaagacagtcacactacaattaaatataaactacatgtactccagcagaaggtagtcgcctttacaacaagaatcaattaatgtcaattgccagcagcataaaaaatctcaaaatgtgttatttcttttttttttttcgaacggtcaggcagttgccgacgttttatattaagaagaagatatcccattttaaggagaaaacgggaccaaaccttacaatgctcagttaatgttatagccatatagtggctgtaaacccgtaactaatcaccccatattaatccctcacacaccatatggtactttagacatgaaaattaagtttctacctcccttattggaatacatatttaaaaccaatttgttcaaattggttttaaatatgtagattgtagagtgcagtgtcaactccctttcgaataattcatttgtcatttttgtaatctacagtatgttgtgtgccgtggtagtatcaagtatgtgtataatcaaacattttcctggactactataatgaaatccaatttacaccgatttgttattttgaattcagtatgtaccataaaccaggaggctttaacatataaatgcacatgagtctctttgacaccacactgaaagtaataaaaagcatacattttggttcacagtttcacactaactttttatgtttgaaataacttattaagcccgcagcaacgcgtggggattcaactagttaagttcaaatataggctcaatatgttcaaaggtggcttgccttgctcagagtcttcacgaagcttcacaaatcttcgagaaatccgcttgaagaaaaatatccggtaaccacaactaggcgcaaacaatcaaaaacctaaacaaagaccaaataaaatatcctatttaggctaattaatagtgccattagatagatcacaatttaatggaattattgaaagtggaacggggtaaatcggagttacggatcaagagatatgaattttggaagtttaaataaattttctggacaagaagatgatttgtcagaattttctggaatacgaaaaatggtttatggaatttatagaaataatattctcaagaatattattgatagtcactgacatgcgggaccgagggaatgaattattggaatcccggaataggataaaggactttatggaattttggaaaaagaaaggaaatacttgtggaatattggaaaaaatattctcaagaatatctttgactcattgaagagtggggccaacaagaaggtcgagtgagagagaggagcaattggaggtagcaattgtggacttttagctcttgggtgtgtgggcactggacttggaggagggagtaaaagtgaactttctatgttttgttaggccgaggaggaaggctggccaatgggccaagcccacgagccagaggagagaggggtggctgacttggcgctgtggactgggtcaaatgccacgtgggctgccacgtaagcgcaagagagaaggagagggaggcagagctcgcccggatcggacggcttacggcggcgcaacggcgccggcgagcggcagcgagccaaagggaggggacggcgccggaggcaagaggaggaggattggatcccttccaccggcgcggattagggcgccggggtcggaggagggccagcgacggcgtccggcggcggcggcgggagcggcacggcgcgggcgcagagggcgaagctagcgactgcggcggcgcttcggggaggtccgagggggcacggggataatggtggcgccgggaatcaaggagaggagggaggccaacggcggtgcgcaaccgtgtgcacggcggcggcggaaaggacggcacggcgcaggggcaaaagagaaggccggcgggcggagcgacggtttggggtggtttgttagagctcaaggtgggtggcggcgagaggattcggcgcgggaccgaccggcggcggcggtgaaacagagcgacggcgacgagaaggggaagagaaccgacagcgaggagaggatggccgatggcggcgcgtggttgcccgcggcggcaagaacagcagcacggcgcgggaggggaaaagaacggtgcgaccgtggcgataagagcagggaggaggcgagtagctcaccgacgggcgaggcgagacggcgttggtgatgagggctcggaagcgagaaaggggatgccggcggcaaggatgtcctggcgggtttgacgccgaggcgggctgatggagttgtccgcccgtggcgagatgatcaccgcgacgggagcggcacggcgccaagacggcgtggccggggaagaagaggggagcgcgaggatggggcggcccagtggcggcgaagagacgttcttggtcgcggcggcgacggccagcgacgaaggagtcggcggtgctccgttcctaggagcatgagaccaaggggatggattggggctcaaggggtggtatttataggcgaggaccgaggagggcgcatgcgagctggcgctcggctagcgaccgcaagcagcatcgacgctttcgtgggtgacgcgaaaacggcgacggcgtggatgcgttgggcggcggaggcggtggatcgggcggagcgaattgaacgcggggcgcgggagggttggcacgggcgagcgggcgcggtcaaggtgggggcggcgaggtgctgcagcggcgtcagcggctctgcctcttgagcaagaagccaaggagttgaggcagggagctcgctacccgggaagggaaaaagcgaaaggaggaggaaagggagctttgctccttccgttttgggaggaaagggatgagaacgagccgcgcctcacggttttggatgcacgcggcatggggcgccgggcccgagaggatgacgccggcgatgactgcaaaaaggatggggacggtttgaaggcgagcgcggacacggtggtcgtcggggcaagcgacgaccgagggtagcgatggcggcgcccaggcggccggccacgtgcgtgggcacgcgggaatcgaaggcggcggccggaattttgggcggcgtcggtgggaagcgacgccgacagagagagagagagagagagagagagagaggggggggggggggg

SEQ ID NO: 72553 - DNA, 22090 bp, Oryza sativa
  unsure (1)..(22090): unsure at all n locations
tctttgctgtagcttgtaacttattctctctctttttcccttaataaatctcggctggctcttcacgccagcccggcgaaaaaaaaaaaaagattggcacctgtagactgcatactctgcagcattggccatttcagaggtgtcctccctatgagccctctttgaaagtagtttccatgtgagatgtttttatttaccttgttctagttccagtagagatataaataaacttgtcctgattctactgacgatcatgaataatttgctatccactactacaaacgcatcaacataaagtttcttaaggaccttccaaagacaaaattaaatttaattgttttgagcactagtgtatctgtgtatgtaactctctagatgcagctcattttccattggactctagactcatctgcaaagtgcaagccattacacaaaagacgctgacgaagcgtattctcaaaacgacgtacaagagcatcgattaaactagcattagtgggccatgtcatccactaactatacttcacaacaacttattaagagaaactcttcagattaaaagaacttaagagaatgtttcatggatagttctgtaattaggagtactggagtactttaaatctccttttctcctataaaagtagtccgttttactcttttttaagtggaagactctcagatccaacatctcaaaggctcttcttatactgtactttgcttcatgctcttcttatactgtacttttgaatgctttctcctaaatttttgttacagtgagaatcaaaggttccatgcaatatattattatcaagactggaagctcctagagtgcatggatggccctactcaggttggaagacaaatatttccaacctgagccgaattatgtgatgcaatggctctgcaagatctcagacgctatttgcagcttaataaattatagagttcaatatttgattgcagttgaagctaaatactcaatccacactatacattgaaattttatccattctcaaaataggcactgaggcctgtttagatacattggcaaaattttcaccctgtcacatcgaatgtttggacacatgcatggagtattaaatataaaaaaataactaattatacaaattgcgtgtaaattacgagacgatttttttaagcctaattgctccatgatttaacaatatagtgctacagtaaatatttgctaacgacggattaattaggcttaataaattcgtatcgcagtttacagatagattctgtaatttgttttgttattaatctacgtttaatacttcgaatatgtatccgtatatccgatgtgacacgccaaaactttacacccatggatctaaacaccccgtgagtagaataggaaggtacctcaaattatggacttgatgaaccttgacatttccttgatctcttcagaaacaacagaataaggcatgaacacaagaagcaagaaaatgcaatgtaatgaagacttctcatgcaaatagtaatgatttctctcgtgcgcaatgtctgcaggataaaaatgtcaagcatcttacaacaaggacagcatttgctttcattcaggcagtacttccggtgctaaggccaaatcataagtaagaatggctctcaggaagtgaccttctaccaagaccatagatgtcagcacacagcagtaggtttggaagaggttctctcaagagggaatctttatgcagttgtcgcaagggctacaaccatgtttgcacctttgcctgtcatactgctcaccgaagtggccaagaagagtttgcctccggcattctgtctgcagggaaattcattcatcaagtcgttgcgatgcagcattttgaatcatacaataacattagttggaagaattaaatcatagagttaccttcagctcgcaatatgtttgcattttctttgcttgctccattgcaaccttgaagctctcactcttgaagttccctgaattcctcagcatgcatacaattcgaccgaggtcctttttctgatataacacaatgcaatgtgccggaagattgtctcttcctgctctccctgactcctgatagtagctttctatcgattttgacatggtgttgtggataacaaagcgctgcatgatgaaatatccaaatcaaagctttgcacctaccagcaaaagaatggaattatatcccaacattgactgaaatacataccacatcaggtttgtctattcccatgccaaatgctatggtcgcacaaatgactttgacctctccgctgtgccattttccttgtacattggatcgttgacgagcagccaagccagcgtggtaatgtgcgcattttatcttgtacttctccctcaagaacttggcagtgtcagcacattcatttttggacagacagtacacgataccagacatgttcatgaaacgctcttttaggagatcacccagctgcttctgtggagtttttgtcttgccaatcacctcataattcaggtttgttctgtcaaagctcctcttgagtaccgttgcattagggatcctcaaggtacttagtatgtcctgcagagtacatccaaattatagctactaatttccatccaagtagtagtgcaggaacaggatcagtgtgactagaaccttgcagacagatgcagtcgctgtagctgttaaagccataattggtactcgagggaagttctgtttgaggcatcccaggcctcggtaatctgggcggaagtcatgtccccattgactggtttaacatggaaatcggtaccattgtcaggaaaaaaagctgcttcttatacaactatcacaaacgtggagtttaaacattaccttacacaatgggcttcatcaatcacaaatctcgccagtaaaccctattgaaaaatgcagtttaacaacacttcctcggataaaataaaggttaaattaaaaaaacaaagtaacaattaaaaaaatgtaatatgagatttgtaccctctggtgtaaacctatgaggatcccaataaatgagctgtttccagccattctttcaggagtgacgtagaggagtttgaatgacggtttaccacttctgcaatgagatgagaatatgggatgagaagctaaagtaatgtgatatgtttaagaagcattatgcaagttacaacacaaaattctattagatatgctagagatctaatcaaatgtttacctaagctcttggattactgcagatgactgtgaaggtgtctgctgagagttcaaaaatgctgctggtatagcaaacttgaagtttaatgccacaatttgatcctcaataagtgacagtagagggcatacaacaaccgtaacacctgggtgcagtgttgcaggtagctgcaagacaagtaattccaggtggagtttctaagtctcgactcatgcgtactgaaaggtcaactctagatgaaaatgcagaatttacggacctgataacacaagctcttcccaccacctgttggcataagcacaaaggtgtccatgttgcttactgcagccctacaggcctcatactgcaggggcctaaagcttttgttgccaaagatgacaacgtttgcaaaattgatgtcatctaggctatacagctgctgataacttagagtttctctgtttgaagttgaagtggatgactcacatctattgtttcctctgttcaccttcaaaagaaaatatggagtttgaaacataaagatcaatgaatatgagattagcagcagaaaagcacatatttgaaagtggaaaagcatggaagtccaatattggtaaatcagggtaggtagcttatagattaattcgagattctattgtgcagtttagcgtttcgagatcataccttcttctgggtactgactgaacgatcacaatgggactccaacgtttcaaagtcatcatctgaggagaacccgaaggagtccagattgatgcgagtctgtcgagcagaggattctgcctgtctgaacaaaggagttctcacctcaacttctttatcatcaattacaccgtgcttcatcatgccattcaaattgccacaagcttcattctctatagcattgagatcatcccaatcatcattattgtttgttgcatcagccaatgcgccaaggaaatcgtctccacagttctccacggtaataaaaccttgtccgccctctcctgtaccagaacattcaattataatctagtgaccaaacaatcttacctttctagataatatcaaacaatctgaaaagtcagctaagcaccaaaatttttatagactgaaaagcaaaattacattgcagcaaaagcaagcgcttgatgtggactatggatactataatatgatataaaagaatatcataactccatagatagtgcatactttaaaggttgtaagaggtcccctataaagttaagaaacggaactaaaacccaccaaaatttagcacagatatatgtaacaagagactttctccagtacttggaaattaagacaaccgttgatcaattaaaatctaatggttagcacaaggtacctatgaaaagttacctaaaaaggtaggcgaaattttagcttagaggttggctgaaaggttagataggaaattttgtccatggtatcatattagatgctaaagacaaatcagtaaagttagttcagttcttctcgatgaatttgctgcttcggatcatggggcagttctctatggtgggtggcagccggacctattatgaagttcccaatttcgattatatggtatctgtgattgatagcagaacatagtgtcatataattttaagtttcagcagctcatgaatagaagctagggctggtgccagatggagtgagccattagagacaaggaagtgagccaccggcatgctctgccagggaagaatcatgcatttggaggtggaaagggaagaccgatcgtacatattgaaaaaaactatataattgatcaattatcctaaactgtgtaaaggacgataaaacttggtaattgatcaataattgcacaccatgtaactgatgataaaactatgtaatttaccaatagttgtccccacatacctacactaagattcccatttacaagtaggcaactcatcaaattggtttagttatacaacatgacttgctaaatataaatttgcaagaaatgtaattgtacctaaatgctatgtaactggctaataaagaacatataataccagaacaacgcgattgactgtcatggcgtttactgatgattctgaaataaagcaggattaaaatatctcttcctttcgcacaaatggattacaagagaatgattctgaaatgtcattttttttataacaaccatcagagggaagaagaaagtggatttgattcagtggtggcagaaggctctgtaggatgcagcgatgcaatggatgtgaaaaacagtaatgggagcagcagctagaaatgaaaattactgaattgcacctaaatgctatgctgtgtttactgatgactatgaaataaagcaggattgaatgtctcctcctttcgcacaaatagattacaagaaaacgattctgaaaagtcattctcttttataacaaccattagagggaagaagaaactggatttggtttagtggtggcagaagcctgagtaggtggcaacgatgcaatggatgaaaaatatagtgatgtcttgtgacctttactctaaaggtaaaaaacataaaattactgaatagtgatgggagcagctggaatttaaaattactgaattagcctgacaaactaatggctaaaatttgttgcattttttcagtcaaaagaagatccatagcatttcgagccttcgagggatcccaaaactaaaacaatccccaactcaaaaccccaattaactaccgagaaatcctcctgcattatcggtagaggaaaccgtcggcagcggaggctagaggaggaggggaacgaggtcgagcggcggttaccgtagaggcggacgatcctgtcgaggcagtcggcggcgaggtcgcgctcgaagccggagtcagcggccaggtcgagcagccgcttcttctccctctcgtaccccgccatctccggcgagcgcgccccacctccgccccgccgaatggaggaaaccctagcgccggtcgccggagagaggggcaaaaaaaaagcgcgggaaactgtcgcggtggtggcgcgcgcctccgcttctgagctttttggcgccgggagttgtggatctcgtgggccgtggaactctcttgggccgaaatttgggctgaaataagatttggcccaacatgacactcggtccagtatctgcacagcaaaagcccaacagtaaaactatggccctagagacggcccaaccactggaaacctgaaaaaaggtatttacttgatttcaaggggctgtttatatggtaaccaaaataaactttatcaaattttcgtaaaaatttataatattgataagttttgacatgatttcttatgtatttatcaaagtttggtaaaaataaataaatgtatgcatatctttagtaattttaccaaaaaaaaatgttatgatttgaaataatatcaatctgaacaaccccaaatataactagttattttaggcttatgcacaagaataaaaaaggatgaaaaaaactgtcgccagactgaaaagtacggaactgtgacgtttgattttattaagtacagtgcaatgttgcactattataaagaagctgcaagctagtactcgtaataaaccatttggtagtaaagttggagtaattgcatcaaacagggtacaagagtaaacatgatttatactacatgtactactgtacatttgattgtgtgcaaatcaaagtacgcagggtgcatgtaaggtttagatagctacttgaatgggtacactttgatctgtccgtttgattgagtaaaaccatggaagttgtgcgagtaggattcacaaaactcatgaaaaatgttcaattcttacgaattttcgtggttaccagcctacttagctgacaaactacgaggtaaaccagatttgaaataaatcaaagtaaatttttgaatttcaatgaaatttgaaatttacaagtttatcgacggttttcaataggtgaacggttatgtgaaccctaacaagcattcgaggaatcaaggctaaaccgctaagggcaagcacaatgtagttttatttgcttgttgccagcaataacatacagacatagtaattgttattattgttggtctgttaggcagagtttaacattgaaacaattgttttgatacttctgaaaaatataggttttatagtttttagtttatagtttatttttttagattttatagctacatattcttataatttagatgaaaatttatacgatttgaagtgagtcggagatgttagaagaagctatgtttgaattcttctaaatagagccattatctctttctacgatgcttctcgcgggataatggcgattctggataccggattattgatactagagtaaggattttagatggatgtgacacatcctagtacaatgaatctggacaaaccatatgtacagattcattgtactaggatgtgccacatctacccaaaatctcttatattatggaacggagggagtatcatatttgtgtggtcgcactaacagaggtttgtgatgcttatgcttatatttatatgccaaaatttaaatttttgaccttaaatttggagctgattttagggttttctcatcaaagtttatttttcagtctttacttttaaatcgttgagaacacgtatataaaaattttattcataaattatttttttttgtaaatataccgtttggtttattccacgaataagcgaaatgatggggctggcaacagtgatcgagatgggctgagtgcaattgtgatcgcggcgaggggggggggggggagcaaatacggccacgcacgactccacacgttccgtgcgtacgagatgcagatgcacgcacggttgcagcaaagggaaggaggaagcaaacatactattcgaccgttccaatactgttttaacgagggcgctgacgtggccatgccttcgtgccgtcctactgtcccatagattattgatgcgcgtaccatcgagtggtaggcgtagagtagagatagtatcttttaactagagtacttgtatcctgtattccaaaataaattaaggctatgggtgtgtttagttcacgctaaaattaaaagtttggttgaaattggaatgatgtgatggaaagttgaaagtttgtgtgcgtaggaaagctttgatgcgatggaaaagttataagtttgaagaaaaagtttgtaactaaaagtggcctatgtttagatcgatgggtgaaaatttttagcgtgtcacatcggatatacggacatacatttaaaatattaaacatggattaataacaaaacaaattacataattcacatgtaaactgctagacgaatttattaagcctaattaatccatcattatcaaatgtttattatagcaccacattgtcagatcatggcgcaattaggtttaaaagatttgtctcgcaatttacatgcaaactgtgtaattacttttttttatctatatttaatactccgtacatgtgttaaaacgtttgatgtgacggggcaaaaaaaattgccggtggatctaaacaccccctaacttgtaaagattaaattttatttgaaataaaccaacttttatcctcttgcttaccatcggtccataaatcatgaattttattcactcaatatctctcaactactccctccatccgaaaacaaattaatattgtatgaatctgggatgatactatatcatattccctctatccccaaaaaaaaaccaatctaatattgaatgagatattttctagtacaacgaatagactctcttttatcaagattcattatattataaaatagcacattcaataatagattgttttcttttaatggaggaagtatgtcataataaattaacttattttggaacagggttagtgcccggctagcacacaattttcttattaatggaggatattttagacttttatttttccttttgagtactgcccgaatgccacgcaacattagagcaacgataataatatagcccacttcatactattagtgcacccacaatggttatctatagactctctacaagagatccatgtcagtatattttcctatatggaagatattaaatgaagagggagagcaaagctatctactaacttagagatagtctatagagaaaaacgaggcaatgtatgagagagctatagatacccatgtagacatactattgaggtggtttactattaatctagtctattgctgagatgtacatgttttatagatagcaccttactttaccattgcgggtgctcttagcttatactaaagttaacacatataatagattagctataaggttagctataattttcttcttctatctctatctctcacttatacatttaatgtatttgtcttggagtttgtgttaagctagctcttgcatgagagccaacactattatattttgtttacctctctcctctacataagtttatagtaggtttatagctcactattatacttgcccttatgggagatgtatagtaagcgcgcagccacgatgatgatgaccccatggaaagttatagcctactctatggagtacgtacctgtactgctgtacatagccacacagacagcgtacgtgcacgctctagctctagtaggctgggatgggagagtaggaggagcatggccggtgtactactggcaggcgactttactcacctatacaggtattctaccagtacgtagaatacaatactacggagtactgtatatctgtatctattcaattcactctcccctactcccccgtccctaaaaatccatcttataaaggtccctttaaattatatgaatgtaaaaacagagaaataaaaaaaataggattctgacaagaatacgggtgtcgaaatagaaaaaaatataggatcttgatagaaaagtaagtgtaaaatagatgattgcaaaacgcaggaaaaaactgaatgttcatttgattgaaccgcgggaagaacgcagaaaaaaacatgaatgtccatttgattgaacagcatgaaaaacgtaagaattggatgagagagatagactcaaagaaaagttaccaagaggttgaaactcttactaaatattctccaaaatctatatagaattgtccattccataggaatttcaaaggattggataagatttaatcctttgtttcaaagggcttcgtaggaaatttttctataggattaaaatcctccataattcctatgtttttcctccaaatcaaaagggtcttacaagtgtaaaacaatggattggaaaaatacgtaaatgactgtttgattggactacagaaaaaacataggaatcggacgagagaaatagactcaaagtaatttttcaagaggttgaacctcttgctaactttcctctaggattacccattcgggccctttgaatcataggaccgagaatacagaggaacagaaaaaaaacacatgattctgataggaatgcaattgtaaaatagagaattataaaacatagaaaaaacacatgagagatagactcaaggaaagttttccaagaggttagagtggatgttaaattttcttcgtttttcctctagaattgtaggaataggaaagtttaaacacataaaagatagactcaagggaagttttccaagaggtcagagtggatgttaaattttatttgttttttctctagaattgtaggaataggaaaattttttacgtttttccttttctcattcttatgaatcaaagacataaatagtgtaggattttattttttttatttttccttcatttaccctccaattcaaaggggatcttcgtatgtattttaaaggatatgatatgtttctaaggccgagtttagttccaaatttcttcctcaaactttcaacttttctatcacatcaaaactttattacacacataaacttttaatttttctatcacattgtttcaatttcaaccaaactttcaatcttagtgtgaactaaggccgtggttagttctccctctattcccaactttccatcacattatataacataaaaactttcatacacacataaattttcaacttttttttaaaactcccaactttcttcaaacttccaatttttttttttttgggaaaacacaccctaaacacaccctgagatggatggccgggcgggggcggcgcatcgcatccctcatgcatggaaacgaggtcgagcagcagctacagatgcacatagcagagctgccagagcagagggtggcgccgtgcagcgcagggcaacgcaacgcaaagcgcaactcttcctcctcctgacacaattcacgcactgctcctctactctactcgtagctcagtttagccacacccacacgctcctctttattacttcctccgtcccatgataagtgcagttttgcactattcatattcaatgtttgaccattcatcttatttaaaatttttttatgattagtatttttattgctattagataataaaatataaataatattttatgtgtgactaaatattttcaatttttttataaatttttcaaataagacagacgatcaaacgttgggtacggatatccacggctgcacttattttgggacggaggtagtatactgtgcgccgcatcacccgtccgatcccacccacggtcccctgtctgcggggcccaccgatcggttgggacccacctgtcggtggcggaccttcacgggggccccacctgtcatagacggcaacaccgcccctgtgctaacaactgtgcactcacggagctttacctcatcagtctcagctgagcaggacacgtggatggatcacatctactcccgctgtccagctccttaatttggcctgctacagtacagatccgccattaatgacgactctaatcacatcccaccatcgaataaacgtgctgttaaagtgttaattaagacgatgggtgagcttctgcaaacaatgctgctagtgtcgtcagtgagtagtacacacaacatatctcctcttctgatgctcggctgacgacgacaggagaggagaagaattgggaagcacacaccactgcactgctcctgccatctccaaaacgaagagagcagtgtatatgatgatgatctgaccatggatgtgactagcaacggctcggcaaggagaggaataaacgcgatacacgcagacaagcagcaccagctcacgtcttgaaatggatggaatgatagacaggtggacactgatctggacggatacacagagagagagagggatgcacacttgcattgcacatactgcagagagaagaaagccaatgtcgcctcaaccgcggagtttgcctcccgtgtcgggcacaccggtggttcctgttccgctccctgctccgccggattcggacttcggactcggcgaaagcgcgcactggtggtggtggctaaactgctccacttcaggtttggaatttggatgcttgacatgagcccaaaccgtcccatttcctattattgccactcctgcaacaaggctcaatctacctctgtgaatcactgctcaaacatacccctaggacctgtttggcgcagctcaatctacctctcctgcaaatgtgcaaatggagctcagccaaacagtttcagattcacttaaaatgaaagcgaagctgggtggagcgttctcacgaaataaactagagatgtagagctgggttttggctgctccacgactccacttcagacccaactcctgaagctaaattttggagttggagctctaccaaacaggacagaacaggttattaaataaaaagataggaaaaatcatttacaggttttcacaggatttcaaggaaaaaatgggttataaaatagcaggagtacagtgtagagaatttcctgttgtgtaaaatcaatacggcaatactagagatttcctccagataggacgatgcgacccggtcccacctgtcagagggatcgaataacacggcttttccagtagtacaccacaaaagaggacgatcctacaattacgcaatccaagagggttcagatctgatcaccgggacaattacattaccacctcaccccccgaaactcacccctaatcaccttagaacccctcaactccactaacacactgaaaccccaaaatttatgtaaaaccaaggggctgaatcgaaaaaaacccgagcagttaaaaactcccaccgtcccactcctcctcactcccaccacttcgctcgccgcaccaaaccaccacccccagccagccatggcggccgccgccgaccacgcagccaccgccattgccatccccggcgaccctctcgccgacagcgcctgctccaccccgttcgtcagcgcgccgtccagcccgacgcgggagcgggagcgggagcaccacttcgcttctccccacggcgcgccgtgcttcttcagcgcgccggcgagccccacccgcggcggcggcggcggcgggtgcctcggtgacttcgacttcgacttctcgtcgcggttcccgtctccctccgcggcggcgatgtcgtcagcggatgagctcttccacaacggccagatccgcgctgtccgtctctccgcgatgctcctccagcctcagcctctggctccgctcgtcgacggcgacggccacgcgtcgcatctggcggaggaggatgcggcggcggtggaggaggatggtgcggaggccgacgagcgtggccgcatccgcagccggtcggttcgacggaaggcgcggtcgatgtccccgttccgcacgcgctggagggcgccttctcccgcgccggagaccgccgaggaggtcgaggcagtcgccacgccggcggcgtctcgctcgtcgtcgtcctcgtcgacggcttcctccgcttcgtccacctcctcacgaggctcccgccggtgggcgttcttgaaggatctcctccaccggagcaagtcggacggcggcaagaaccaccaccacgacaccgcgccaccgcctcctccgccaaagaggagcccgtccccgtccccgtctccgtctccggctccggcggcggcgagcgcgagaggagggagaggggcagcaacggggaggaggagcaggaggagatcggcgcacgagaggctgtacgaggcgaggagggcggaggcggaggagatgcggcggcggacgtacctgccgtaccggcaggggctcctcctcttcggctgcatcggcctcggctcccgcggctacggcgccgtccacggcctcgcgcgggggctcaacgccgccgccgccgtctcatcgcggtcatgactcgtgacctccatggctgctcccgccattgatgccgttcttggagctcggatgcatgctgctctgcttgctcgtctgtgtagtggcaaatgcagtgtggaaaaacctgcaaaaattgcatagaaaatagtagtagctagtattagaagtttgcttttgccttaatactagtttcttgtatggattttggtgatgtaaacaaagcttgttcatctggtgatggtgatgaccactcccttaacaatggcaaaaaatgtgttcttttactacagtacttcagaactatacttgtattaactggaaatcgactgatcatcttatccttagtttgttcatttctaactgttggtgtccggacagagctagatctccgaacaaaatgtctgcgtttgcaatagtagtagtaataactattgctagtaacaatctccctttgttcactgtaaaattatccttcacagatctttggcttccatcacaatcttctccaaagccttttgtagtatcaaatgagttctttttgtaggaaccaataaagctaacaaaggtgagtttctaggggtaagatgtcgactctgaaaaccaaaccaaacagtacagagatcaagaacagcttttctcatgttattaagagatttttacatcaaaattattgctcaaacagaatcaaaactactaagaaaaaaagggctggattattctcttccgctggttttgcttaacagtgggggtaacatcatcttttattctcgattattatgtcatgcattcgagctgggacgacaggctcaagtacatctcacgtgacagatgacatgtcgtttatcttttgtgcctcgggctcagtaattttatcacggacagaacaacgagctgtgttaatctatgctaaactactgtttactttgcggtgattatttacctaaccaaggtaaccgaataaacggcctttcaccgtcctggcgcgacttgtccctaatcgagaccctattcttttagtactagcaataacaaaaggaactcacaaagtcacagttactagtaagtcactagctacaagtctaaacatcagtacaacactgcaaccaagctaatagcaccaggagcaaattccaaacagaaacaaaatttttatcaagtttgttttaccttaacttgttaggcctaaccaagataagtcacctctttcactttttgttggaagcatgcactttggatgcttgtaccataagttgttcagcgctgcatgcgtgtgctgcaaaaagtcacacgcttcgtgtcaagatctgtcaaacccaacgcaacaatggtgcatttctttactcttagtaacagattaaccgactaataaccatctgtactgtgttgattcttcattctagtactatcatactcctaccagtatttcaatccatttcaacgaaaaagagagaaagggaaagatttttgggagaggaagcaaccataccactttgaagttgagttgacaacatgataaaggtcacagttgcatggcaacttcatccggacagtcaccagcaacacgcagcaactgcactctccagcacaaggaaagctgaaggggaaaaagattacgaagtgagaattcaggcatgtggatgtgacaataccagcctcccatccatgtgtgttcctttccgaagcaagcatgtcaccgtacctcaaggcaaaccacaataaatatagtccgatgcagggatgaaacgaaaggcgccatgccttgctgtgttctttcgctgggagcatagtatgtcctggttcatgcaggggtagggccatcaaaatgccagctttgaaagggatgaaaatagagttttgtacagtagttggaagaatttaagaatgtagtaatgactatagtaactctgacagtcgacatggatctggaaattgattgtttgatcacttgtagaaatattacgatcataaatgaaattatttttaaaggtaactagaaaaagagacatcactgattatattctttaattcttagatggtgttcatttctatcgaagatgaagatgaagttggggtacggaaaacaagaaaaccattaatatataattaattaggttttaattattataaacttaaaaatagatttatataatattttaaaataatttctatatagaaaagaacggagccaggcccattctaacctgcagagacttaagactttcactaaccgtgtggactttgaggctttgactagaaaaggaagttcattttcatactctcacatataatgatggatggcatctccagataccttaaatcaaacttggtctgaggtaggagtacttgccagcaacctttcctccctgatatttattttccagagtcgcacagatatgcagctgtttcgcacatcacaggctcacagcactgcaaaaaaaagattcagggaaagcgtaaatgcctatcatcacgatcacactaaaataaggaatccataaagcctttaagattcttatggataaagcttgcaaagaaaagctttgctgacctccaatagcaaagacactcgtgcgccgagatgcaataaggtcgccaggacactgaaataaccatgaatagaaaatgccggtagtacttcatcattggagcgccacatcactaaacatttcattcccctcttttagaagcacataagaattataagttacattgaatgattgttcctagtttaatcgaccttataatacttgcgagaaattaagaatcgaagtgggacgaaaatatgcaccggtttaggatacagcagcatgcatatcttctgctggattcactatatggccgctgttgaaagaccatattgcttggggattatgcttgctcccctggaccactggcatttagcagcggggtcaactgctgttgcgcctcccaccggtgtcaccgccggcctacaccgcgcaaccggcgcgtcgatccccagacggagaagccaatgtggccccttcagtgtgtggcaacacgggggccatagagttcctgagaataaaaaagttgttagcaacttgaggggcctcatgggcagtagataaaacaagaaatgccagtgccttccccttacatgtttgtggggacctgaatgcatcaaaatgagagcagattagagagaatccaaaggtgggctgcatgtgaatgtgattgtgcaaacaaagagtatcacttattatacatctaaagaaaacaagagtatctctttatctccccgttggaagaaattaggaaggataacacatgggtcattggctcattgacactaatctgtacaggaatattcatgcattcttttgcatctattatctggtgatgccaaatttttgcagaagcaagatcattggataaattatctcatgcagaaacatataagacattttaaaagaagaattcaaaattttctaatatgtgcccaaccaagccttgcatgctgttctatctgatttcattcccagcaagaaactaagcaaacgtggagtagcttaacggcctgggttcgatccctggttcctcaccttccctctctcttaaatacattgatactaagtccctccttagtatcccacaagaaaatcagcaaacatgctattactgtccgtcgtattagcattacaaagaattgatctttctagattgaagtaactgaggctcaactcttgaagcaagttcaagtcagcttgataagtatagaatatcctgacagatctttctgttgcttattttaattagagagaattataaatctaactagaacatcttacctcaagaacacacaattgtatgggattcaagttagacatagatccatatgtcagcaaaaccaatgcataaatatgcacaatgcaatcataagatatcaggtttgtcaaaataaatgcataaatatatactagctaaatgcaagagctttggatggaaggataaagatcaaaatggttcctttcccttttgcatcttccatgcctttttgnggtttttaagnngngatcgttccccccattnccctccagcagtaaaaaatgaagacaggacaaaaatcacaaggcccaacanggaaatttntnangnnnnnaaacagcatcctttttatttgttttcttttttnttgggaagccacagccaccatttttagaggagcccacaaaaggaatatgccaaggttggtgnnggggnnnntcaatatgagtataggtccctgtgttaaattttgtttccgtatgtttgctagcattctgtacgtgttacagcgtcggattaccttttatatgacgacagcatgctatagcctctctctagtagtctagttcctttcagtacccctttttgtgcccagcccaagtaataatgctaaaagagtgaacagcctgctgtctgcatagacaaccataaactgtaaattcagaactatgaaagttccctactctcgaaatgtcagaagtctctgatctttagacaatgttttatttttcaattccttagctgtagtaaaactaactgttggcacttggcagagcaatagttataacttgtgttaaaagaaaatgagtaacggatatgctactatttatagatattatgactataagtatttttaattttagataaaaagtaagtattcatttataataatgcatatacaagatgtcaggaactaaatgtgccaagcctctactaacatgtaataacgtaaattctgcaaggaagatatctgctacattagagagaaatgttctaaaaacacttctattactagatatatcacccacatgcatagattatatagataatattgttagtataatccttgttctagttagttatttggtttccttaggcagtaagctataggctgcagctgttactcggttgtcagacagctgctattagtggtagtagtcaattttgattttacctctagctggaacatagcagcagcagtattgtcggttcagcaaccgacctatccatgtactataaatatagctattgtgctaacataagtaagcttttcagctcattttcagtttcagtttcagctagactattgagtgtagttcagaagtgatcctaccaacaaatataggtgacaattaagctttgttggaagtttacaatatctgaactaatcgaggaatatgaatcgcgtgtgcggaactaataaccagaactatcgcaaaatttatagcaatcatgctatagctgaattttaattgcagaaaaggttagctttcccgtatgtcatattatcatgtgggaattgacatttgacatatacataagaaacgaatacatatctgttcatagttagagtaataataaactttactaatgtatgcacacacttcgttgttctgagggctagaggtgctcaaatatgcatgtacttagtacttaattcttattagtgtgctgttccttgtggtgcattataaaacaaaggagtaaaatcgttaaatcggtccaaagaatgcagaattcatgactctcatatccaattttccattggaagtttgaaaacttcactgtaactttcaggatgaccactagcaataggacttcccagaaaaatattttttgtcacaactatcttgttaactttgttgtcagttaatagtgtaatgagtaggacctccatagacccatgaaacattaaataacctatattgactatagtagaagttgaacattacatcttgttatttcaactactgtaactattaaggtatctagtgcatccataggccatagctcccaaattaatcatgaattatatccattaaggtatctagtgcatccataggccatagctcccaaattaatcatgaattatatccattactgggcattaagtccttagtaaagattattgagtaaagcttcctattcagttcaccattctaaaataaatgttaagggaatacaaaatgcataaagaccaggaactgttacctgaaatgaccagcctttgtagacttccacattttggccctctggggttgtgtacttccgcagttccacacagttcactgacaattatatcatgtatttgtgaactgaaactcggtttcttcgattaagctctgccctggagccttttgcacactcatcctcctcatcagtctcctcgcatcccctgcctcctcccatcgtcctgtttccgcataaagattggccaacaggacatagttccctgagttccatggttcaaggttaataagttctttcagtgccacctcagctatgctaatcccagaatgagcatggcatgcgcttagcagtgcaccccatatcgcagcattaggtctcattggcatcccttgaatcaatgcatatgcctcctcaagaaggccagatcttccaaataaatctaccatacaaccataatgctcaattactggctcaataccatgctctagctgcatgctctggaagatgtccctcccaacatccacagccccagcatgcgcacagcagccaagcacccccagaaatgtcacttcattgggcatctcaccgtgtgtcctcatctctcggtaaagctcaatgccctcaatcccatggccattcaatgaaaatcctgaaatcatggtgttccagctcaccacactccgctgtcgcattcccttgaatacctcccttgcactatgaacatcaccacacttgcaatacatatccatcactgcatttgcaacatgtactttcctgtctagcaacccactcttacgtgcatgctcatgtgcccatctccccaccccgacattccccaacctcccacagaccggcagcacagcagcaagggtcccatcatccggtgccacctccccctccctgaccatcctctcaaagcacaagaccgcaatgtcatccttcttgcaccaagcacaccccgcgatcataacattccaagaaaccacgctcctcctggagcgcctgtatctctgcatttcgtcgaacaggtggcgtgcggcaccaagatcatcagctcggaaacaggccgtgatgagtgtgttgtaggcgacggtgcacttgttcctctgcgtcatttcgtcaaacaggacgcgggcgtagtggagaggatatggcttgaggagcgcgagagagatggcgtgatgtgaaaggaaaccgaggcggagaagaagcgcgtggactgcggagaggagagaaagggacgatacgcaacctaggaggggcaggaacgagaggcggtcgggcgcgtggaggcggcggagagaggagaggagccggaacgcgagcggcggcgaggaggccgagagggccttgatggcggcgttgaggagaggcagcggaggcggcgcgtgaggcgggacgaggcggaggagcgggagagccggcggcggcggggaggagaggagcagcagcgcggcgagggagtggtggtgcggggacggcggcgacgacgggaggcagtgtcggacggcgaaggcgaggagctcgagcggccgccgccgcgcgggaggggagtggtgcaggaggtggaggaggcgccgctccgccgtgcgcgggtgccacccgtccggcgtcgtcaccgcggcggacagcgccggcggctcgccgtcgccggccatcgg

SEQ ID NO: 72554 - DNA, 582 bp, Oryza sativa
gacgattcccgccgtcgggttcgtccacccacgccgctggatcgccggaatcgcgggcggtctccgtttatgctgtacacagtgcccatgttcagagacgcaacgcgttgcgtagtgaagtgcggggatgtgtagggtagtttggcttgtcattgctcgcttgctcggtggagaaatggatctccgattctccgtttcccggcttgagcgaaagcaggtgggttttaggattagccgattttgcgatgttgttctgtttgttcacgatacaattcactcgggtgtgctgtgctacaaggctgctctgcgggccttctgtcgtgtagattagcttcagctgttcatggattgttttgcaagacatagaaatggggcatttcgttctgtttaatcggttcactctccgagaggatccccttctgaatatacctttgacaaggaactggatcctaaatattgaagtaaacaagtctctgattttttttctacatatttcgtaataacttggatgaacattgctatcgcatttgtcgattccttattggaacacgctcggatacttttgcgcttgtccttggtcag

SEQ ID NO: 72555 - DNA, 721 bp, Oryza sativa
attcctgcagcccacaccaaaagcacactttgttggattcatctttaaaccatactttctggttctctcaaaaactttcctcaaatcggctatatggtcctccacctgctttgatttaaaaaccacatcatcgatatagacctctaccaacaagccaatcagatcatggattatgtaattcatggccctctgatatgtagcttcagcactcttcaaaccaaaagtcatcacaacccactcaaataagccgattgcaccaggacatctgaaagcagtcttgtgaatgtcttcttctgccataaaaatttgattgtaaccagcattgccatccataaaacttataatcttatgtcctgaagcagcatcaaccaattgatcggcgatcggcattgggtactcatccttaggtgtagccttatttagatctcgaaaatcaatgcacaccctaaatttgccgttcttcttgataaccggaactatattagaaacccactcggcatatcggcacggccgaataaaaccagcatcatataatcgagtaatttcagccttgatagcatcatacatttgagccttacatactatatattcttatttctacataatattagtaaacaattatgaaatcaaatataacattttgaaattaacatatcatatttaacaaactagatgatgggacgaccacatgacatcaaagagtatacataaaaccaacaaa

SEQ ID NO: 72556 - DNA, 696 bp, Oryza sativa
tgaagatcattccaatcctcaatcttacgatcatgtacattccaaatgcgtactttttcatccagtgatccactaatgaagaagttatcatccacgggattgaactggatgcaagtcactgaaacaaatttgagtgcagcggagtaattaattgtcaggctgctccaaacatatacatggttactgaagaaaggtgttcatacatagaaaatgaccctgtagctagacttaccatagtctgtgtgtgaaaatgttttcagacaggtactagtagtaatgtcccatagtttaacagttttgtccattgaggatgaaagcaagtactgcatgataaaaaaccaaacaaccagttagcacctccatatagttgtattcagtttaaactggttttctttcaaacttcaaagacatcaatttacaatgggcttgttttacaaacttcagatgtgaagtccatgttcattgattagcaactaatggtttcattgttatatattccattcagtgagtaagtgaattaggttaaggaatgagtgaaattctttcaattacagattagaatagttaacaagtttgaatgcagctcgtaataaaaaaagtgtcataaaagccaatcaaaaagcaggggcaaaagctaaatatgcatattttgtatagtatttatgtgtcaaacctaagtgaccttagaacaacaga

SEQ ID NO: 72557 - DNA, 4486 bp, Oryza sativa
tcttacgtatgaaaaaacttgtctaaatatctctaattttattttgaaacaagccttacttgtgtggacggagatactccctccgtttcgaaatgtttgacacttgatttttagcacatgtttaaccgttcgtcttatttaaaaacttttgtgagatatataaaattatatgcctacataaaaatatatttaacaatgaatcaaatgatataaaaataattaataattacttagacgaatggtcaaatatgtgataaaaagtcaacgacgtcaaacatttcgaaacagagggagtagtacaaagcgagctcatcagtgttcactccaaccgttttaggttgtgtttagtttagcacaaagtttaaattttgattgaaattagagatgatgtaactcgcgagctcatcagtgttcactccaaccgttttaggttgtgtttagttcagcacaaagtttaaattttaattaaaattatagatgatgtaactgaaaagttatgtgtgtatgacaggttgatgcgatggaaaaagactgaaatttaaatccaaactttagatctaaacacagcaattagcaaataagccaaaacgaaccaacccaaaaatgagatgtgcatagccaaacaccatttactatcatgggcaattataagcaacccaaaaaagagaccgaactggattgagtgaagcaaactctttcttattcatcattcatagtatgtaccatgacatgccacccgcgaccgagaatatacattgccgagaggcgagagcccaaagatggacataaaaatttaaaaagaagaggtgaaaattaagtaaaaacaccgcagaaaaatagattggcgcgcttcacgctagctgcaaatatcgctctaataatctgcatgcttcggacggagaagcacatcggatatagagaggaggaagaagaggaggaagagatgagcggcggcggcaaacggcgaggaggccggcggcgagggcaggcgcacggcgacgagacgacggcgtacggagcgccatcatcaggcggcagcgtcgtcccaggtggcggcccagttggtggcgctgccgacgcggggcatggagttgatcttggtgaaggtgtcgaccttgaaggtggcgccgcacatgacgccctcgctgtccacccgcggcatcgccttcagccggttcatcgggtgctcgaagctcttgagccccccctcgctgtggaacatgcaccccaccgggaacggcgcgtacgacttgccgcaccctcccttcacgatctccctctcgtcgcagatcaccaccgacccatccgccgcgatcccccaatacaacggcacctccccatccgtactctgcatcgcgcaaagcgaatgaacgtcaatatataagaaaaagaaaagcagaacaatcagaaactgaagcttaggaactactacggcggctaaacacaactcctaacagcgggaaggggacagggccacgctacactcacaggaagttcaatttgaagcacaaattcatcaattcgattcagaaaaccagtctagtagtggtttaaattaccagggcggcgaagacggcgccggacttgttgtcgaagacgacgaaggcgaaggagccggagagatccttgacgacctggtcggcggggtaggggccgcggtcgcggagggtgcggtaggcctcgatgacgagcagcgcctcgttggtggagcggctgcacagcccgtactgccggatcaggctgctcaggttgtccagcctccccatgaacacgcagtagatgtcatccagcccacagaacatcctgtgtacacacccatttaccattattatcgatcccctacgttttaatcaccttaattattcggattcattgcctcatcgattaaattgatttaatttacctctcgtagccagagaggccattgcgggcgtggccggcgacgcaggcgagggcggcgccgccgccgaaggaggtggagaaggcctcgatggggtggagggcgtggaagtccctgaggatctcgtcggggttcttgggcttcgccgcgctgctccgcgggctgttcagctccgccggcgcgtgcgccacctgcttctggaatatggccaacattttcttcttcctcttgctagctagctccgacgaatcaaactccggcgccgacgaagacgaaagaacacgtagtactttagcttagcttagcttgagctgctgctgctgttcgttgcgtgaagatgagagacgtgtcgggttggcgagtggaatggaatggaggtgaggatagagatgtgcacggctttatagacgggatttaggatggcacgaacgcgaacgaaaatatcctatccatccctcgctcgcgcgcgctgtttgatgagcgtgttattggagtcagtgctgatgtgagaagccaaagcaagcagcgaacgggataaagacggcgagacgacgaggataagatcatcacgtaataccagttgccgctgccgatgtgacaccagtagtagtaaccggccaccttaaccgtgacgtgcggtgccctcaccccctacggtaccctgcacccaaagcctacataagtaattgtttactacttccgttttaaaatataaaaaaaattaaatagatataacacatactactaatctacatagaaaatttgtttaaatttatagtattaaaatttatccatctatataaatcttttatattacaaggcgaaaggagtattacacacctcctcgtgttggttgttgatacggttttcttccgtttctatcgagtcgctgcacgagcactgttttcttgtgaaattcctaccctgcacaagtgaggatgctgtacatggtctacacaaaacgtgattaaaaagaaattcgcaagaaagaaagagcaaagtagaacaaaagacaaactagtaaactgatgtcgtagatctgtagaacttcatgtttttgccgccggggtagccgagtaggatgaccggaggtgagcgaaaaacggaggaaacagcagcgagggacgccttttccgtgggctgccgccgttagtttggcgggagcggtttattatattaccccgtaattattgctcgctgaaccacctgtcggacacgtcatcgcctactcgaactgcgtgctcacgggggccacctctctacggcctccgtggacgcggcgtgccacgtaggctcgcgcaccgccctcacagcctcacccaccgcaactgccacgtgcgcgccgcctccttcccgtgggctggggaggtaaacgccggtgagcgccgagccgtacactgacagggtggggcccacaccgagcgacgacaaaagtgtgggcccggattggggataaggctggcacggtatggtcgctcggtacacgtcacccgcgcgtcggaccggagcgataaggtccgcgcgagcaagcggttgagccggacgcggcaccaacgtgttgtcacgtgtccgactcggcagcgagtcaccttttttttttctctcttttctctctcttgtcagggcggcaacgaacgtgtttatactagtagtaatcccaagtttgtggtcgctgttacgcgtgttaattatggtgattaaaaactggtcaggtcgatcgagcggcgagcgatgagcagttgagcacatgcattggatcaggaggcgtgactagagtacaggtcgccaggtcggtagcgctgatcttggatggccagtagattggccagacgcttatccaggccagagttgttaataatctctatattgctacttagatgtagcttacggctgacagaatcctgctgatgagatctagtatcctctaccggatcatgacagtccaaactgtgtgtttacataagcagtatggaagatgtcaacagatgctgcatcgcaaggagccaaggaacaactcgcatgaaattgttgtactagtgtaagttactccctctgtgtttcatgttataaggcattttgactttagccaaaatcaaactgatttaagtcaataatttaatatattttcataataaatttgtcttggcttgaaaatattattattatttctataaatttaattaaatttaaagtattttgactttgatcaaattaaaaaaaaatcttatgacttgaaacagagggagtactgctaagggatcgagtgcatgcaggttgccagttgtaatagttaggaattaaaaacatatttattgttatccgatggtattgtagaaattctatatctatagccttttgcacgcttactactgccacacgctcatctcatgctcgacagctccaggaatactagctagtaagtcagaaacggtcgctttcgtcgtcatactttgtaattatgccattttaattttgctccaggagtacatttctttggcatgtttctatcctacccccgtggattcttgatacttgccaactttccgttctgctttactcgacggagacgtgcgtttcacaagctct

SEQ ID NO: 72558 - DNA, 788 bp, Oryza sativa
acagaatcactggcagagaaagataggtacgattctggagactcaatatcccacaattgtaccacagctgaacctccatattcacaatcacttccacatgctagaagattttcactacagaactccattgtatcaattgaaggatagaccatatcctgggacctacatcaacacagaagttgacaaggtttgacagctacattaagatgaattagaaatttgcaagcttaactggaaaaataatatgttgagacatgcaaaccagggacattttaagtttgcaccacgcctatcgataaatagattgcataattgagcaaaaacaaaattaacagtggatgaaaaaaataaatggatcacaaataaagataaccaagaagtttcctttgcccaaggctacctagtagagaatacgtagataatgagtatagcagtaaacatttcaaaatcctcatgcatttagctttaactggtgttaccacttaaacaaaaatgatcataaagacataaactagataatattttatagtatgaatgtatgataggcaagtttttccactgtgcgtggcaattatatgtggggaacagtataattgcaaaatatgacatacaatattttgcacaacaaaagcattctacctagttatgtagccaaggacctgattaagctgaattaaaaaaaaatcagctcaataacaataaggttctgtgcaattgtacattagtgtcattcgctcactaacccttatagacaaaactgccaagagctagtttccaagctcatgtga

SEQ ID NO: 72559 - DNA, 1891 bp, Oryza sativa
  unsure (1)..(1891): unsure at all n locations
atgatatgcatagcgaccatttctcactctatttttatcgtacttaccaaaagtgttcaactatccacctgcagtgttggaatgtgggatgttactttaggtcaaccttgtgtcagacatatcttaacgcataatcgatgtgctaatgcggtaaactttccaatattcttctgggtagtcctttagcttactcttgcagatacttcaattttgtcattgtacggatttcaggttgctgttgctcctaatgacgaatacatttccacagggggaagtgaccaaaaagttgtgagttgcttatttccccctttactagtttgttacgatgctctgtgttgcatggctatttatgaagattatatttaaacattataagaaaatgggaaacacaacaccaaaattttcttgatatggtttaccagggattggcataagtcaaaaactcaagatttacaattcataacttattgcatcaactgagatgaatttttgcctttatatatgctactgaaatcacatcaaatgtttgttgattctgataaaagtgtgactgttcaccttgttctctttttttttgcggctctagttgttcatgttattggtttttgcaggttttatatcatagtaaaagtgggtgtgcccaccttaattggcgtctcacatatcctctcccaggaaatgattaatgtactgccataatttgtagaatgaaatgtaagttattcttttgtgctttctgatgttgttgaacttgcaattagctggtacaaaaacagataagggaaccattaaaaaatagctaaaagtgtaaggataaaaggattactgtatgacaaggcattaaggcaataattacatggttatggtatcaatgcacacattgtctagtgtctactgctattcatttttaagcttcgaacaatggtgctatcttcacacaccagacataacttaccgtagacatctaatggaccaaataagaacttggaaaaaaaatcaaattggtgaaacgccttgttttattgcggagagacttggtgttttatcttcataagagattgagatgcttctgttatttcctagcgcgcgctgcatacttctgttcctaacttttcttatatgcacatctttttcagctgaggaattatctgcactaggttgttgaaccatagtaggaagtctgctgctccaaatagtacttgagccagggctggtattgaagcctctgcttgatggacgactgcagcttgtgttgggtcttaatataaatgaattctcatgcctccttgcaagttgagtctgtacctttttattctcctgtaaagagaatcttgatgaattaaacaacaatttgactgataattttctgtatcaccaatcgattaataactacttacccattgcctgtatttttcctcttccttttccttcagtgttagcatgtagtctttcagcatggccaataggggaagctgcaaaactgaatgttaaaaagtcttgttcaagaaattaagggacttctatcatttgaaaccaaatagttgacatttaatccaacttgtgggatttaggnggctatatttaaatttttttgcatgcggctattcataaaatgttattttattggcaaagtaaaatgtatcaatgcccaaatacataacaaattaattcacaaagatttgctaaccagcattcttatcagaatattatagttgagtatactattataagctatacactgaatacttcaaatacaccgctataaactagtgcataactgcatattgtttaggtcttggtaagacaaggccttcttttttgtcatagagcataagttcagggttataattatttattcttcatgagctgattgatgttggttgatttgctg

SEQ ID NO: 72560 - DNA, 518 bp, Oryza sativa
tatatatatatatatatatatatgctaacacgtaaaaaaactttgcatattaatatattagaaaaaaaagtgacacgccgagacgatcaaccagcaaagctcctaagctatgacctcttgcatgttaatatattagaaaaaaagtgacacgcctagacgatcacccaacaaagctcctaagctgagaccgagagaggaagaaactacactaaacataactaagctatgtgcctaacaactctccaactggattggcagttgtcgccacccattgcctcccttcttccacaatctgctccaccaccatcagcacttgagatagaacatcatcaaggacatgggcattcctctccttccatagttgacaagggagtcgagacatttcctactcttattatggtggcgatgccgcaaaagcttgccactaatcttagagcactgagtgacggcctggtgagagagtagctagtccatcaaaaatcaatactccctccgtacttgtaaaggaagtcgttttt

SEQ ID NO: 72561 - DNA, 1538 bp, Oryza sativa
ctcatccccatttcatgcaaataatcattttttattcagtcttacccctattaaatgtgcatgacacaccagtgaaacccccattgtgactggccttatagcccactattatccttgctcttagcagggatgctcggggatatatggtaagatatggttggatcgccatcaacgctgggaggtcagcagcggcgaatcgatcaaaatgttcaacgaatcaccattgccggcctccgtgggaaggcggccggccggctacgttaccgcaagatgattcgttggttatacgtctcattccactgatgattattgattggggctatccaaatctgacaacagttttcttttttaagaaaaaagaaaatctttagagcataactatagtatggttacagtaacttttatttaacttataaaaacagcgtgtgacacagttgacctgtagacacgtgtttgtgtcttgcagatcgtgcattctatacccaccttccatgcgcatcgtacatttttttccccttctccctgaacaaattttgatgcaatatgatactctagaaatagaaaatcttttcgacgaacaattggcgatagagttctagcaatttcattccaaattttgatgtaatctagcagttcagaaatcaaatgtttttttaataaacaattggtgacaatacttctagcattttcattctaaatttccaacaattcatatgtttaggagttatttttgaacataggaattttacaggatttttatagaaattagttcatttcataaacaaaatcccattgtattcattttagatgaggcttaattgagggtttgtaaaagttttcgctctcgcgcgtgctgtaccaatggatgtaatgacaaaggtagtgatcaccctcacttaaactgagtagtagtaaataaaaaaaacgttaatttcagactttaagatacgattgatttatgagaaggatcaatgacatgcattatcatttcgtgctcgtggctggtgacaacctgtgacgaaaggattaggtcacgctgaaaagtagtagtttggcacaacacaacaaaaacacaacaggagagaacacataatactatttttatacgatgccgtcagagatatggagctcttcgcttctgacgagtcacattagtcttatacagtaacaacaacaatagggcaattggatgatcgtggcgtagactccttcaaaacaaatcagatcacaccagatggacgtgtgaacatcaacagtaacagagcataattggttgacaagaaggcagcaatcatccaaaaccaaaacaggaaatagcagcggatgtcagtcgttgactcgtcaccagtccacctaagccaacagcaagaaaacacaggagctcacttaaaacgaggagttaaatcatgtagtagtattaattaacttgcgttaattaactctaattagggcttgatttttgttcgggttagatgaatgattttgtgaccacatagagttaaaatataaatttaaagcagtttactttcttttcatgt

SEQ ID NO: 72562 - DNA, 1524 bp, Oryza sativa
cacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgtaacattctagcattccccttgttcctgaacaaatgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgtcttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaataagtggaaatgaatagtcctagatgcagaatacttcttctgattcttacacttattgcatggacaacaaataaaacccctttgcctgttagcttcggccactctcaaaaaatagtgcacgccgtcaataaactctttggaccgccggtcagcgtatatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgtaaaccttttaggcacctccgatttgtatgtaatcac

SEQ ID NO: 72563 - DNA, 1558 bp, Oryza sativa
ccatctctacccagacgggagccactaacaagattcctgtcgatagaagggacatgctgcatgttcttcagctgcacgatctttcccgaagtaaacttcagaactaccgtgccaacaccatgaacagaagcatgtgacccattccccattaggacggtggaaccccgtgcgacctgataagaagaaaacaatgagatgtcagcacaaacatgtacattggccccaatatcaacccaccaattagtagactgattaactgaaaaaacagtaggtaaattaccatacccacttccatctccagtgttgccaatggtcacattagcagacttagaagtctgcgctgcaggtgccttcatccccttgcgctgtggacacttcctagccagatgaccaggttgcccacacacaaagcaagtcctctcatcctagttaggattgttgttgttcttcttcttcttcttcttctgcttcttgaaattggtggtttgttgagctttgtatttccccttactcttgttctgggccttgtgcacaacattggcacaggactgcccaccatcgcccttagacgcggcgtctttttcccgagctttctcctcaacatcaagagacgctatcaacccctcaacggagtattcctgtctcttgtgtttgagtgcagtaccgaaacttctccatgatggaggtagtttcgcaataatacacccggccacaaatttgtcgggtaagacacacttaaggagttcgagttccttagccatggtttgtatctcatgagcctgttcgactatagaacggttgccagccatcttgtagtcatgaaactgctccatgatatacagatcattgctaacatcagtagcaccgaatttagtattcagtgcatcccacaactccttagcgtcggtcatttgcatatacacctcgaccggacgatcgccgagaacgctaagaatgcatcccacaaagagagtagtggcttcctcgaattgcttctgctgatcagcagtaagaattccttcaggtttgccagtactcacctagaagcatttcatagacgtcagccacagagtgaccctgatctgccatctcttaaagtgcacaccggtgaatttatccggcctcagtgcttcggcaaaaccagccatagtaaaatcacagcgcctataataaggtttttggattgttgaaattataagcacataatgatttaatttattccataaataaatcatgacattgcagatgtaaactagattgaacgcatcattagatctacacatgtaaactaagcaataaaacatgaacaaatcaaatatgcgcaatatgtcgaatacgtaccgaggtggcggaaagtccggttgctcggcatgaactactcgcagttgcgagcgtcaacgaaggcgcaaagcacgcgagcgaagaggaaggcgagccgtcgcgaacgaacagggagcagtcgcgcgaagcgcttcccaaaaaccttattgccgccttctcccggtacaggacgtcgaaggcagaggttctggagacctgctctcccgatcgccggtgc

SEQ ID NO: 72564 - DNA, 669 bp, Oryza sativa
tggctttaatgtgtttgagtgacgtcttatcagcccttctttcaacatcctatgaagcgtgctttttggtatacccgcagctgatgcaaatgaccgtaatgtgccccttagttgcaggggggcattagcaacatctgacaagtcaatttcattcttcttgcgaccagaattagttttctttctagaacttacattgactggaattccctgtgcacggcactgctttgctcttcgccaaatatcttgcactctaccccttttgatattgaacatttcagcaacttcagttgttgctttttttcttagtcttccattgatagttttcttaaccaatgcatcatatatctcttgcctttgtatgttggtaagatttttgtttggatgttcatcttcctcatctgaatcatccaactcctcttgttcaaaaacaatttccacatcaccagcatacacaccgtactcctgcatgtctacaacaacaattacaaggtgagtcgtctgtaccaatttagatggtggatattttattatcatggatcaacatggttgtaaacttatggctgattttagatttcagaaggacatagaaacattgacacaatttactttatgtgctgaaatgtcaaattgacagtccataatttgcaactaatgcatccaatgttatgg

SEQ ID NO: 72565 - DNA, 7747 bp, Oryza sativa
aaggggcccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcgccttccatgtctctcgccctcttctagacttctacatgttggttggtttgttggcccagctcagtatagagcacggcccacttcccaggttggcccatattggtagatgaacagcccatacaaggcccagtaatatatttcccaggcttgtgtccggtcagatgtcactgtgttgctctgttttctttgttgttacatggcacatcatcccagtgcaatttaatcaaaatgaatcaaattcttcgtccacaatgaagatatataaattatttccatattttaaagctgagattcgagtattcgtcggtccatctgtaagttccaatcatggacaccgaatatcgcagggttaatcatcagttcatcatggaggggcccactcgtcaaccacaggaggaaaacttaacaaaatacaaagccgcgggaacggggtgaagtgaaacatgtcacgtcttcaaatgtcaacctcacggatagctgcttagcagtagcagcagcatcgcctccagctagctctgatcatttgattctctcgtcctaatccacattttgtgctgccgattaaccacaggaaagtgagctttgcttgcaccacaaaacctgcaaattgaactatattcgaagcttagctaggtgactgattcttgctgcgattcgatgtccatggcgtccataatcatcctggccgtcgtgttcgtcctcgacgtcctcgccttcgtcctcgccatcggcgccgagaaacgccggaacacggtgagagctctcgaacgcgttgatgcatacatgtgtcgtcgccatcgccgtcgccggagacgaagccgatcgatcatctgctgcgtgctgacgatcgaggaggtgtgtgttgattggatgatgcaggcggcgtacgtgaacgtcgaccagaacgcgcggccgtactgcgtctacggctccgacgcggcgacggggtacggcatcggggcgctggtgctgctggcggcagggcaggcgatgatcatggtggcgactcggtgcttctgctgcggccgcgcgctctcgccggggcggtggcgcgccttcgccggcttctgcttcatcacctgctggtaagtagctagcatcactttctccttccataatcccatccatggatgcatctgattcttccgcgctggtacaattgcttccgtgtgcaatactgcaaccaaagcccctgggattaagattctctttcgcataattaacctgcacagagatgaccaattattagtgcaacttggactgaatcatgataggcttcaaagccaattgcatttgcatatatgtacatttggataagaccatacgtaagtaggctgtatacagtggctgactagctgtgctgtagtgctgtatactgaagaccaatatgtatggcctatttggagccttttttgtcacaaaatatactagagttgtggagctgggtttagacagctccagaactccactccagactcaactcttggagctaaatttaggagttggagctgtaccaaataggcatttggtaaaactcctactcctaaatttagctttagaagttgggtctgaagtggagctttgaaactgtataaattcagctccacctctggtttattttgtgatagatcttcacccagctccgctccaattttaaatgaagttaaaattgtttggttgagcgacgaagctgaagctgcaccaaacatacctcgagatcgatgccactggaaagaggacgggtcggctctttggatgcagcccatcttctagatgcttcctgagataatgggccgagttttcagcccaatctaaagaatatagactctcttctggcccattaagtagaagaagctacaaagaaggcccaatcaattataacattatgctctgagcttttcttcggtacgaaacaaagtatagtagcaactagcaagcactaccaccggcatccttttttcgcggtaagaaaagctgaaacgaggtggatgtttggttgtccggtgcggtcagctgtccctgtgttgctcttactttctttaattacgctttatttttggtgatgaactttttaattatgttatccctggtttcaatcaacctcttgttagttggccgatgaacgcaaacactagtagttaattgcccgatgaaagcaaagcactactagttaattgcccttcttagcaataggagcgctcagctttgcatctgtggttacaccctttcttatgcgtgtagttggaactacctttgctttgctagcataagctcatcatttgcctttcgaccaccgttaaaatctgaattttaaaacttgatattagtgttgatctgaggtttttactatggtttatcttttaaaattggcttttaaactgcaaatagcatatataaaaaagttttaactatgaagccagacgatagggacttagacgttgtgacggtcgaacacacagtactggtttcgattttttttaaggaaaaaaaaacgtactcctacaatgctactgcctccgtcccaaattagtggttgctttaacatttttcttgtaacgtttgaccattcgtcttatttgaaaaatttatgtaaatataaaaaatgataagtcatacttaaagtactttagataataaagcaaatcataaacaaaataaataataatttcatattttttagaataagacaaatgataaaaattacaaacaaaaacttaaagcgacaagtattttggaacggaggaggcagtgcttaggagtaactggttaatgtccgatcgcaggtagaggtaaaacaaatattcctccccactaagctacctttactgaccttggtgaaacacaaattaattactcgcccacgtagatggaatgaaaaatatttcctgtacctgcttttcagccaaaattattcggacgtgcaattttacagcaattatcagctgcaggccatacgatcggaacgaattctattggccgtttcactttatcgccacttttttcaaatttggtatggtaataaactaaacgctacctcaccaacaccatataatcaaattctagtagtttcaaaaccattatcttataaaaacgctaccaaattttgaaaatgcatcaacgctactaaaatctaataaaatcaggctgaatttggtaataaagcgaacaaaccctaggtttcgataataaaaaaacataggtgcctagaaataactggtccagttaaaggaaaaacaaaatattcctcctgcgccaccaagcttcctttactgaccttggtgcaaaacaaattaattactaacccacattaaaggggaaaaatattttccacacctgctttaataaaagccaaaatgcgagtacatgagcatatgatagcacatccaaatcccactcccactggcctaccgtttccaatcatccacgccgaatactttggtggcgagccgggggggcccacgcgtcagcctcagctagaggccggaggcaggtgccagtggaacagaaccaccaaagtcgcgagaatggttagagtgaaacatgtcaccttcaccggctaccaaagcagcagtgtacgtggtgcatcgcctcatctccctcgacttgctgctaagctttcctctcgtctttgacgcccccatctttccctagctcgcttgtcctaatcctcctctctttctgcaacaagaggaaagtgagagctcctcttggctcgctcgctgcacgaatcagtagtccaagttggattaattaagggaggtacgtaaattagttcgaatccatccatggcgtccataatcctcgtggtggtcgtgttcgtcctcgacgccctcgccttcgtcctcgccatcggcgccgagaagcgccggagcacggtgagctatagctagcgaaatccatactatgggtcgtcgtcgtcgtcgtcgtctgacgagagggagctggttgggaacgatgcaggccacctttagcgaggacacgagcggcaggcagtactgcgtgtacagctccgacgcggcgacggggtacggcatcggggcgctgctgctgctgctcgccgggcaggccgtcgtcatggtggtcacccgctgcttctgctgcggccgcgcgctgtcccccggccggtggcgcgccttctccggattctgcttcatcgtctgctggtaatttaatcagcaattaagcatatcacgctagctagctagctccccttcttcgttgcctccgtagcttggattaactagcccgtttgcaattaagcccttagaatttaggtttttctgcagtcgcgtccctaggatgatcaaccaatttgttattagtacgagacttggtttcagtaaattactagtactaatctgcaatggattaatgaatgagcaattttatcatccaatatttggtacctcgaagtaccatatttaccatattttatacacgaaatttgggtacctatcaaatttaagtaattttatcgtccaacatttggtatctcgagttactacgaatgtttggtatctcgaaatattttctagtgttaaatttgatatttctaatataaatttggtacatgataacttgagataccaaatgttggaaatgttagatgttaaaatttcatcaaattttacactacaatgtatcttgagatatcgaaaaattgtggtatcttgagatatcaaatgttggatagtaaaattgcttttattgaattgatgagctgatgatggtgggtggatttatggacaggttcacgttcgtgatcgcggagctgtgcctgctggcggggtcggtgcggaacgcgtaccacaccaagtacagcacgctggtgattagcgggccaccgcgctgcgcgatgctgcgcaagggcgtgttcgccgccggcgccgccttcaccttcctcaccgcgctcttcgccgagctccactacctcttcttcgccaaggcccgccacgccgccgccgtgcccccgcccattgtcggcggcatcggcatgacccgcatgtagacagagtgacagacagcaccttggttctcaatccatttgccatttgcatcccccctgacttcgacgcccgcgttgatacctcgattgctctactctgtacatttcattctcattgctcagtatctgtagtatatggagtatatctgtaactgcgtggctcatgtctctgtattttggtattctagttgagtgcgttcatggtcattaattgatcggccacctgacctgaagtttctgtgtgagatcggccacattgacatgaagtttttctgtgtaatttggggatcgatgtgttgtttgtcttgtgagccttgtgaatcctttccctgttcttgtgtcagaattcagaaacggaacatacgcacgtaccttaactttttttccttactttctgttcataattcagagactgatctggatctgttcttcatcgtgttgtgttgatcctgcgacacaaagacctgtaaacgtaacatatactactctgccggcaacacgattcgacccgtacggaatcaagaactttcaggctcgccatgctttgcctcctcccggcgaaaccacagctttgtttatggcgaaaccgcgacgcgagcaggaggcagacgcaggatagccctctgcgtgcggttcgggagccaggagaccgagatgtggtcggtgcatgccttcggcctcgccgttcgtcaggcacaacaacaaaaagcttctcacatcctctctatgttcagtgtttcagagctcaagttcagttataaaaaacagggttggtttatgatgttatccttggctgtccctgccacggaaggccgcatctttgcctgtccctgcacaatccggcaagccattgtcgctttgccctttaagtaatccaatctactgctgctactcacccttcaggtaacacatgtgtagtagtagaagaagagggtggtacaattacacagaattcagtactttttctgccggcgacaacggcggcagttgcggccggccggccggcaagatggaggagaacagaatagtgtagtgtgcatactgtcatggatgcggccgtacgccgggatgtttcttttacctggcactaaattactagcagtaggctttttcttgtttgttttggtctcgatctgacgtgaccggaggatcgatctgtctgcatatctgccaatctgcatggtcgtggtcgagcagaaaagctactattatgataatcttcataggttggcggctacggagtaaatcgcacatgatgaacgacgacttcctctcgtctcgttctgcaatagccaataatcctccctgagattatgcgattatgccgcttgtctcctttgtggatcgaagaccttgtgctcagcaaatcccggcattgtatcgatatcgattggtctgaaactctgaataatcccggtcatggtcgtcgattgaatttgcagtagcagtatgttatgactgtatatgctcatatggaaggcacgtcgagacgatctgctagtgctagctataggcgatggattatcccatggacacagagcttaaattttttgtctcaaactcatagagcttaaaattctgagaatctgctggttaatagccagcttctgagaatctagagaagctgggttttccagcttctgagttctagttcattttctggattccacaactatatattcttagaatatggatgacaatatggactgtttgggggaagctggagattttatgagaagctacagcagctagtagctatcccaaacagaccctatatacatgaccccagccatgaacatgcttgagaagaaaaggccatgggactaactagtgaagggactggacctgcatcggagtactgcattgcacgcctacgtggtccatccgtccatggatggctcgcctagcttgctgcatatcgcgtctctgtcactgtggctggcacatgatgatttttcaccaccatggcatcgatcgatcgttcgttcgatcgaacagggcgtaggtaaacgtaggtccaggaacaagacaagcaacatgcttgctttcttgctgtgaccacgctctgattattagtctgaaaagccgaggactatactgaatcatgcatggagattgttgagtggtggtaggcctgaagaacaactgctcccgctggcccctgcctttctagaatctagaggagctaccacctctgaacaacaactgaaagatcttggatctgtactgctcctagggagcaatctaacccataccttagctgctatttgactactgtgctaataatcgaatcagtactggtgtaaaatccgcaatcagggcattctgcctccacttttctttacaggtaatcaggaatagttgatattccgaaacctgcaaatattccttccgttgctctttgcatcaaattttgttttctgcgtatacatacgggtagtatttataacaagaaattaggtaatcagtgtcgtgtgttttgctttgcttccacgctaacctaactggatgtatgtataatatgtatgccacctgt

SEQ ID NO: 72566 - DNA, 1989 bp, Oryza sativa
cgggagtaaatatcttttcccgctatttcgaaattctttttaaacccggttagggttaagaaccgggactaaagattatagcactgcatatgattttcgcttacatatctgtttataaaatagaagttaatgcattaacattatttaaagtacaaagattaatgacaattacttcgaaaaattatttttgtctgtaataaattaagtggataaatcgtaataagcaaatataattaataaaaattcaaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattatcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcggtcttgtcctcaactccgacgatttttattttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttgtggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgtgaactagagccaagtgctcctcgatgtaaggagctaccaatgaagtgtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaat

SEQ ID NO: 72567 - DNA, 4146 bp, Oryza sativa
gccaacaccatgattgattgattcctctgaaatctgaatctctgctggtttctaggtaacgcgtgaagtgaactgctctccacgtaattccatccgtcgatctcgtcctacgtgcgggcacagcaccggagtgcagcatacagctaatataatgttcttaaaaaaaaaactaacaaaggaggtgtttagatatagggatataaagttttaaggtgtcttacatagggtgtcgtatgaggtgtttaagcactaataaaaaaactaattacatagtccatcattaaaccacgagatgaatttattaacctaattaatccgttattagcagatgtttactgtaacacaacattatcaaatcatggaggaattaggcttaaaagatttgtcttgcaaattagttgcaatctgtgcaattagttatttttttagtctatatttaatatttcatacatgtattcaaacgttcgatatgatagggtgaaaaattttagggtgggatgtaaacatggcctaaggctgtatttagacaggggtataaagttttggtgtgtcatatcgggtatacggacacatatttaaagtattaaatataatctaataacaaaacaaattacataatccgctagacgaatttattaaacctaattaatccgtcgttaataatgtgtactggagcactacattgtcaaatcatggcataattaggcttaaaatattcgtcttgcaatttacatacaatttgtgtaattaattatttattttttatttttaatactttatgcatgcgtccaaacattcgacataacatggtgtaaaattttgcgaggggatataaacaagccttaacataacacccctaccatgaacctttgcgccttcgatttctccgacatccgctgctagctgcacgcaatgcaattattttgcctaatccatactacagtatcataactctgattcactgtaactattatatatactctgatttttcttttaaagaaaaactctgatttcaatcttcacaggtacagcacctaagttttttttttcttttcaactccaccacggaaatatgctactctttccgatcaacgtttaggataagatttgattgaagttttcccaataagttcatttaatgtggggagtacaaaaccctcccatcaaaacccgtcgggtgtgtttagttcgcgaaaagaaaatttttaggtatcacatcaaatgtttgaccggatgtcggaaggggttttcggacacgaataaaaaaaactaatttcataactcgtttggaaaccgcaagaagaatcttttgagcctatttaatccgtcattagaacatgtgggttactctaacacttatggctaatcatggattaattaggcttaaaagatccgtctcgcgattttcttcctaactgtacaattagtttttttaatttatatttaatgctctatacatgtgtccaaagattcgatgtgatgtttttatctaaactggaccttcatctgaaaaatgaaattgctagtggtacaaaacgtgcggcactgtgagaggcctaagtgcacagtagaaacgatgtgattggttgttggagaggggaaaattactggcaaccacacaaagagcgatactactactccattgatactacacaagagttaacctaaccacgaacaaattcttagcatgaaacattattagcatcacaaaattaataatgtcataaaccaagacatcttgatcctaggcaggatatgtatcctatgttccatgcctcaaaatgacgcatgcacatttcgcattatctaatcgagcggtccggctaattttggcccgatacctccccgggggccccacctgtcattgtccccagcccccggcaaggatataccctccgatccccctgatactagggatcagcagcaattttgccacggcggcgcctccatcatcatcgagtcgagtcgagtcgtctgcaaagtccaaagtcgagggagatgagagaggagacttgttgatccaaatggcgccctcgttgttgtcttcccaactccaactgcacgccgacgacgtcgcaccccgcacgaactagacaaacacccacaccataatccaaaaccaaaacctcctcgccacatataaatccccatttgcgcgcggccgcctcgccggaggggagggtgtcgcaatgccggaggctgcggcggcggcggcgggccacatggatccggttggcgacgaggcggcggagaggagggagatggaggagaaggaggaggaggaggaggaggaggaggaggatgaggagttctacgagtcgctggatcggatcctgtcgtcgtcgtgctcgtccacgtccgcctccgacgacgacgaccagcagcaccggcggaggcggcggcaccacccgcagccgcagcagctgtcgtcgtccgcgacgttctccgcgtacgaggtctggatctccgagccgacatccgtcgaggagcgccgccgcgtgctgctgcgtcggctcggcctcgcccacgactccgagcccgtgccgcacccgtccccacgcgtatcatcctcctcccctcgttcgccgaccccttcccccccgtcctcgtcgccgcctcggccggctcccgtggtggccgccgcggaggagcccagatccagcggccacgggaagccgccgcttgcgaggaacccgagcggcggcgcggagcaatgccggatccggaacctggacgacggtacggagttcgaggtcggggaggttcacgatgaggtggtccgggaggtcggcactggccggcagctcaccttcgaggagttcgagctctgcattggccgctccccgatcgtccaagagctcatgcgccgggccaccacagccgcatcatcctccacctccgaccacgccgccccagcatccaagccacggaggaagcctggaggctggctgcgtggcatccggcacctggcgggaagcgttgcatacgggcgcagcagcaccgatgagagggacaaggagaaggagaaggagaagaaggagagggaagcgcggcgcctgagctccgccaccgatgacagccttgacggcaacggctcgcgcaatgcagggagggtcagggtgcggcagtatgggaaggcgtgcaaggagctcaccgggctgttcatgacacaagaattggctgcccattcgggctcaatctggtgtatcaacttcagcttggatggacgataccttgcaagcgctggcgaggaccgtgtcatccatgtgtgggaggtatcagagggagaaagaaagggagaattgctcggggaaggtacggtggcaagggagaacggtggtggctgcagcccgtttcttgcagctgttgggaatggatcgccggagctggcaacattgtcattgagctgtgctgacgggggttttgtggagaagaagaggaggccaaggatgcaaagcagccggaagtctgttggctctgatcatctagttgtgcctgaatgtgtgtttgggttcagagataaaccagtatgctctctattgggtcacgccgccgatgttcttgatctatcatggtccaaatctcaggtgcgaactttgtgatctttcgattgaatgttaaactgttaaatcataacttttggcactctggcatatgttctaaaaaatcacaataataaaccatcacactgccttgttcttcagggcaacaaggaaaaagttatgtttcgttttagtgttgtctagatagtaggacagaaaagaagtcgtttgttgttttgatgatgtttagtacggcagtaaggcccgcattgttaaaaaggctaaagatcaaatcaacgggctatttggaaaacaatgcattttgtcattttgccatagtaattgagcgtaggcttcagcatgcaacatttggctacatcttgctgatagaaaagtgaaattggttgagtggttgttgagcactacagttttgcactggtgaaagattcttgcactaggcgtgaatttgtttcaacttgctaggatggtctattctttgacttcattggcctgtctgtgaaatatgtatcattgccatgcctcgtaacctgggaaacagcactcttacttgatcctaatcttttcacacttcagctataaagat

SEQ ID NO: 72568 - DNA, 700 bp, Oryza sativa
ttcctgcagcccccacactatatattttttgaatgacaaatgggccccacacttttttttttatttctagtgccacttaagcgccacatcaacgccacatggaaagaagaccgagtcaatgctgctacgtaggcgccacgttagcaaaaccgccgagggagtcaaattgctccggttttaagagttttggggtcgaaatatccggtttttggtttatggtcgtggattagatttcgatcacagttgagggtcacgaagtgaacttatcccacataaaagagccgacggcccaattccactgcaaatttaaatgggccaggatccggattctatccaagcccaactcacacccacgctgctcggctcgacacacatcgccgcctcgccgcctccctccctcctccggtcgccgtcgccgccggcgagctctcctcctcctcctccggtacacagctcagctctagagaaacctcttcccctgttcccccctctcctctcgtcgaagcctcctccgctatctccccggtagggctcccgccgacgctctctcctcgtcgccggatattcccatcctatcccctcctcgctcttgctccctctacgtgtgtggcacggcggcgcaccggatcggcgctgggagctaaccccccaccccccggcgaagatgccgcaggtaatggtggtcgcgcggaacttcatg

SEQ ID NO: 72569 - DNA, 24278 bp, Oryza sativa
gccctccttatataggttggggggcagggttacaagatagaaaccttaaccaatacggtatcggttttctaaatctactttacaatcttatcaaactaggactttaggctgttccataatatacagggaaacgtaatacccaagtcatgatctgttacatattttatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcaggtgcatcgactagatgcaccgagtggtttcgataattgtagtcaaccaagcgacttaatatgtagcatatgtggtatgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccatagtattgggcatacgccatgcgcacactgctttaacagatgtgcttaagtccctagaagacacatggttccaccacacctggaaatatatggcatatgaggtataaaatctgagtaaataaactcataaaggatttaccaaccgcctggaaaatgaccacaatatataatcagcctaagccataatattggtcaataaaaatgcacacttacgtggcaaaaagcaatgatattgtatccaatcaattgcttaaaaacccaaacaacaccatgactatataaaaaagtcagcggggcagctatataaagctttactgtttgacaccttttaagatgcattataccaactcctaaaaagttgagtaactgcgatataaaaggattttaaggtattgggcaattgatcacgcgcactttggcctaagcaaaaagtgcctaagtccctaaaagaacgtgacaggccacacctgaaaatatgggctgcagatatattaggcctaggccaaaaaatatgccttcgacaccctttaaaggatgacgcatgtaacatgctcccgagtaataaatcttttcgggtgatatagaccaagtgtagctcatatgaatagcttctgatctgagtgattatcctttatgggatactccaaaatagatataacaattgaattccgactggcacaagtattcagttgataacccttacggggaataataaatagtccagtctttgagcatagaaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcagctgttgtagatgcttcacttggaggagagttgatgttgttgcccaactcgtctaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtgtagcccccgactctttgatcagttgggaaacaactgaacatagagtcgagaactgtagcttcttgtcatcgaatagtcataacttgagtgaagatatgtgttgaggatgtccgagtagaaatattgaagattggaacaccacttgttgtaataaaataatacggcatcatatttagtgacatatgccgaggtgtcgaaactcttgtagtcgtcgtggttggtgaagtagcaaagcttgcgaagtagaagcaataaagtttgccggtgccgaagataataaagatgaagtcgctccaccatggtgacaaagttgcatagctgtaatgaagtgaacacgagtcggcggtaacagaagcaaaccggtggtgaagacgcgcagttgtgaagataaaagcaccagtcggcggcggcataaccagtcggcgacggaagacgatgatgtccatcagtagtggtagctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccaacgtgcaggcggaaacaccagtcggcagcgaacgaggcggccggtcggtgaaaacgtagacgtccaacaacggcggcataataggccagccgtgtaagcggaaacaccggtcggtggcggatgaggtggccgatcggtgaagatgtaggcgcccaacaatggcggcataataggccagccgtgcaggcgaggacaccagttggcggcgacgaaggcaagccggttggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagtcggcggcgacgaaggcgagccggtggtgaagacgtagacacccaacaacggcggcataataggccagccgtgcaggcgaggacaccagtcggcggcgacgaaggcgagccggtggtgatgttctgattgatccattcctaaagcgtaggagataagcttaaagccatgaatcccttttatgcatatctggatctggatcctacagaacaaacagataggatgagtagtacctgatgtaaatataatactcgagaaaaattcaagcattttaaaatgtttataaatatgtatttctcctcttgtcaattgtgatttccccgagcagatgactccttacgtttaaacactctgcccgactagtcatagtccccaagcatcgggagtcggcctaggcacttcccaaacatgcatatgagtgacatgagttcgtcattaatggaacaaagtttcacggatcagaatttactactcgggtacttttgccattattaagagcagaaaataaatttatctcatctctatgcttttgatttattccgaataatacttagcaccttgcgttactcggtccatccaacgagcccccgggtgctaggaatcagcccaaaggcaaccatccattggcaaaccaaacggaaagcataggaagatagaactccataactcgataggtacttttgtactcagattatgtcgcaagtaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagtgaagatgcccactaatggcggcacaataggccaaccgtgtaagcggaaacaccagtcgacggcaatgaaggtgagccaacggtgaagatgtagacatccaacaacggcggcataataggccagccgtgcaggcggaaacaccagtcggcgaaggccagccggtcggtgaagacgtggacgcccatgaacggtggtgtgaccaaccgaccgtataggcggggacgccagtcggcggcgacggaggcaggccggcggtgtagatgacgatgcccatcaacggtggtgtgaccaaccgaccgtataggcgaggacatcagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacaacggcggcataataggccagccgtgcaggcggaaacaccagtcggcgaaggccagccggtcggtgaagacatggacgcctatgaacggtggtgtgaccaaccgtatataggcgaggacaccggtcggcggcgacggaggcaggctgccggtgaagtcgtagtcgcccaacagcggcggcataataggccaaccgtgcaggcaaggacaccagtcagcagcggacgaggcggccggtcggtgaagacgtagacgcctaacaacggcggcataataggccagccgtgcaggcgaggacaccagtcggcggcgacaaaggcgagccggtggtgaagacgtagacacccaacaacggcggcataataggccagccgtgcaggcgaggacaccagtcggcggcgacggaggcaggccggtcggtgaagacgtaggcgcccaacaatagcggcataataggccagccgtgcaggcgaggacaccagttggcggcgacgaaggcaagccggtcggtgaagacgtagacgcccaacaacggtggcttgatatgccagccgtgtagacggagacaccagtcggcggcggcgaaggcaaaccgggcggtgacggtggctccagcagtacatgtaaagagaaaagcaatctctaattagcatcaagaaaattaatcttgtgtacgtaagtctgcatatatgaagcatgcatatattttttgattggccgattgatctcctgtagcatgaacagtacacacatccacacatgcacgtcaccagacagattgcaggctgccatccgtgcgtacagatcacggtccgagtccggatcaaatccaacttggaggctttacgtgatgggaatcagactcaggtgaccatggcgcatgcaaaataaggaatcacagatcaaactgagattagaaaattaatctaatctaatctagttagtacacactagaagattaattagaagtatatgcatgcatgattaggtagatcgtgcatgtatgttaatctgctaaatcaactcatgcatgcgtgaaatttctccgagcaagctataggcggctgctcccatgtgcccgtggtggcgtggtggccgcaacgcatccgtcggcgctgctcctggcgatcgccgtcaacagctccgttttaacctcagccgaccagcccatagaaagcaaggaaaacaccagaagagcaaatcacaattagaaattaatctaataacagttagatcaaaacaccgaacccgactgaagatttgagccatcgagattaatctcgccgtttcttctgtagttgattccatcacacttttcgatgggtaattcgacgcagcccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatattttatatatataagttatcccctataactagtcggataaccatgccgtgtgggtatggggtacccataatctccacatagggcatgaatgagattgagaaaaattgtcaaggggtacacactagtttggataggaagatagggaaaaaaaggagatgaagatcgaggacgtttttcccaagatggaccgtgtgactgatatatcgaaatacaagcagtacacggtcgcaaggtctccaccacggagatcaaggatgccttggccgttccacaccaaatagtgatgatatgctcatgcatgtaacatcgtggagtcccaatctaaatcaggtttaacaatttgggggtgtgtgtctggggaggggggagcggtaaaattagaaattgtagattttttttccaaaatttggatcaaattttttgatgaaatttgagccaatttaaatacatttccacaaaaatgaaactttctacaacgatatctatatagtcccttccccggcgcccgcctccgcccctggagagcacggagacattggtgtaacttcgtgtgatgctatgcctgttttttttttattctcgatgcgaaactatgtcttctctctcttttcgccgatccgaaaatattaaaataataaagacggtgtccagtgacaaattatgacatttacagagtgtcttcttctaaagtttaacttggtgtcttacatgtaaaactgtaaagtgacaatatcatatagcaaatttaccaattaactgcgcatataaaattaattattttatatccactgattatactgaccagccaattacatattgatctctattacacgcatggagacgaaggagagctagcatgacccttattgcatatatatctcgcatgcattcaggttacatacgtttagacgtactactacgatatagcttgatcagtatacagctttattctcggcacacacatatatagtatactcccatgcactaatagtacgtaggtacatgcaagggtatatacaatttaatccattttatcaacgacagttgctgtgctttgctttgagcttcttatatatggtttccagttctgcatactctttgtgcttagcctgcctgtaattctccagtgcttgtatcttcatctggagggctgcattttgattcttcaaggcagcgatttcagcctcgtacgatttgttcttgcttattgctagctgaccacatgcttcatcctgcatacatgcataataatgcattggtatttatatatatagattcaatcaaaattaaagtacatatattaattctacatttgtgtagtatatgtatggtagctagttctacatatatatgttacgactgttatatactgagagagagagagagagagagagagtgcatagagaggaggggaagaagaagggtatagtatgtaccattatattgagctagatatatcgtagctagttctgtttgcagaactacaacacttgttcagtggctaacttagcatgtttctcgcttcctacgtacgcttaaatagacaaagcagcatggaggcttgcagttagttttcgtttcactactataaatccccaggttccctagggttaaaattcgttaccttgtagtgaatttgtccatgttgtcaacttcttcttcctcatttttcatacgtacgttttccgaatgttatgttttattgtaaatttctataggaaagtagctttaaagaatcatatcatattaaacaattcattttcaagttattttagctaatacttaattaatcatgtgttaattcaccgctacgttttccatgcatagagaataagttcccaacttcccaaaagaacagtcttatgctctcatggtagtgtgttgcttttttgggtggattctcctctacttctcgaacaatatataacgttataaaatagatacgcactaaaatatttagagaaaagttatcatatatatatatatatatatatatatatatatatatatatatatatatatatatatatatagagagagagagagagagagagagactgactgagactttgtagggtgattgaatgtaggagagccattgtgatcacttgtaatctaacgatgtaagataagatacaaatgaaaaggtattaaaaatatggttaacgtactaacaacagatgctagctagcgaatacgtgcgacaacggtaagttgcgcaccccgattagagtttagagctttggtgcaagagcgttgcaggtgaacgagagcccattgcagtgcgcatgtctccacctaagcgagagcttcccattccccagtatcacatgaccacaagaatcctaaaacttttgtctcgaattcaaaagaagacttttaattcaaaatctagaaattccttcacaaatttagaaaatttcaactcaaatatgaaaacttttgtctgaaaaattcaaaatttttaattcaaaaaccaacaatttcatataaaaaatttaattgaaaatccaaaacttatatctcaaaaacataaaactttcaatttatgatgccttatcccaaaataaagctatttctccacctaccacctcctctcaaccatttacaatcattatccatttaatttattcatatatattctcttctcaatcaatcacaacatttctctaacaatttttacctactttcttaatacccgagtccacctctaacattttgagcaaaggaagtattttctaatttatggttaaaataaatcaacggtggatacttggttgggtggcttaggagctagtatacctccaagcacgataaaattagttctcatatataggcatgtcattcacacatgatcgtcaggaaactataggatcgtcagtccagtgacttcaatgtatgcatcatctaattaagcacaagacgagcagaatatttaatttactggatatatatgcgttaaaagctattctctaagcaagttgtgatcaaactatatatacccacgcaagagtgctgagatcaccttgatgacacattgaaattattcgtttattagctagctagtagcttggatatatatattggggcaaacgctccctgttttcatcattatacttacaccaaaacaattaattactagtacattttttttcacattataagcagggccggccctgggattcttggccatcctcaacgtctgattgtatggaagcttacagaaaggaacaaattttagtttttaccatgtcaaatcaacctgacggtaatatatagaactctgggagcatgcacgtaatcaactagagctaaatcctatttcatcacattataagacattttaggttttgaatatatatgtgtgggtgtatgtatatatatgtatatatatgtatgtatatatatccatatatgtgtgtttcatatatgtacctacatttatatagatgtaagtggaactaactcttgtgcctgttcgttcgaaacaattagtaaatcaacttggaatggcagaattaattctactatcaaaaaattaggtcaagttggagcaataattcatttttataccgctaacattctatacttctatatctatatacgttgggaaaaaaagttgttccaaaatacttttacttgcgcacatgcatatataccaaagaagatatgtatgttctctacacagtcaaatctaataatttaagacccgtgtttagagcatcaacaatggtgtccctactccattcctaatctttattttttggaattttagtaagaaaaaaccgctccaacagtacccatactattcattccaaaaatcaccattcccttcttcattctcgctcttcacaaatcgggaatcgttctcaatctcaaattttgtctcctgagcgagactgccatccaagaagaggggcgagtgggagggcagcgctagatgggtgattgtggagtcagatggcacgatgataaagcgcgggttgaggtaatacttttaatattctcaaatcctcattagataatctcaaaaggagatttaggaaagagatttttagtcatctattggccatgaggtttcttagcttcgtccgggaatagtcgtctcttgaagagaaagtaaaaatttatgtcaaaatgagatatatatgttcaatgttcaatgtcaaagtgagcacaaaaagctcaaataattgctgaaagttttcttggttattgtttttctcaaaaggagttaatttgagaatcaatgataatgcaataagtctacatgtagagtttttctttcaacctatgtactattgaatatattgtattataaattgtttgaaatcatgaatcttgattgttgacttaagcttaattgtaacatttttggttcatgtttatactcacaatgcatgcttgttaactcgttgatgaatttatatcttttgttttgcaacacacgtccttgaattgctcttgttatatctcaaagctctttgaactataagtggtgacttgcaaaacttgataatatcattgtcaaagggggagaagagatacaaaacatgcatgttttcagctgggggaattttctttcttttcaaaagggggagaagttctatgttgattttttagcactccaatgattttttaccacttatttgtttttattttttcaaataacaaaacaacaaaattttgatcggtttatcaatgtgttcatcaagggggagattatgaaatcaaagtgtgcttgattgttattttgtgatgaacaattgatatgagagacaattggttttaatatttggtggatgattagcgaggtggtgctgactgtgttagcttggtcatacccatcagtggtggccggacaaacccacgtggtatgtgcggtcaaatcggctagcccaatggtttgatcgaccgattttgtattggtgtcgatttcgggctgtttatttggatactcgtgattatctcatgtttaggacttctagaagatttctatatgtatataataaaattgtgtgctaatgttgagtcaagttgagaagaacttatgctcggatatggttgcctatttgattcatgtgtaggaatatcttgatgccatgggagagtattgtcgatgatggatcaggatttaacttgggagaagatgatgtccagatgatcgggatatcatggggatgcttaggctaaagaacaatggacgaggttgatggagattccatgcggcatacgatgggagattgtgtgcgtatggaaagtggagtcaaactccgaaggagtccaaatttgagaagattagagtttaagttggaaagagataagtttgtttcttatacgggaatgtttcctagtggattaggacttcttgcacaagttggattcgtggctttaggctatctacctcgagtgtaagtagagaggggggctaagccctcctggtatcgatttgtacgagttgagctgagagaaaaagttagggtttcgagtttagttgaaatttttgaaagaagtgttgtagttcgcactttgtaaacgctaatataatcagtaaaggttgaaatttttgaaagaagtgttgtagttcgcactttgtaaacgctaatataatcagtaaaggttaatctatttccacgagttatttaatttgtgtttgctcggtttcgagaatcacaccggcaagtatacggcaaccagaccgatggcttaccaatggtcagaccgatgggtatagggcagttagacctgcggcagcgacaggcgcaggcggttcgataggcggtcagactggccgatcaatactgctcagaccggctgcaagggcatggtcagaccagggctagccagttagaccgatctccaacgattggaaggtaacttttaattccgcaaaaacttttggtttttggtgttgctgccattcacctcttctctgatgtgtttagtttttattgtttgatccatgaaataattgtataccatatttatattttgagtgaagtttagtttggacctctctttcttgccaccgcgccttagaccgatcggccaaactgtagtggcagccttaagcaatgatgtagtcagcaacaacagccattttctctatgcacattaagcctgatggccttaatttttcactgatcagttttccctaccggcaaaagaatgacgttcagcgggttatatggctgagaatttgcttgtcgctcaacccgtcatgaaacactcccccatcatacattttccatttccgcatcatcctactcctgtcaggtctctttcaaggcttgttcggttaatcccaaatgagagatagaaaaattgagcagattaattaattccaagtacagaattattttccttcaaatcccattcaatccttttatgttggggattaagcgaataagacctcaacactattatttttcatgttggtttttgcaaattccctgccagtatttttgttgtcacgaaagataggaatcctagtagatgtcagaagcattagcactcggtaacttgaagcgctgactcctgaccaatctgtatatgttttttctgcattggctacatataaaggatatatgtcatatttatgacttgaggaaaatccaatggcccacaatgattatcaattatcatggcttctatttcgcacgattgatcatccatcctagcaatgattcataaatcaaattttgcatttcttcttttctattacaccgggggccgccgacctactatgtacagggatatgatcaggtacagttgtacccaaaaattttgcaaaaaaaaaccccaccatatattatagtatatgttatgtatatgtactaatagttgggtcaaatgggtaatatttgagtttaaaatggcattctagatggtatggaaatttctcgactgagccgttattgtttctgcaaaaataataatataataatatattgtgttgttaacttttatggtaatgcttgaaaatatcgcaactggttctatgcaaactaaattaaaaaatattgcagacaacaaaatacttaaatgattttcttggttacatgctttgaaatcgacattttctacatattcagaataaagatgtaatatcccgtttataaaaaaaaatcacatcaagtatacttttaattttatttttttagtatatattttgtagttctagaaatttattgcacactatactcactttactaaactatgtccatgttagtttttcttatcaaggcatttatcattaatttatatcaagtctatatatagtaccgtctttttttaagaaaaaatacaaagatttttttcttaacttcatacccacattttaaaaatctttcatccaccaccgtattacactagtgatctaaactagttgacatctctttatcacgttacacataagagtatcatctaggtattatgtaagaaatatatatagcttagaatcaataaacaaccaagacatcaacatgcacacaggatcaaaggccaaacataaataaaacatttgatttcatacaacaacaatgctgaccacttacatcaatattgatgcatgcatggagatgaaggtgagctaccatgcatgacatagacgtatggcacacatttttgctgctagctagcggccggggtcatatccagcttattacaaatatgtatagttatactcacatacatcactcatatctgtaggtataaaacaggggagtaggtatcataagcatgcatatataagtaacgtactccctctatcttaaaataaagggattttatccatgtaactgtatatttacatggataaaatacctgatatttgaattatttatatatatagtatatatatatggatgcatgcgatgacatacatgcacatagattatataagtatatataataaaaactcttccatatcttaattatccgcagcatccgggcctactcatttgccacctgagagcattgtgcctggcctccaggttgtggtagctggtttgcaggttgtggtggcaggcttgcaggtttctgtagctgctgtgcagcttgttgtattcgctttccaggttgtagtactccctgcgcttctgctcctcgtagctctcgtggttctgaagcttcatcctaagcgtccggatttgctcttctaatcctgcgatttcacggtcctgcagcctgatgttgcctttctctagcacctctgttgcttgtcctctctgccacattaattgaacatggatggatcggatggatgcaaattaaattaattgtgtgcaatcagaaaaattcatcaattaattctacctattatttttctgggtatagtatatgactgtaaacgtactgtaagtaaatatgagctagagatgaggaggacaagatcaggaagaagaaaggaagtaattataataaccatgttgttgtgagatcgatcggtagcaagttgatcagttgcactcacttggttccttcagaatactctccttctaccttagctttctagttcatttgttatggcctatcagagaccctgaacatcgcttaaatagacatcgcatgaagagtggcaggactaactaattaagtaatatatgcattatgttctccattgtaattaatttactgatgtgtggatggattcgtctcaacatgtagttttctaagatgctcatgttcaaaattaaacaacaaattttgtatgatcgatgcatgcatccacctcaaataccgttagtgaggagttgcgttgcgtgtacatgagcatatgcatgcgtctgtattgagtatcgaaaattggttttgccaaatcccatgcaattatgctgcatttgatttatacattaatttaaggaattatataaacagttttttaaaaaaaaaacacacaaagcacaaacgcaggcactcacaacccatacacactttcccctataaacgttccctatgaacacctaaaaaaattaggtcggcatatcttaagatcgacaaatttctttttttctactcactacctaagctcaggttatgcataccttttaagggcataatgtttaccaagtttgtgcccgtttgaactagatgaagaagctgatgacagttgatgaatgcatgatgtattgctttacaaggatgaattaaacactatataatatagggatagtctagatctcatgcatgcatacgactaaaatttaggcacttctagctcgtatcccccatataaactacttaagcctttctttattagataaagattgaacaaagaattattctaacttaaacacaaaataaatttacaattggtaaaaaatacaaaatacaataacaagactacacttaaaataaactaaaattgcatatacatagcagaatgattttagactaattagcagtatgtaattttaggtaattaaaaaatttcaaatttacttcttacgtttcaaaatataaggcttgttttgttttgttaagaaaggctttgaccaataattagcttattagatatactttttatgacataaaattatttttattcatattgaaaagtactacttatatatgatgattatgtttttgtattgcacagtaatgtcataatagataaattgttggttaaagttttatctatatcgatactaaaatacaccttatattttaaaatggatgtggagtgtaacctctaaatgaacagagttttggataaatcatagttttggaagtatattcactaataatcatatactaagatagccatgcatgcaggagtgctgatatcaccttgatgacggcccgaaattattccattaccccattagatctagatacaagagaatatatgcgccctggtttcattattaataaaccaaaacaattattaatcctacatggttgaatagcaaatgtagaattgtaattgggactccctagctactatacgacaacttagtattatcaattatagattttagaattaaataattaaatagatttaaaaaaaagaaagaattaaaaagtacggtcgtggattctatatataattttgacattaattattttttattttgataaaaaagtatgtaatataaatgtgccatgcgaagacagggattactgcgattatagtatcatagtatggttaattactcaagttgaaagaacatttacctaaaccattatgaagcagtacctatgggtcctaaaaaaggttttttcaactattgcttttacttgtgggcatataggcatatatgcaaagcgctatgttggctttacatgtaaacctgattattaagacctaatttaggagcttcaaaaggtttgttaagttaaactaagtatagattcagacaacagatttaggtcacattgatttagacaactttggaaactaactatataaatgatactttcattggttttcttatatagtaacttttaacttcataagggcacattgatcttttaagggcaaatatgatagtcaattaattgacgttgaccaataatagtgacaaaagagagctgagaactaactgaatagtggcaaaagaaagagttccaaattcttgatggtctttttgttggatatttgcttgcaaattctatatgttttttttctgagaaatataaaatttcaagttaagaattatacatttagagatctattgaaacgtatgggtattttgctagtaaataccttttggtttcaatgggctacactcgcatgccacacacatccataaagaacatcgatctggttaaagagatttgctaaacacgacagggatttgtgatatctgatgttgactgccattacatgcaggtgtgcgttgggccatttaatttggaagactcagaaaacagcatggtttttaaattatgtgatttatagtcctgtaaaaatcttgtttatatgtacgttacgtgttgcttaatattggatttctttggtattaatttgtcattcatctacagaaattggagaggcggcgaagttaaaggcggctgctagaattagacgagtgttagtagtggagggatcaagtgaatcagattcatgccacgtactgtgcatccatccagagaaaattgctacaagattaatctgctatgcccctaaattttgtgtcatccgttacatgcaccagagacttttttcttattggtagttgattgttatttttctttaaataactacatattgcccccatcccatacttatatgctagtgataaaaacacaactgtcaactgaaaaaagattcattaatttgtagaaaaaaggacatatgaaatcagctttgatgaaattcatacaacattttcataaaaagtgccacacaatttagtgcctgtagaaagtgcatctactttcttataggcatgcataaggaaatatctctacgaaaataccgcaaggcatatagacatttcataaaatgtctatttgtttctagagacaattcaccaaaagacatttagggcctctttgaatcgcaagattaagaaaacgtaagaataggaaaaaggtaggattttagggcccctttgaattggaggaaaaacataggctttttggaggattttaatcctatagaaaaatttcctatgatgccctttgaaacacaggattgaatcatatccaatcctttgaaattcctatggaatggacaaccctatagagattttggaggaaatttagcaagagctttaacctcttggtaacttttatttgagtctatctctctcatccaattcctgtgtttttcctgtggttcaatcaaacggtctaaggattcaccaaaagacatttagggcccctttgaatcgtagggttgaaaaaatagaggaatagaaaaacacaggattctgacaggtattgaagtgtaaaacagaggattgcaaaacacaggaatgatcgtttgattggaccgtaggaaaaacataggaattggatgagagagagatagactcaaagaaaattttccaagaggttggacctcttgctgagtttcctccaaaatccacatgcaatgtgtcattccataggaatttcataggatttagaaagtttcaatcctttaaatcaaagggccaaatagaaaattttcctataggatttgaatcctatgaaattcctacataaatattttgattcaaaggggccctaaaaatacaggagtccaaaggatgagaaatgtcacttaagttttcaaatatttaagatgatagcacttttctattgaattttctaacatccggtgtgcagaccatacaaaggctaacctgtttaagagagaaccgcacaagttgctgagatcacctagatggcgcatcgaaattattccgttatagcttggacctggaaaatgccccttgatttccttactagaagtcaattaaaacagtgcaaaaacccacttgtgttaccgtaaagtttatttagtcaagttgaaaagtcttctctagaccactaaaaatctctatatgtgcatgggttctaattacaaacgattgttctaaattcttttttacatgcgagcatatataccaaaggtggtatatatattttggcaagacatctaaaccaaattataaattaagacgaggtgatgtgcaggaatgcacagcacagcgcatagtagtctgcgcatgatcctaaatgtaacattcctattttacttaatttacttataatttaaaatcggagattgattagaattgatgaatcttatacatagttttcagaaagaaaatgaatttatgttacacaatatttactcttttatacaatagatttttttcgtatatacttatcattcttatatagaaatttatttggagcgatgccaattaattatatcatgtttttcttcaactttctcatgtcttcaaaatctacatgccaaaaatatcccaaatttccatttggctcctcgccacaaaattttctacccatatctcttttagtaaaaagttctgctccaaaaagctcctaggatacaccatgtcattgaatgaatattggctgtccgattgagaagacaacaaaaatagagagattcaatattcatcggctgtttccaggttattggtcttcctttctctcacacagtctctgtgcaggtttccttgatctgtcttcctatctcacacactctctgtgtgtcgatcgccttctatttttttctctccctgtcaagagcaaatgaacagagaaaggagaaaagacaaaccaagagagtgggaaaatgtggcaaaaataccatctcgctgctctcaatgcacatgtgaaccatacaaagctaacccagattaagagataagctaccgaaggtcgctgacatcacctggatgatgcaacaaaaattactttgttactactgatctgagaaagtgccccttgattttcttcctgagtgacaattaacacaattacctagttgaatggaaaatgcaaagacccacttgtgttaccatatgattataatagtcaagttggaaaatatccttttctaaaccactaaaaatacatgggtgaagggttgttctaaatatttctttttagatatgggcatatatgccataaaggcgatatatacaaaattatattaagaccctgcttaccaggttacatagcttctccgggaattaccttctccatgaagagagtgaaaattacaggtccaacaaaaagcatctgataaaggagaaatgtgatgggcagacgtgcgtctgcgcttatcatcctaaataaatgtaacattcctattttactcaagttataatttcaaattttggatttattagaattgatgaatcttaatacataattttcagaagcaaactaaaggggattaatttgaataaaaacttttataggggattgaaaagttaaactgatttttttttcatgaaactagagtataatatgtagtttttctgatatacccctaatccaggccatctcgctatttaaatttctggaagaaactatataaaattcacaagtatccataaaacataactaaaagatatatgcataaatatatatttgtccatagaatgtcgtcgtacctgcagctcaagaggtcgtgaggatggcagactaactacagccatacccttattgacctcttttatatacagggtgtgtgtttagttcacgataaaattgaaagtttggttaaaattggaacgatgtgacggaaaagttggaagtttacgtgtgtaggaaaatttcgatgtgatgaaaaaattaaaagtttgaagaaatagtttggaactaaactcggccacaatcaagccctgaagtaatttctcatttggctcctcaccacagaatttccaggtaatatacaagtgaaggacaaaattaatattcctatacatggattagcagagctgagatgctgggcatctgtataggcaatttggaatgcaagataattttggaccctttttatcttgcatataaattaagctttttgattcttcaaggcagagtagttctccataatccctcaaattatatatcaattactaaaataatgacttggcttggatgatagagggggtagatgaagccatgaagatcatgctggacagctactacagcagtgcaggctgcccgtatctatgtatgtatgtatgcagtgacagataacatatatatgtttttttttaataatggaatataacattccggcacagaagctacagcccatcattacaatctagcaatcaaaacaagtgtagtccaaaaataatagcaaccagcgtataaagataaaagtaaccagcgtataacaacaagtatatatatatgtactgaccacactttgcatttcaatattacatccagctgcaggaacaggagaggttgcatgacatcgatcgatcacatatcaatgttgcatgctctagatatatagctgccagtatacatgcagctttattcttcacacacatatacatacagtacactcgcaactctcataggcatgcatatacatcacacacaaccctgcatatactgtatagatacttatacatatattcaggtacgtacgtagggcattcgatggttgtgcagatcgatcatatcgatcgatcaattgtggcggtgatagtagggttgtccgacggtgaaaacagggaatctgacagtggggccgcaattcctgtgggctgcatccaggtctctgtatttcctctccagctctgcgaattctttctgaagattcgcgtgctgcttctgcttctcttccttgtacctggtcaggttctgaacctgcctctccagcgcctcgatcgtgtcgtttaactcttttattgtgtcgtttaatttactgattctgccgtttaagcccttgacttgatccttgtgcgcatcggcgttctctctctctagtacctttgttggcggatcgcccgtatatccccttcttgttgcccggtgctgcatgcatatatagatcatcataataatcatatgcatgtttgataagaatattaactccattacaaaatatgggaatctaaaatcgggtgagaccatatccagatatacgatgaatctaatgctatatttgagatggaaggagtatataagcactccatccgtcccaataaagcactttgcatatcttgtataaggattaagcgagaaagaactcgtagcctagtggttgaaatgctcgagtagtactgggtatgactatctatgtaagcgaatttcaggttaaaaaagatcacttgtagactcctcgtaaaaacgtgtattaagaatgggcccatcatctgaaagacagaggtcttaaaacatgggttaatgacagatcataaggactaatccgcatgtatgggccaaagttcgtggccatttttagccagtttggttgaagctttttcttattctttccttcatcggtcgagttatttcattacaaggattgggaatagacgtaacattaaaaagaaaattaattagtaatgattggtactttggtagggacaagcagctggtggagaaactaaacaaatgatgagatatataagaaaatagctaggtagacaagtaatataagaaaaaaaaataaatttaaacgtttaaagtaactatattttgggacgaagatcatagtagtatatgcgtatagcaagagaagatcagtaccattgtgaaaccagctagctagcaaattcgatcagttgcaaacttgatccttgagttattctaaccttggtcgcttgctaccgtctggagaccccggggcaatgcttaaatagacagtgccaacttgcagggctaattaattaatatacttcctctgaatatttaatgtttaggatcagatttagtgaaacttgtaaaactttaaccatcaatagcttcttactcacattactacaaaacatcaaattggtctcgacactataggtgccagaagtgctaaatctgacacatataggccttttcgcacatgtgggttgaaattgcaaaaaaaacgacatctttaaacaattataggtgccggttctaaataaaaaccaacacttattctataggtgctggtttttattaaaaaaccgaaacctttaatatgtcaaaaaacggcacctttaatccactagaatggataccctcatctcaatcgggcggtaagccccatctcaatcgggcatggcgtccatcacaggctagaagtcactgatgtgatgagctatctcaatcgggcaaacggtcgtcacagatgattctatctcaatcgggccctaagtaaagcccgtcaccgatagctttgacccagacgaccaatcaaactatagcccctcacagatgacctatctcaatcgggccacaactataacccgtcacagatgagtcatctgtgacgggcattaacttatgctagagttaatgcccgtcacatatgagtatattccaaaaataaataaattttattttttggctagccctcactcgtgtgcacccacgcggaagttcaaacttcccggtcggtcacccatcccaaaattactccagaccaagcacacttaatgtcaaagttctttagagattggcttccggaagatacgagtattctattaatcctattatgccctaggccaggatgttaaattggggttattaaatgatttcaaatggaaaagtcaccaaaaccaaagttgtagaactcatcgaggtgcaaaatttttattttggtcatttctccatctgactctatttaaacaatttgaaatttgaaattcaaagtttgaaaagttcaaaaagaattttagatcagtgaacgacttcaactgaaaaagtcatcaacaacaaagttgtataactcatcaaaatctataacttttattttggtcatttttctatataacattttttgaaccgtttgaatttgaatttgaaaatatgacaacttcaaacaacattttcaaatactaaatgatatcaactgaaaaagtcatcaacaacaaagttgaataactcatcaagatctaaaacttttattgtggtcatttcttcatacgacaaagtgatagtaacattgttcacaaaattgacatatctcttatctagttttataaactataacacatatatgtaaaatttatgaataatattactaacatttcgtcagatgaagaaataacaaaaataaaagttttagatcttgatgagttattcaactttgttgttgatgactttttcaattgaaatcatttagtatttgaaaatgttttttgaagttgtcatatttttaaattcaaattcaaattgttcaaaaaaatgttatattaaaaaatgaccaaactaaaagttgtaaatattgataagttatacaactttgttgttgacattttttccatttgaaatcatttactacccgtaaaattattttgctataatcaacttacaaatataaacatttcatatgaaaaatgaaaaaatagtcatcggtgacgggttttagttaatgcccgatagagattaagtatatagcccgtcactgatgagtcatctatgacgggcctagttgttatctcaaacgggcctcaagttggtgcacgtcacagatgatggtcatttgtgacgggccccaacttgaggcccgtttgagatatggaatgttatctcaaacgggcctaaagttgtggcccgtcacaaatgaacgtcatctgtgacgggctccaactttaggcccgtttgagataaca

SEQ ID NO: 72570 - DNA, 613 bp, Oryza sativa
aaagataacattgatcttggggtcgatctcagtaagcagcaggaagacagcgatgtactcaccattacggccctcacatccacgcgggaataacaaaatcgtcgcattgtgctccccggccgagattcttattccgggcaagcactcgccgatggcaagcttctgggtttcgaggtaatcaagtttgtactcgatgaaactagaggccagcatgcttgctgccgtgtactccatatttgttgtatgggggcactggtggagaaaccctttgtagtcccggttcgtaacccccctttagtcccggtttccaaaccgggagtaccaatccgggactaaagatcgatctgtcttttttttggtgaaagaaccgggagtggagagggatctttagtcccggttggatatacccatatagatataagccctgcctagtatatgtttcaatacatatatatgcagacatatgtatatgtatatatatattatataaaattatatgtatatacacgcataatatatatgtattaatacatatatatgtaatgcgaaggcttaggtttttagatttatatatgaccaaaatattttacctttatagaaaatgtgtacacat

SEQ ID NO: 72571 - DNA, 614 bp, Oryza sativa
  unsure (1)..(614): unsure at all n locations
cgtacgtccgttcgagagtgatcagtacccttctccgaaaaattcaaatacaaattttaaaaataaattaatttgatatttcaagcaactttatataaattttttttacaaagaatacaccattttaacaatttaaaaaatgctaagaaaaatctatatcttaagtagaattaaatggacaaaggttttgagaagaggagttattaggtagggaaacttgaacggcggaagattattattggttgaaaaaatgatatatatatatatatatatatatatataaactacgtacaaaggagttatattttatgataaattttaaaggtaaaaacttattactacaaatattttagaacggataaatacaaaattgattggatttcacgcgcatgggcgcatgattgcaggggcttggcatgctgactgtggcgtcctcgctgccggcgtgcgccgacaccgacgtcgccgacgncgtcttgcgttctttcatggcacaagtgatcttcgtctacgtttcgctctacctcgtcggcttcgctaaggattcgacaagccatgcgggttggcgttcggcgccgagcaatttgacccgggccaccccaaggagagcgccg

SEQ ID NO: 72572 - DNA, 5874 bp, Oryza sativa
agttcttttttttctttttgaattacaagtaacagaccaattgggtctctgccgttcattcgttcttgatgtccattattgctgagttcgcaaagattctctgcacgtacctttgcaaatattctctgttcttgaaatgtaccgtatccctcctgtttgtacttcccacttcagtcaaacagacttcagtcaaacagagattggaatcatctgaagtactcccttcatcccaaaaaaagacaaaccctggtttccgtgtccaacgtttgaccgtccatcttatttgaaaaaaatatgaaaaaaattaaaaagacaagtcacgcataaaatattaatcatgttttatcatctaacaacaataaaaatacaaattataaaaaaaatttatataagacgaacaatcaaagttggacacggaaacccagagtttgtcttttttttgggacggagggattatctcgttttccactttcgacttctaatcatgtatcctcaattcagggaaggagaatgtgcaataaataaaaccggcagcataaagccgatggaaacaaatgcaaagtgcacagccaatctgattatgaattcagacgtgccacaactaattcagcaattgcattaaagatgaaaaaaaacccaacatttccgactgattactctcatttttgctgctccttcctagcaaataaattatctgaactagacctaactttcatcatcatcaccaccggaggaactccatgctcagcagcacatctcgagggcattgtaatatgagtgcccacaggtggctaaagcataaggtccactccatctaaaagaaaatactataaggatacataaccagcgaagccaactatgactattagttagtagcagcggttggggaagcagaatcactctcggtcagcgcttctcaattgtcaagccgtttgcaccctcagaaaccacctgacggatggcgacacacggtgtccattcaggaatcaggatgaccaagaatgcatcgatcaactgcgcgatgatcggtctgctgtcttgtgtcagtccaaattgctcaaccatttccacagccacagaaagacttgtatcttcagtcaaattgaatgggaattcaacactcttgaaacaacctgaaaggaagttgatgttcagtacaaaacgtgttgttgaattctggaaaagaaagatttcaaacaatatgattaccgctgggatcaggaaatcttagccataaatcaacatggctggctacatcaacatttcctgtcagcagaaactcgcccttacgaagcatgcaactgacaggctgctgcccatcttcagacatattcttgaccagagagactgagataagatcatcatcctggaggaaagagttttcaacagctctgttgcagacattctgttctctactggagctaaacagttctctatgaaagatcttacttctgcatctttaattttgtagaacgcagctggtttcttaccctatatcaaataggtcatacaaacaaaaagttaagttgttggctactacaatcactctggtatctgtagacatcaagaccttacctcatcaatctttttgaatatatgggccatgccttgacattcactgtatgggtattcgcatgtcaccatttcaagcatgcacatcccaaatgaatatatatcaaccaattcattgtaatgcccagttaacagctctggtgccataaattctaaggtgcctgcagttaatgattaatatatccttattacacatccaactgaaagagaaatcctttttaagatgaaaagaaaacagaattatatgagtcaagaaaattggtaacataagtttaaaagtggacatacatgctaaatagaatagttatgttctgagaaaactgtaacagttagaaaacacataagatggcagacatataacaatgttgatatgagatatctaccttttatactttttttctgttgctgcatgaatgttgccaaaccaaaatcaccaatcttcactttcccatgatttccatttatgaatatattgtcacattttaaatccctgtgtataattgctggcttctgactgtgcagatattctagccctgttaatatctgtattgcccatcgtttcatagccttcatattcactttcttgtgctttctgcggtacctggttacatggtgacataaaaaaggttacattgtaatttataaggtaaaagaaacgcagtatccctcttgaagttttagggtaaataattttaagcaacgctcatctagtcatctatactgaattaaagggcggtacaaacaaatgacaatgaaaaggaaaagttaccaaatattatccaagaattgtaaaggagccaactaaaactttaatttgcacaatggaaaactgtaaaaatgttcaggtagcactaattcagtaaaaaaaaggtatatttagaagatagatatccaaaccaatgaataggcaacagtttattaatatgctccagctgacagcatagttgtcgtaaggatgaggggcatactgtgtcaagctcccggatgtgaacaactctgtgattatgttaacagtcttcttctccccatcaacccatgaagcaaacattttctcaatgttcttatgcttgagtgtcttcaaaagttgaatctctgtgtttagttgcttcatcttcttagaggaccccatgacagagtcatcgatccgggattggctccatgctacctcgacaccctccagcttatcgaaggctttgtagctatttccaaatcacaattaaggaatatgatatgaacaatataattttgtcccaccagcatgagacattcaggttgtgaaacccgaattaaagaaacactggaacatcttgaatcagccaagaataaataaacttgaaatttgtcacactttatccataatagaagtacagatggttagcagaactaaatatttatggattaacatctttccatgaatatatatcaaggttaataaggtcaacaccgatcaataattttagccacagattacagaagcatgaaaagttcggttccatctctgaatgtgtctgtagattctacatggaatcgcgggtgtccatcataagttcagaacacatctaatactgataaataaataatcatcgggcatggttctactgtgatcaacaaatcgaattatattccacaactaattcaatcgtgataattcaatcaagaacaaaaagggctaaactagaaacagcacatgagattgatgaaaggatacaccgttttgacggcccctgaccccacgatctcatcatactgcacacgcagagggcaacaacaacaacaacaattagccaccacccgaatccacccatcttccgcagcagcaacaaaaccctagaaggctagatagaactcgaacagaaacgagcaggacagcaacccgtacccggatgaagcggcctgcggggtccgcctcgacgtacccctcctcgtcgccgtcctcgtccggcggctgctcctccgcctccgcctccaccagatccatcggacccgcagccgccgccgtcgccgccgccgccgctttccgccgagattgtcaactgcttcccagctgagaccgacccgcacggcggcgatttaatagcggcgggaggaggtaggcgggccgattcgtgggcccacgttgggtgggcccggcctcgccaagtcagcgcgggggacgacgggacatgtgggtggggtccacgtatcggtgagagacggttcagtgggagttggtccatgagatcgtttcggatagggatggatttcgtttttgaagaaaatggttttggttggtgatgacgaacgggagtgctgtagggatattcttttctgtggcatgtgggccaacctgctctcgattaatacttttaacactatgtactattaaaaaaatatctgtgcatcataacggctattttaatttttttattattatatggtttatttaagataaaatttacggttaaattcatctggatatgtattttgttagaaaatcatgagctacaattacgaatccgatcgtctcatgttagcatacgagttatttaaagttccaaaagcgaacaaacttaaaagccgactcaaatacgatttatatttctaaaaacgaactaacttaaaaaccagctcgtacacgtatgacgtaccaaattgccgaaaaaaacattcttaatttttataatagtagagatagagatatgtagtactactttactacaaaaccaaaataaaaaattctgaaagaaactattaccacactttatagtacacctcaactctaagattcaattggttaaaactgaacagagtaaaacttcagcaccataccatgtacggagtagatgatatactccatttttgtttacatgtctctacctttactattataaaaattgaagatatttttaccgatacttttggtacgtcatccttgtttgaatcggtttttaagttcaatcgcttttggaaatacaaatccgcgtttgagtcggtttttgattttgttcgtttttagaaatatagaaggagttgtataagaaatctctttaaaaatattgcatgctaacttgagacgatcggatccctaattgcggctcatgattttgtaaaaaatatccaagcgaattctcacggtaaatttcaccttagctaaaccatacaacaataataagattaaaataaccttcacccgttgcaacgcacgtgcatttttctagttaaatgaaacaactgagagagtatttaccaagataatcatgataaaaaaagacggggtatttaattggcagacacactttatcgtaactaaggttagacaagttgttgccatcatgaaaatatgggaataaatttttagtcataaagtatggaaaaaattgaaaagaaattaagtctatgacatgttagacatgctattaaaaaagtatggaaagccacacctataacagtgaacaaaatacacacctaacaaaagacaactaaaaagtgtggtacagcaaaatatgaccaatgaaccaaacacctatatgcacacgaagaaattgcaggactgtaattgatttaggcctttatgtaatcctacatgtcattttatcaataagtattttttgcacgcagctagcaatccaagtgctagggtcaatgttctctcttcattgatcaccttaattatttctctatcacctatgggggcactccactggttgatgggacactagctactttctacaatatccacttgagccaatgaattttgtgtgaattttattgaattgaaatcctatgaaaatattttctacgaagccctttggattgtaaaaatgtatcccaaaatttctatatgatttcttccattccttcattttttctttagattccaaacatttcgtcaaagctcatgttttacaattctttaagaagtccagggcaacatgtcttttatctctccccttttacctatggtaattaggttttaattcaaatttctatgatttcccttaattttggtacaaaaattcatcaaacaacccaaagagcagcccagaaaataaagcatgcatgcagtagtttagctgcaattgttgaaatagttagcctctgtactgccttcaactagcaaagaatagcccaattatttgaccattagtgaatgatcagggaggctgattgagaaattttgcaatctcatcttccttgaggcctctcatgtctatgtagaaacatctgtgtgatttgccaacatctatgtggtgctttctctccctcacgcctttgatagtgtaccctctgtatgtgtggttttataagcacaagatggaatta

SEQ ID NO: 72573 - DNA, 1090 bp, Oryza sativa
ctcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaagaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctctcgttaattaaatgtaggagctggtaatgggattacaatttcccgcaagatttggcggattctattggaatctgggtgggtgtccggtacttttgtactaacgtttcatgttgcgctcttcctcttcattgggcacgggcacatccaaggctacatccgtatctgaaagatggagggaatacaaatagagaataagatgatgctgggcgataaggtcgaccttaaatggatttaatacagcaacaaatgcttcagcaaaaaaccacccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaat

SEQ ID NO: 72574 - DNA, 6064 bp, Oryza sativa
ccctgtaaaggcatctcttggataagccgtttgctactacggacagttcaagtaacagcttcagcgctggactgttcactctgtaactgttagagtatatggataggactctagcatccgtttgttatactagatacttgagatctaagtcttgcactcgtatatatactgatccccgaggctaaatacaataactcaatatttgcagtatatctctctccctatactattcaacatatcatcaaggcatcatctaatctccatatgtctaccagcatgctaaacaatggcatgaagagcctggagagacacgagaacacaacaagaattacagatgaacaatatggaaaataatacatcaaatgattcagttccagttcatcacatgccatgtcagtaagtgtgagttggctaatggtagaggcaaccatttatcttttacatcagaaggagttcattctactaatctgcatatgaagaccgcataaggggattgccatggtgttggatttttttgaagagtaacaaatgaagcaaacaaatgctcacctagaaggtctatttgttccccccaaaattttgacatcatgcatcctcaccctatgagttgaatacaacacttggaattgttattgttatatccttgttggtggaagtcatagttacaaaaggatagccgtgtaaactattacacaagacaaaattcacatatgtactccacaacaaatgttcccttagttccaaaatataaggcacccacaattttaggaaaatcaacatttgtaacttttgactaataattaagcatataattatatatttagtgccatgcatgcaatatcattagatcatatttgagagtagttttacatgatgttaatgttatagttgttgataatatattatgaaagaaatcaacaatcattttagaccatgaaaaaaacattaacaccttatagttcaggacggagggagtatatcaaatattttctgtatttttttgaagaaaaagcaggagctctgccattttatatatttaggtagaaaaggagtgcagccagggatggagctaggtaggagaggggggggtgcccaggaactgatcaagaaatatttttagctatagttcatctattttcaccatatgtgcaccccctaatccaaactcagacacccgtattagtctaaacttggtctaaagtagagttaagcaagcgagtggcacccctctccatttcgttctagctccgcccctatgtgcagtgttcagtacaaaggccttgcattacaataaaagacatggacaacttaattataagaggtgcttataacaagagaactagtatgtaaaatttcaagcatcaactctttggtttatatcttgaatcaccaatacagcaactagctcttcagtttgatgaacatcttggaaagctcttctagttctgtctagccaaatgttccaccaagttacaatgagtgccccattactcctcttcatttgctcctttggttttaatggcaaaagggagaaaggcccaggggcttccggctagcaccacaaggtgtgggttaaccaacccaggttcgagcctcaccagtcaccgctctcttaataaattttgatatgagagctcttcctctcatatccagcacttttgagaaagtcctaggggtcttccggctagctgacctagttttgagctttacccctttcttggtaaatttagatacgagacccttcctctcatatccaacgttttgtttttatggcaacaagattgtatatctagttaccgagtgcataatcttgatcaaactataaacaccatattagttgagcctctatggataatctttagtttttgccaagcaaaatagggatctttcctaatttccaactggacaactgacctggttcactagatcaaaaccaggtgttttgaatcgactttgaaggttggaatgattcatagatagagcaccttataaccatcgtgctttgtgtaagacatgataacttctactccagttgttgcaggaaatgaattgtttcatatgaaatttgtaagttttttttagtgaaagggaaggacctacactaaatatgcattgaaggggagagaaagaaaagtgatttattgtctttgggcgcagtctttggtttcttggaagcattaacaatatgtgcacaaaatcattacgagtgaatactttgttttaaaaccaaagcaaaccacaaaaagtaacttgtgctactttgttacaatagctcttagcctcttatggtagttcttttgacatgaacgaactttgaattgatccctaagatgaaactctgtaagggaacgaacaagggtagtaacttataaccaataagagcaacccggaggatgaaaagtacactccctgaaagaaaaggaatgtttagctacaattgcatcaagtgttttggctcccttttgccccctcttcagcacactgccaccagttctttcaccagatagtgagtgatcaggggtgtgacatcccagcccagagcttaataggattaatagaatactcatatcaacaagttgcaacttcttttccggaagccgatctctaaagaactccgaggttaagcgtgcttggcctggagcaatttagggatcggtgaccgattgggaaattcttcccgagcgcgcacgagtgagaacaaagtgtacagaaaagacttgtgttggtctgtgaggacagtctataacctatgaaagccgctagatgtaagtgggcctggcctggggagaggcgggtcgttacaaaatggtatcagagccgaccctcgcgccccagatgtaagtgggcccggcctggggagaggcgggtcgttacaaaatggtatcagagccgaccctcgcggtttcacgggcgcgtgcatggtatgcatggctggtgtggacccggagtggtcacacagcatggcacatgcgctggcactggacacatggacgtggccaagagatgtaagtgggcccggcctggggagaggcgggtcgttacaaaatggtatcagagctgaccctcgcggtttcacgggcgcgtgtgtcggggcgcgtatgtcacagttgcgcaggcatgatgtgcatggctggtgtggacctggagtagtcacacagcatggcacatgcgttggcactggacacatggacgtggccaagaggggacgtgtgtgcagaaaagacttgtgttggtctgtgagggcagtctataacctatgaaagccgtcgtgcagaaaagacttatgttggtatgtgagggcagtctataacctattaaagccgccagatgtaagtgggcccctcccatgcagaaaagacttgtgttggtctgtgagggcagtctataacctattaaagccgccagatgtaagtgggcccctcctggggagaggcgggtcgttacaagggggactaaattggttgtgttgcaaattcatcttccttcaagcctcccatgtctatgtaagaaactataatgctagaaacaccatgtgctttggtactttcctggtacaaacctttggtagcgtgccctctttatatgctattttgttagtatgacattgaaatcaggttcctgcatcagatctgccacagatagacctgcaaacttttgccttcacctcctgcatcacaacaacatgcccctgtcgtcgccgccgtatccatccaccgcatccatctcctgccgtctccgccgcagccatccgccgcatccatctcccgctgtcaccgtagatgcgggagcgatggggagtggcgtggagatggagggatgtgcagagaggagcgggagggacgtggggaaggggaaggaagctaccgagccaaatccttccaccggagccgtccccggcatcggatctaaccactcacaaccctccccgccgtatccaagcgcccgcatcctggtagacgaggaactccgtagggagatgcagaagcgagggggagcggcgtggagcagggagagatgtgcggggaggagagggacagaggtagggagggaatctagacgccgccacgtcgatggaatcaatccaggagggggcggcggggagaaacgcgagagaatgagagagagacgcgagagaaatctgggaggcgataaggttcgtgtggtgtaaacaagagaagtcgctgtccacctatggcccacatgatacgatagagagaaagtttctggttttgtggttttgtgtgcaggaatcggttttttatgggacaaagccctccctctagaaatcgtctctttgtgggacggagggagtagcttggtagtatgttccctctagaaatcgtctctttgtgggacggagggagtagcttggtagtatgtatgatgggaggtgatctgtcttatgcatcgcactgtaaaattgcaattttccagtatttactgtgtctgttaaagacagcaaacaaccaacagggagaaagttttttttctacaccacaggcgcctcgctgtcgacgggtacgtcgcctaccactgaaagaataattagccgtaaatgcgagcacccgtatcaaatctagaatttgaacccgggtgggttggttccaccacaaggaacctaaccagttgagctatgctcacttcgcatatagggagaaagttatgtgaataaaacatgaaaaatataaaacggtggtacgatcaagatgcatatattgaaacaccttgtcagaatttataatgtcctaagagatgcaatactcccattacaaagctggccttgaagtgattgccttctacatcagctctggttaggctgtactgttgggaactatttcctccattctaaaatgtgttgttggtactcattagcgcatgattaattaaatattagcttaaaagaacttaacatacgtaatggtgtaattttttaaaacaacgatcatatagaaaatatttttttaaaaaaattaccggttggcagttcgagaatcatgtgtgcgaaaaacgaaagtaagagttcgaaacctagactaccgaactcagtattagtattatgtttacataaatccaaaatattttgtttagacgatcatcaacatattatgcttaaacatttggtgcaaattattttggcgtactagctaattactgaatgcatattcctgatcaagctaatcaccatgtgcattgagcctctctctgtgactccatggataatatttatccttctctagaagaattgtgcctatataactagaaaactggcctggtttactggatcaaagctcagtattttgaacttattacgaactaatctgaaaaacgttgataaataatagagggagagcaaaactgaaaaacgctgcaatctcgtcttcctcgaggcctcccatgtctacataaggaactgctaacaccaagaacaccgtcaactttccaagcaactgtccaagcgtttggtatcagcacaagattggatcatatagctttagcaaacgtgtacctttgaggaattgaatatggttgccatttgaggaattgaatatagcttttagaaagtgcacacaccaattaaaatgttttattctaaaacgttgcgctcttctttcatatatagtagtattgattaggccaaatctcttggtacaagatcagcacaggtgaacattccattttgaaagccaaggataagagtcttgttacaagcaaacctgaagagcaatttggaagctaaaacttgttacaatattgcgcacatggtttggcttcctattgcctcctcttcgcacaaaatttctggttgttccaacaatggcagactttgtaagggctcaaagaattactgcaatctcgtcttcctcagggcttcctatgcctaagaaactgctaataccaagagcaccgtgtgctttcctacgtacacagccatctagtgctcttcccgtccaaggtttcggtaggactccctctttatatatgcgatgctatcagaataaacaaactactttttgtgtactgtgaagtaaaaatttatctagctagattttttgtaagtgattta

SEQ ID NO: 72575 - DNA, 512 bp, Oryza sativa
actatagggcgaattcgagctcggtacccaaattcaaacaatgcataaagttaaatcccttgaatttgacagtgagcaagaaaccaaactacataaatgaaatgggggtcaatgcacagtttgactatgcaaggtagaggtggtcaatggagaggagaggaggagaccattcaactcaaggcacttgttgtaccaaccaaccgtgcagtccacttgtatctacacttacgcgggagcattgacttgccatccatccatgcgtctcctcgtcgtcgtcgtcgtcgcagcaagaggacggccggtgcaacgaccggttgatcaatcgatcgattgatcgccggtaatctcaccgttgaatcagggaggaaagagtcgccggatgggaccagatgatggttaaattaacttgttaattaattacgaataggttgcagcagtgtacgtatgcatatagaacaggacagaattaatcgtgtggttagttcgagtaaacaaagaaaaaaaatgagaat

SEQ ID NO: 72576 - DNA, 1376 bp, Oryza sativa
ttcctgcagcccatcagctgaaggacagaacactaaggttaaatgaaccttcagaattttgacgcaaggaaaatatgagcgaggaatcatgaagtttttctagtttcttaccgctgtaccataaacttctgctgtatcaaataaggtcatcccattatctatgcttgtgtcaaatgctgctttacctcctgcagtctcctgtctgatgaaatcaaaggaagcacgttttcttatcatttctttgttctgtttttggaagacttttcttcccaaaacagcagcaacgattgtatcacaaatacaaagaccataacatacacctgaagtggaaaccttacaaaagaaaaactctcccagaaagagggggaagaggggcaggaaaaggacagagttgataattaactaaccaatgatagggacatgttaagttgctaattaactaatcaggaagagatttacaccgggccctcttgaaagggaaacaccaaaccaaaaccagtgacctgcctgatggttgtagtccggaacaagaacaatcggatgaccgttggtttgtagacgatatgtctcaacaaaagggactttttggttgtcgaaatcacatgacaaaatatttcacaccggagaggattgaagtgacatgcgtgcaagtgcaagtcacccggggaggcaatgcaacaagcaccttgtgcgcatgggaagcatgacctgatcacacactttctgcccctgctgctttgagctgcttagaaccagacctactacaggtaacacctaaacaactgagaatcacctggagctaaatttgactgcaacaattagcaacaagaactaatcttttccagcacaaacaaaacaagcttgaacaattcgatggattgattaatgaggcagtgcgtaccgtcccactcggagtcgttccagtaggtggtgtccccccacgaccaggcgccgatgccgagcttgctcaccgccacttccgacccacccagcctcaccttcccctcctcctcgctcaccttcgccgccgccgcgtccgacgccaccgcacgcgccgccgccaaccgccgccgaccagctccaagaacgggccgctggcaacagcagccgccgccggccaccacctgcagcgccatggccgccgccattgctctgctgctacgtgtgtggtgcgtgcgtgcgtgttgctgctggctcgaggagaagagaagcctggctccttcttgtactctaccaccaaggccgcgacgaggcgtcgcggtcgcgggagccaacgatttttttttcaaaaaaagaatacaaatttggcggtagagttggagatgccacgtgagtaacgtgcagatgctgctgctgctgcgagatatctgcatgga

SEQ ID NO: 72577 - DNA, 759 bp, Oryza sativa
  unsure (1)..(759): unsure at all n locations
agtgaactgctatcgtattcctgcagccctttatcttatagagagacgtgtcaatgtctaaaacgataaaatatttttttttatttacctgggcgaggagctcctcgggggagccgaactcggtgatggtcttcttggtggtggggttgattatgacggagacgttgctgttggcgtcgaagttgtcctcgtagcggaggacctgtccggggaactcgcgctccttgctggggttccacttggacgggatcagcagcttgaacccctcgccgctgtaggcgatgaactccgtgttcgtcttgggcttcccgaacacgttcgccgcctcgccgtaggccgcggcggcgggcgccaccttcacccccaccgccgccgtcgctccggccagcagcgcgagcgccgcgcggcgggagacgtcggcgtcgtcctgcttctgggcgcggcagacgaggaggtgggtccgtgtcgccggggacggggaggcgacgcgcgcggcgacgcgggccgtggactggtggaggaagcangaggtggacgccattgccggccggtgggctggtgcctcgccgctgattgcctgcctgagagtggagcggggtgtantgtggtggagggagagggtgatggggcgaggtggcgacgggataaccaagaggagagcgcattgggggcgccgcggtggctaggacttgtggtgtttggcccggcgagtggatggtgttcggaatcgcggataaggcttccccccgccccttggcg

SEQ ID NO: 72578 - DNA, 4804 bp, Oryza sativa
taattcttacaatctgaacacaaaatacccaaagaaatatacagtaaggccctaaaattccagaaaatgcgactattaaaagcacgaacacatcatctgctcatggaggacgtgatcaatcaaatgaatgtctagtacttgagctacataactggatgtataaccaatgtaattcagaataaaacattgctgtgtttacattcaataagaataaagtgatgcacacacaactatagaactgtaaatcagcaaccaagtgcaagatgtcaaaaggcagataaacctaaaattgtggtaaataacaaatatatatactagtaagcacgcatggccaaatctagagaggcaattttcaccttgtccatcaacttgttcaacttcttcttttgtttttttatctctgtattcatcttatcattctcgccatctaaaccatcttggacaaaacaatctgcacaaaatattgagataattggatatactagagcagcataaaactgaattaagttttgcatcatcaaacactaaccattgacagcattgccatcctcactgtcagaataatatagacattcagagtcctgcacaacgagcaattcaggggcaatataacagacaatagataatgtcactggttggaaacagcaaacttatccaaagcatgctatagaggttttgggagccttgatgacacactattggcaagaactgagccatggtgactacggctgctatagtgatgagctaatgatagccaaccatcatacttgatatataatgtactaacataccaaaaaactgttcatctcttgccaacagatactacagtctcctacttggattttgcacagaaataagcagatttgtgaagaaagtttatcaacaagaataaaaaggaataatgcctatgcccttgtcaataggatggaattaagaaaaaggcttgatatatgtggaccaagctcaagcttggacaaatacaaatttgttatatgcttgagcacaatacatggaaggcatcacaatactgtaaatatggacagttgtgaacattttttaaaaaaaaagcatgattctttatgatggaatgaatgctggttgtggatcaatgaataagatcctctgaaaaggataagcagacatacctctgaaagataaccatcactatcagacagatcactgtttaattcacattcatcttccgggaactctaggccattaaccaaagctgcagcatcaccgttgttcctagaggaaaagaatttcgaatttatttagtaaattaaataaaagaaacactaatgaactattgtgcagtattatcatgattaatgaagttgtaaagttatgaagttgaattgaggttagtctattgcatcatttgagttgcaagcaaagttctggtcagtctcaatatctagtacaattcagaccagatcaattccatccaaaaaaacaaaccgacactatcaaatgtgtgaacctagcaaagcattgcaccctccccttctagttttcaccctattgtatgttggaaagcatcctgataagcctaccaaaataaacaaaaccgtaaggagaggtgaaagatgattacatgacgttatcgattgctcgctgcggcatctcgtcatcgccatcgccatcgcgctcgttcccgcgaccgctcccacctgaggaaaagaagagcatatgagctaccaacagaagagcccccgtggactggagccgtacggaaccaaaccacccggagaagagggaggagcaggagacgacgggggagcacgaacctctgcgagggcggcgggcgaactgcgagcgctgcttgcggttacgcttggcggcggactggaggtgcttgcgcgcgaacttgcgcgccttcttcccgagcttcttcgccatcccctcccctcttgcctcgctagggttagggtttcaggtgttctcctctctctctctcttcttcttcttcttcttcttcttcctcctcgagaagacggtagcgccggcgctccggcggagttgtggggtgagggttttggggttgaggacaagagaaacgtgggcttaaatgggccttctatggagcgcattttgtgggctgaggctgaacagctcgagtacattttcggacactttgaagtttttttccatcccatttttcaccctaaactatataaaatccgttattttttatctgatcctatcatcctaagttttcacaacccaaatagtagtttttatgtagaaaatttttaacttttagttatatgccaaatgcaataaggtcatttcagatccctaaaacaaatgtctaactattgatagactaacgaaaatcgttagacaagcgagaaagatagaaacaaacccaatgatatatgagaaatcaagtaaatatcatgagcttagttttcaagaatcacctgaaaaatcaacgacacttacgctgcattcgccatgtggtgtttgggaacaaatcctacacgcacgcaaaataaagtgattcattagcgtataattaattaagaattagctacaaaattttaaaaagttagattaatatgattttcaaagcaactttcgtatataaaacttttgcaaaaaaaaacatcgtttagcagtttgaaaaatgtgcgcgtgttcggttctttccccttcttttacatgtttagcaaaaaaacacacgcttctattaaggctgtgtttttgttgaaaagaatgtgtttggttgggtttgacgcagtcggataggagatggtcgtctctaagagcatctccaacagtttctccatcccactcttcaagccaaattttagccattctagcccaaaaacgtgctccaatagcctctccaactggatgactaagccatccggctggccaaaacccccctacactagccaaatttggacaaccagaaatcattggccaaccgtaggccccacacagattcctcccccctcccccctctctccttcggctcggatggcgcatgcggccaagacctcgacgcaggcgtcgtgcactgccgcgagcaccggcttccatgcgtcgcctgcatctccaggatggtgcggcggagccccttggccgcgagcgctaggccgcgggcgcccggcgaggaagaggctgtggtggggttcttggggagccgagctcgatgcggcgcagaagtgcggaccggcagcagagagcacgatggcgagcatcttgaacccacgccggagtgccaccatcgtcgtcgaggtcgccagccgctgtcgccgtcgtctgcaccgtcgccatccactgtcgtcgtccctgaggttgccattatcgtcgtctggatccggctccgtccgacctccgttgcctccgtccccaccggattcgggcggcgcggcgttgattttggcggcctctgccgtctccgcctatgcctccttgggctgcggttgccgacttgccgtcgtcgttgccattcgccgacgccaccatcgccatccactgcggttgccgtcgtcatttccattcgccaccgttgaggaagaggaggggagagaaaatccaggagaggaatccacccgttgccgcagtaacgacacgatcaatgtgtattgaatcgcctgcccgttacagaggtaatctcgcgaattctgaaccgttgcaaaagaatctcgagacgtggacgcgacgcacgccacgccacgcccacggcctcggcccggctcggcgcgcgcgcgtgtgactttccgatccccacctcaaccggtcaacatggaacctccaataactccctatttaagttgaggttctccacttttaattcccagggtggtattattatctttaacatttattatgggcccttgagattttaatagaaaaatcgggcctagcccatttattctaacaatccccaccaaattttatggctcataagaaatgttctcgaagttgaacctgtttgatataccagtgttttggtggagactgttaagttgaacttccacctaagaaaagagctacatcagaccacaactgaacaatggactatgccttgaattgtcattcttgtctgatcaggtttcactcaaacccttgactggtactgggctgccgtttgcatcccctctgtttggagcatataagtcaaactccaggcccttttatgagtatctagagatcgcccaaatctcatatactgtgactagcagtcgaactcatataggtgtgttccttctgagatgttctgcaggtcaacatctctgcttagaaaagccacttgaatcgcattaaggcataagccatcccaccatgcagaatagaagagaagtacatcatgaaaatgagctcttttcaatggtctcttctctcagccacacaatagtttgtttcgccatccaaattcacgggatctccgatcacaatggataggtttccactattgtgcaaccttaggtgggtatcaagcccatttctcttgatgcactgtctatcacattacgtggtagccccttggtaagctgatctgccagatttttagccgtttggacatagtccaatgctattactccggagtttttctgctttctgacagatttcagtcttcttttgatatgcctagatgacttcatgttgtcctttgaactgttcactttaataatcactgtttgattatccagttcattaggatagctggcactggtttttcaactaccggcaaatccatcaggagttcacgaagccactcggcctcaactgtcgcagtatctggtgttgtaagctctgcttccattgttgacctcgttaagatggtctg

SEQ ID NO: 72579 - DNA, 15982 bp, Oryza sativa
tttatgtgataagcaatctatgtggagattatatgcatatgatattcattttagaaacccttctgttgaacgtttagcatgccatttaccgaacatgaacgtggtctcttttagattagacacaaatttagcatctatggtttcaaatacatttttacaaaaaacaacattgactgagtggtttgtcgctaatgatctgttcccgcaaggccgtcacctaacatactgcaaatatcctacgatgtttacttgggaagatgatttaaaaagttggaaaataaggcagcacggctataagattggtaggatgtattacatccatccttctgcaggcgaagcatattttatgaggatgttgatcatgtacgtaaaaggcactagaagttatgaggatattagaacatatgacggcgttgtttatgatacgtttaaggaggcttgtgctgctagagggttgcttgttgatgatagagaatggtcgtatgcatttgatgaggctgatagttgggcatccagcggccagcttagatcgctttttgtgttgatgattgttcattgtggtattgctgatgagagtgcattttttgagaagcattggcatgcgatggctgatgatattctgtttaatctgcagcaagccttaaataactcttcgtactctgttcctgatgctcagcttaaaaatatggttttacaagaattgcatacattgtttgttcgcaacggtgtttctatgtcttcttttaatttgccaagcatcaattgtgatagctcctttcaatcagcaaatagattgattgacgatgaaatgtcttatgatatagataatttatgtgtgaatgctccattgctatatgaccagcttaacgttgatcaacgaaatgcatatgatcgtattgtgcaaagcgtcatgacgaaatcacctgctttttactttgtttctggctatggcggcactgggaaaacgtttctgtggaattgtattgttacctaccttagatctcaaaaaaaaattgttcttgctgttgcatcatcgggagttgctccattacttttgcccggcggtagaactgctcattcccggtttaaaattccaatagaggttgatgaatcaactatttgccatataaagcgaggtacaatgctagctgatcttattaagtccacttcacttattatatgggatgaagctctgatgactcaccgtcgatgttttgaggccttagataggacattgcgtgatatccttgctgaggatgatccttctgctgcatgattaccctttggtggtatagttgttgtgcttggtggggactttcgtcagattttacctgttgtggaagggggtattagatcaaaaacaattgatgctgcaatatcaaggtcccctctctggtcacatgtgtctattttagagctatcgataaatatgcgtttgcgttcaagctctctaagccctgaggtacaacatgaaatcgctgactttagtgattggattctttgtatcggcgatggtacaacagctgcaagtgctcgtgatactgacactgaaccaacatgggttgatatcccacacgatctcttagtcatggataatgatgataagattggagctattatatctgcagtctatactgattttgctgaacattatagtgatcctatatatctacaagatcgtgctattgtttcacctacaaatgatatatgtggcactattaattctcgtgtactagagcttgtccctgacgagatgaaagaatacctaaactttgattcccttgcaaaaacaaatgagaaatgtgatgatttagatgttttgtatccaatcgaatttttgaactcaattaaagttaacaattatcctgatcatcaattgtgcttaaaaaaaggtgtgcccataatgcttttgagaaatctagatcagagtgctggcctttgcaatggaacgagaatgattgttacaaatctaggtgaccgagtaatagaggcgcgtatcataactggttccaatattggtcagactgtttatatcccaagaataactctatctgcaaacaataagaaatggccttttacattacagcgccgtcagtttcctgttcgtgtgtgctatgctatgactataaataaaagtcaaggacagagtctatgttcagttggcatttacttgaaaagcccaatattttcccatggtcagctatacgttgctctttctcgtgtcacttcccgtgcaggcttgaaagtacttatcgaagatgacaacgggaattgcacctcccatactcgaaacatcgtttatcgcgaaatattcgctgctcttagatagttggtggttgctgtcgttttgtttattttattcctacggtgtacagatatactcgaaacatcgtttatcgcgaaatattcgctactcttagatagttggtggttgctgtcgttttgtttattttattcctacggtgtacagatatacttgttttgtttatatctaaaagtttgctatgttgttctatggatcatgtatattacctggttatgctgcgcttttgtttgctgtcttactatactctttgccataggtgatgcaccgcatatttatctgcttattttatgctttttttgcccttttgcatgaccttgttttttgctttcctatagatggctttcgatttgctgtgtgacatatccctagcaagcagaggctggaagatccgtgcaaggatagcaagaatgtgggactacactggtacagctaacgatgtgcctcctatgcatgttgatctggtgcttgttgatgagaaggtatatctcattagtccgaatgcagggcacctttatattccctgtccaatttgatttgcttacgatttaaatgcttatgtagggaaatgcaatgtatgctgaaattccaggcgttgaggctgataagttcagaccacttcttcaggaatcgaaagtctacacttttagcaagttccttgttttgcctagcaaacctgcatacaagcccttccctaacaagtatatgatcaagcttactccatggacaaacgtggaacaggtcaatgaagttcctgctgatttcccatcccatgtgtttaatttggttcaattctcagatctaagccagcgcgttgggatgcaagagtacttcactggtttgttctttcctttaccattactttccattatttatgctatctatagcatttatcaatttacaaaccactgttcttaattctttttagatgtgatcggtatgatcattggggtatcaaagctagcctatgtccgaatggcgtctaaaacgtcagacacacctaagagggtcattgctctaagggatcttgcgtacgtagcctccatgatttatttgttgttccagtctttaccagcttgttgtttatgaccctgacctctaatgcatggccaactattttgataaccgttcattcttccgaataggaactgtgaggttaaacttgtcctatggggagagcatgctctcgactttgatgctgatgctgttcatagtgttggccaagataatgttgtcgttggtatctttgttggtactcttatgaaagcatataatagtaagcttttctccttctctgcatgtttagttctctctttattttctggtgccggtgttgtatcttcaatgtacatttgtttttttttgttgtctccacaatcatttcacctatgtattatgtacatgaagaaactcttagtggaggatcagcctgcaaatggtatttaaatgaggacataccagagataaaccagttctttgataggttagttaaagcccctcacaacagagttaataattttttagagttctaccccctttctctaacatgtcgttttccatgccttgattagcctgggtgatagtgctccaaagatccagtggatatcagccggagcaaagtcctttggttcgtcacaacgcccagcacagttggagcataaatctgttgctgaccttaaaaagattgatccatgggaagctgcggtaatcactgtaaaaagcatattatatgctttcgcatatgtatttttcatttagttcatctacaaggttattgctaaacacttcctatgcagggtgctggcttctcatctactgtgaccatagctaagttgagcccatctcagtcatggtggttttcatcctgttcccgttgtcatagagccgcaactgcatatggatctagctataaatgctacagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactgattcagcagagtttgtgctgtttggacgtgttgcgcagcaagttgttggccgtcctgttatgaatcttatcaaatttcagggcagatcagacaatattcctaaagaaattgctgctgttgtttcatagaaatttacctttgctgtctctgtcactgagcggagccttatgcataggaatatatcttttcaagttaatggaattgagactttctttggaagacagggttctattccgcagcctagggaacagggtccatctgcaggcccttctactcctttggctcttgttgcttctggtatgaataaggatgacgcctctcaatctcatgagttaaccccggtcaattcatctacttcgactgctgatccagtcgatgaacttcctggtgacagcaagaagcggaaatccattgtccgtcatgtacgcccttccattcatatcccatacattacctgttgctttttttatggcccttctttttatatgtctgattgctattccagcctctagcagcacagaaaaaattgacctttgaaacagctccatccagcaaagaaaacaccagcccggttgaccctcctgctaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgaggaaccatgcattatgaacatattaatgtaggttccttgttgatctatattcctaatcatcctacctaggcctaatagacctaaataagtcattgctatttctcttgcttccatatgccattccgtacctctggtctactctgtactttgttccaccgtataaattgcctgtatgctaaatagaaccactttacattactatgacatggcctgctagctaatcgaaagaaacatgctcatagacaactacagaacattatttactacaggcagattagttgcttacttgttatcttttatatgggatgtaatgcgctccaaaatgatctgcatatggcctaccatcttttgctaccactgaccattgcacgcagcctaccagttatatcttttgctatgcataggcatatcatgtaatattactgatcatgatggctatctgctatatttctcagttcttctcgcactgatgaccaagctgctgataagcaacatgctgtgcctcatgaggttgatgtttctcagattgcagctgcctctgctgaaccaaatactcaggttaagcataaatacaccactttccagctaattcagtggtcgaatttttttagtgacactggcaacctaattattcccgttctataggtcaaagatatcctgccaactgaagccaaaaagaaaaggtataaaactacatattccagctgagaacgaataagaaaatccctatttttgtactagcggtggaagcatgtcacattcattgttaaatagactgcaccatttcgctttcgctgctctctcatttttggttcttctagattaaccaggtgttcctctctgctttagtgttgatccaggctctacaggcacacgcaagactaagcctcctgtaccgaaagggaactaaattgctcaccttagcttttgtgctgatgtgagtatcttgttctgttatatatctatgggcacggcattagtttcacctagattgctgatcactttaaattattttttaggggaataataccctacatcagcgatcccaccctatgtctacatatttccttaatcttactgttggcgatgctgcttgacatggcacatcgtatcagacaatcttttgtttacatgattgctggcaccactgtgtccatgcatgtgcatgtttggtcctctacctgctgctctttcgccctttagtgtcggtgtgctttccatataaccgtagcagagacttcctatgaaacgctgccatacgactgcacatcaccccatcttttgcttgtatgttataaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaaacttatgtttcatgtgctacgtgcctgtgcaggaatttgaaatttgtagcatttccatcctacccagctaatgtgataagtaggattttgtgccatcctttctgtcctaaagaaagggtgggcaaaatttgcagctaaaaatagcatacgcgttggatcgaactgcattttccacttctacagggcaagccagatgcaaatgacatgcaaatgaccatcgatgttctgtagaccacacgtgaatagtcaatgtattcaggaccacttaccagctctaccgccactgctatgttaattagtgttgcaccttaagattattatcataggtactgcagcaccttacaaatatcagacatatgtgtgttagcgctgcaatctatttatctattgccgtctgctttcattacttttcccccaccaacactttttaaccgttcttccctggctatcagcttattgggcggcacacgtgcgtacaggcggtgcgccaagggcgcgccccaacctctagttaaaggtaacagagggctccagagaatcagattcatgtaagattgtcactagctagcatccatggagaaaattctctacgtgctcttgagaatttgcccgatccttatatgtccatgaatttttatctaatgtattatatgcacctgagttctccttttgattatgttagttgaccgttaattttttcaaaggactatattgcccccgtcatacttaatcagttaattgtctgctagcctagtgataaaaaagacaactctcaacaggagtaagattcaattgtaaaaatgaagggatagaattaattgaccacaaatttaataatgaaattaaaattttaaataaatttcaaatgaactttgatgaaatccgtacagcattttgaccaaaatttaaacccaagtaataaataatttttgttctgaatttctagcttaaattctcgtatggatttagtaaaaataataatttattcaaattaagttttgtattttaaatgttgcatatttctgttcgatttgatttgattataaattataatttttcacatagatattaatgagtcatgtagcatgtgagtatgagaaggggtgatatagttatttcaaaaaaatctaatggtcaactcaaggtttaactaatggatcgggaaaaactcaaaggagataaggcaaattttagggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggttttctaaatctactttacaatcttatcaaactaggactttaggctgttccataatatacagggaaacgtaatacccaagtcatgatctgttacatattttatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcaggtgcatcgactagatgcaccgagtggtttcgataattgtagtcaaccaagcgacttaatatgtagcatatgtggtatgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccatagtattgggcatacgccatgcgcacactgctttaacagatgtgcttaagtccctagaagacacatggttccaccacacctggaaatatatggcatatgaggtataaaatctgagtaaataaactcataaaggatttaccaaccgcctggaaaatgaccacaatatataatcagcctaagccataatattggtcaataaaaatgcacacttacgtggcaaaaagcaatgatattgtatccaatcaattgcttaaaaacccaaacaacaccatgactatataaaaaagtcagcggggcagctatataaagctttactgtttgacaccttttaagatgcattataccaactcctaaaaagttgagtaactgcgatataaaaggattttaaggtattgggcaattgatcacgcgcactttggcctaagcaaaaagtgcctaagtccctaaaagaacgtgacaggccacacctgaaaatatgggctgcagatatattaggcctaggccaaaaaatatgccttcgacaccctttaaaggatgacgcatgtaacatgctcccgagtaataaatcttttcgggtgatatagaccaagtgtagctcatatgaatagcttctgatctgagtgattatcctttatgggatactccaaaatagatataacaattgaattccgactggcacaagtattcagttgataacccttacggggaataataaatagtccagtctttgagcatagaaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcagctgttgtagatgcttcacttggaggagagttgatgttgttgcccaactcgtctaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtgtagcccccgactctttgatcagttgggaaacaactgaacatagagtcgagaactgtagcttcttgtcatcgaatagtcataacttgagtgaagatatgtgttgaggatgtccgagtagaaatattgaagattggaacaccacttgttgtaataaaataatacggcatcatatttagtgacatatgccgaggtgtcgaaactcttgtagtcgtcgtggttggtgaagtagcaaagcttgcgaagtagaagcaataaagtttgccggtgccgaagataataaagatgaagtcgctccaccatggtgacaaagttgcatagctgtaatgaagtgaacacgagtcggcggtaacagaagcaaaccggtggtgaagacgcgcagttgtgaagataaaagcaccagtcggcggcggcataaccagtcggcgacggaagacgatgatgtccatcagtagtggtagctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccaacgtgcaggcggaaacaccagtcggcagcgaacgaggcggccggtcggtgaaaacgtagacgtccaacaacggcggcataataggccagccgtgtaagcggaaacaccggtcggtggcggatgaggtggccgatcggtgaagatgtaggcgcccaacaatggcggcataataggccagccgtgcaggcgaggacaccagttggcggcgacgaaggcaagccggttggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagttggcggcgacgaaggcaagccggtcggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagtcggcggcgacgaaggcgagccggtggtgaagacgtagacacccaacaacggcggcataataggccagccgtgcaggcgaggacaccagtcggcggcgacgaaggcgagccggtggtgatgttctgattgatccattcctaaagcgtaggagataagcttaaagccatgaatcccttttatgcatatctggatctggatcctacagaacaaacagataggatgagtagtacctgatgtaaatataatactcgagaaaaattcaagcattttaaaatgtttataaatatgtatttctcctcttgtcaattgtgatttccccgagcagatgactccttacgtttaaacactctgcccgactagtcatagtccccaagcatcgggagtcggcctaggcacttcccaaacatgcatatgagtgacatgagttcgtcattaatggaacaaagtttcacggatcagaatttactactcgggtacttttgccattattaagagcagaaaataaatttatctcatctctatgcttttgatttattccgaataatacttagcaccttgcgttactcggtccatccaacgagcccccgggtgctaggaatcagcccaaaggcaaccatccattggcaaaccaaacggaaagcataggaagatagaactccataactcgataggtacttttgtactcagattatgtcgcaagtaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagtgaagatgcccactaatggcggcacaataggccaaccgtgtaagcggaaacaccagtcgacggcaatgaaggtgagccaacggtgaagatgtagacatccaacaacggcggcataataggccagccgtgcaggcggaaacaccagtcggcgaaggccagccggtcggtgaagacgtggacgcccatgaacggtggtgtgaccaaccgaccgtataggcggggacgccagtcggcggcgacggaggcaggccggcggtgtagatgacgatgcccatcaacggtggtgtgaccaaccgaccgtataggcgaggacatcagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacaacggcggcataataggccagccgtgcaggcggaaacaccagtcggcgaaggccagccggtcggtgaagacatggacgcctatgaacgggggtgtgaccaaccgtatataggcgaggacaccggtcggcggcgacggaggcaggctgccggtgaagtcgtagtcgcccaacagcggcggcataataggccaaccgtgcaggcaaggacaccagtcagcagcggacgaggcggccggtcggtgaagacgtagacgcctaacaacggcggcataataggccagccgtgcaggcgaggacaccagtcggcggcgacaaaggcgagccggtggtgaagacgtagacacccaacaacggcggcataataggccagccgtgcaggcgaggacaccagtcggcggcgacggaggcaggccggtcggtgaagacgtaggcgcccaacaatagcggcataataggccagccgtgcaggcgaggacaccagttggcggcgacgaaggcaagccggtcggtgaagacgtagacgcccaacaacggtggcttgatatgccagccgtgtagacggagacaccagtcggcggcggcgaaggcaaaccgggcggtgacggtggctccagcagtacatgtaaagagaaaagcaatctctaattagcatcaagaaaattaatcttgtgtacgtaagtctgcatatatgaagcatgcatatattttttgattggccgattgatctcctgtagcatgaacagtacacacatccacacatgcacgtcaccagacagattgcaggctgccatccgtgcgtacagatcacggtccgagtccggatcaaatccaacttggaggctttacgtgatgggaatcagactcaggtgaccatggcgcatgcaaaataaggaatcacagatcaaactgagattagaaaattaatctaatctaatctagttagtacacactagaagattaattagaagtatatgcatgcatgattaggtagatcgtgcatgtatgttaatctgctaaatcaactcatgcatgcgtgaaatttctccgagcaagctataggcggctgctcccatgtgcccgtggtggcgtggtggccgcaacgcatccgtcggcgctgctcctggcgatcgccgtcaacagctccgttttaacctcagccgaccagcccatagaaagcaaggaaaacaccagaagagcaaatcacaattagaaattaatctaataacagttagatcaaaacaccgaacccgactgaagatttgagccatcgagattaatctcgccgtttcttctgtagttgattccatcacacttttcgatgggtaattcgacgcagcccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatattttatatatataagttatcccctataactagtcggataaccatgccgtgtgggtatggggtacccataatctccacatagggcatgaatgagattgagaaaaattgtcaaggggtacacactagtttggataggaagatagggaaaaaaaggagatgaagatcgaggacgtttttcccaagatggaccgtgtgactgatatatcgaaatacaagcagtacacggtcgcaaggtctccaccacggagatcaaggatgccttggccgttccacaccaaatagtgatgatatgctcatgcatgtaacatcgtggagtcccaatctaaatcaggtttaacaatttgggggtgtgtgtctggggaggggggagcggtaaaattagaaattgtagattttttttccaaaatttggatcaaattttttgatgaaatttgagccaatttaaatacatttccacaaaaatgaaactttctacaacgatatctatatagtcccttccccggcgcccgcctccgcccctggagagcacggagacattggtgtaacttcgtgtgatgctatgcctgttttttttttattctcgatgcgaaactatgtcttctctctcttttcgccgatccgaaaatattaaaataataaagacggtgtccagtgacaaattatgacatttacagagtgtcttcttctaaagtttaacttggtgtcttacatgtaaaactgtaaagtgacaatatcatatagcaaatttaccaattaactgcgcatataaaattaattattttatatccactgattatactgaccagccaattacatattgatctctattacacgcatggagacgaaggagagctagcatgacccttattgcatatatatctcgcatgcattcaggttacatacgtttagacgtactactacgatatagcttgatcagtatacagctttattctcggcacacacatatatagtatactcccatgcactaatagtacgtaggtacatgcaagggtatatacaatttaatccattttatcaacgacagttgctgtgctttgctttgagcttcttatatatggtttccagttctgcatactctttgtgcttagcctgcctgtaattctccagtgcttgtatcttcatctggagggctgcattttgattcttcaaggcagcgatttcagcctcgtacgatttgttcttgcttattgctagctgaccacatgcttcatcctgcatacatgcataataatgcattggtatttatatatatagattcaatcaaaattaaagtacatatattaattctacatttgtgtagtatatgtatggtagctagttctacatatatatgttacgactgttatatactgagagagagagagagagagagagagtgcatagagaggaggggaagaagaagggtatagtatgtaccattatattgagctagatatatcgtagctagttctgtttgcagaactacaacacttgttcagtggctaacttagcatgtttctcgcttcctacgtacgcttaaatagacaaagcagcatggaggcttgcagttagttttcgtttcactactataaatccccaggttccctagggttaaaattcgttaccttgtagtgaatttgtccatgttgtcaacttcttcttcctcatttttcatacgtacgttttccgaatgttatgttttattgaaaatttctataggaaagtagctttaaagaatc

SEQ ID NO: 72580 - DNA, 18530 bp, Oryza sativa
cgcgtggcggccgcttgagaactagtggcccccccataacatgttcagcagaaagtaccatacaccgatatatcatacggaaatcattaaaaaaaacatacattggatgtatcgtgctcctcaccgtcttccgcttcaatcctatcattgtagaaattctcatacctctttgcaaatccatgtagcgaagaggatggtttttcatacttcttcagaacatgattcatgctctcacttctttgggtggttgacatcctagcaaaaaagaattccctgaagtaagctggagcccattttttcttcatgtcccacatcctgcgcaaatacacgctagactcgagattgtactgctccattcaatctgaccatgccttctcaaactctgcctctgtttggggttcatttaacacccggtggaactcctgtgtgaaactgcttcttttactgtaaatgttccccaagttctccttagcactcttcagaatatgccatttgcaaactctatgagtagtttcaggccaaaccgctttgatcgccacctccatttgatgacagttatctaaaaaataagttcacaaccattcgagattaaaaacagaagacatatcattaaacacaccactgatccatcccaaaaaacatatacctgttaaaattgttgcaggcctcttcccatgcattgcatcagtaaatgtttggaaaagccacttgaatgcttcgattgttcgattgtctcctccctcaacaaagcgcaaccaaaaattgctgtttgaaaatggttatttacaccgacaaaaatcccaaatggcatgttgtacctattagtctgatatgtagtatcaaaagtgattgcatccccaaaatgttcaaaacttaatctggacagtgaatgacaccaaaatatatttttaatccttgaagcaccatcaatctgtatggtgtaaaagaaattcttactacggcattgcatttccctaaaaaaattcagtgtcttctgcacatgatagctacactcatcccttctgatggcatacgccattcttgtcacagccctccttgtaaagggggttaaggacggcccgccgagcatacctgaaagtaatccatacatagctgtaggtgtcatcccattatctaccatttcctttatgttcctctttgtcccttcatcaatgaaattatgagacctgaagtgcttagtatgctgcaggtcccgtttcatttcatggttatgctcactaatgaatgcagaaactctccacttttgactttcagaagaacgatttaacctgaccatagccttgcagcctatcctggtcggcggaccagtgacagaattatctctaccctgcataaattacaggaacaccttactacgtaaaacctatcgaatgatgatcctacgcatcacactgtagaaacttgccaatcctacgagaatacgaaaccatggttttcaaaaaaaaaaagaacacactaaagatttttacctcacgaatgcagcagaactcttgcatggacttcacgccttcatctttgtatctgttcttggatctccttataccaaaaccagtgaacctagcgtacagattgtagaacgcatagccattagagtcctcattgaaggtctgcccaatttccggcaacagaatggctgggtcagagagtgaaataggcagcagatcactatcttcctccccctcaaccacgatcctaggatcaaaaaacgagaaatcaggaaacaatgcagaaaggggaattgtacactacaatcacactgacataaaaaaatacctttccaacggaactacgtccatgggttgtccactatgatcctcgccacctttctccggccagccttcttcctccatacctatctccgtgaatattgtttctgtccagcacggactctggtagctaccccttttggcaaacagaatttgctctagggtgtccttttttttcagctggttggatatatactgacaaataattacggtttattttccaccagctgctcaacaacctccccgaaaatcaaggctcctacgtgcgaagcatgttattggactctggaaagtcagccactagcaacattaacgaattctgatgaaaccataccgccacaaaaatagcatctataacaaatattccgaatacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaattttatttcacttcccaaatagcagaagatacagatttctcaactcagatactactcgcttttttctcatagaatataccatacaaaactagagacagttcgtacgactaatctacggccgtgcagaaagcaagcccttattacaattttcctgatcatcacactattggctacatattttccttggacacatgttcgcaactattactgttgccccgggttgtttcgttgcttctgaaattcacgtcgcaagccacgcgaatatcacggagtgagcaccaagcacatctcttcctaggattcctcatggaaagaggatgacatccatccaaatgaatgacatatttctggagggagtggttcatcacttcactccgggcagcagtatccatgcaacgcacaaaaccattcctgatgaccaaataacgcaataaccagtcagagccaaacaaacaaacaagagaaaaattttcaacagaacataacctaaaactaaacttctatgtgtacctatctgcggcaggcttctgctgcttgtcaccattagctgtaatggttccattttcttccttcgccagattgtgctgcttgctactactcactggcgacgacgcgcctacggccaccaccgacttctgctgctcgacatcacgcgccgacgagcctccgcctacttgcgccgcggaaggcgacgcaacagacctcgccgacgacattctgccctttccaccggaggggttctgctccaccaaaaacctgcagaacaaaatcttcttcctcacaaatccgaaatataattctgctcctcattttctgtcctacatcaccgtcaacttaaatagagtatcaacagcaacctccacactaactactctcctggtcgcacggccatgcatgcgtgcgggtcaacaatccatgcatgcagaacattcaaaatgactcgccatgcagaacaccacgcggtgatacgaattttcaaagaaaaaaagaatattcaagtttctgcatcggtggatcagtggatcttttctcaccaaccgttagtgagttaaagcccgaaaccctgatatgagttgggcaggtgtccgatggttacaataggagtacctactacagggagtagtatataggcttcctatgtatatatatatatatatatatatatatatatatatatatatatatatatatgtatgtatgtatatatatgtatgtatgtatgtatatgtatgtatgtatagatataaatatgtatgtatatatatatatatgtatatataaatatatatatgtatatatatatgtatatatatatatatgtatatatatatgtatatatatatatatatatatatatatatatatatatatgtatatataaatatatatatgtatatatatatatatctatgtatatatgtatatgtatatgtatatgtatatgtatatgtatatgtatatgtatatgtatatgtatatgtatatgtatatatgtatatatatatatgtatatatgtatatatatatatgtgtatatgtatgtcggagaatgaactcctccaccagggaaccgtgaggcccccctttgtgtgttcggccgggggcagcgggtgagattcgagggcttggtgagcggagctgtgtgatcttgagggggttagccccccccccccaagacgatgagacaaaagaggtttatacaggttcgggctgctgagaagcgtaataccctactcctgtgcatgattgattgaatgtagaacacaagtgcttggggttgcgagacccaagcgccagttcgccccgaagtcccccctccaccactaggcctggacctccttttatacctcaaggggttaccacatgggcccaacaacctaacctaactccggtggagaagtattataatctttgcattaaatgcatgtcttgtctcttgacttgggaagccaagcacacgtcgtcttgatgatggggcctgtcaaatcttgccgcctgacatggggggtgcccctgtcagtcaccatttaatgggtgaagacttctaggctcctattacaccgagaaacgggagccttgcttttaccagagcgggaggactgactctggctgggataagaggatgagaacctctcaccatcactatttgatgggacatgtcaggctgcacgccgcctgacacacgagcagcgcacaggcgcactagccagtcccattggtcattcgaccggtcacagaccggttgagtgcactgcacgccacattaaatgcagcgtggcgcgactactcgggatgccataaatgcgggtaggtgggcacttggaggcggacacctaacctaccgtacgtggtgacctagagaaggggtcgggggagcccgacccctagtcacgagaaggggccgccgccgcccgacctcgggcccgattccccctcgagggggagccacgtggcgcctggggcagccttctccctctagtctcggccagggagtggccgccgccctacctcgggcccgacccctctcgggggagggccacgtggcattggagggcagcctcctacatctagtctctgggaaggagtggccgccgtcctacctcgggcctgactcccctcggcggaggaccacgtggcatcggggggcagcctccaccgactagtctttggggaaggaggggccaccaccccacctcgggcctaactcccctcgggggaggggcacgtggcatcggggggcagcctcctccctctaaacatgatagccccgggcccatatcaccgacagtagcccccggcgttagccctgaccaaaaccttccccaggtggtcagggtgacgccactttcctagtctgatgataggtgggcccgatctcttattctttctttgctggtactaggacccatgcgcctttttcgccccaacctaagggcgactcgctagcccataccttaggctgtgaaattattttatgtatatattcagcaaacgttgttagattctctcgggcccgtgaccttacgccgcgtacctcacttgcccctgccatttgttaacctttgttcatgttctacttcatctattcaaacaattattttcgcgagtgtgaggactgaactttccatagccagcaatcttcacccgtgatcaagctaagctgggcgccatagccagccggcggggccaaagccagccgctgtggaagagctagcataggagggcccgggtgtcgacggtacccagagcttgacgcaaggctaggatagagctaggaatcgtagcccccgtactttaagcaaagaatcgtttgaatggatgaagcgaatacaaactttttgttaccaagggaggcaagccggtgcgcgacacataggtaccgcggagaccgcgaggaagagataggcgagagataaatataagcaataataattttatgcaaacgattatcttcgcgcgagtgtgaggactgaactttctatagccagcaattttcgcctgcgatcaagcgaagctgagcgttgtaaccagccgatggggccaaagccagccgctacggaagagctagcacagggggccccgggcgtcgacggtacccagagctcgacacagggctaggatagagctaggaatcgtagcatccacacttacagcaaagaattgcttgtatgaatgaagcaaacacaaacctttagctcgaagagggccccccaccatgggttccgaaccatcttgggaagcctgtgaccacttagcaaacgaggttaggttcccacgagcctgtgtccccacactacacattctgtttgctctttcctttcggtggcctccttccaatctcttttccttctacatgcacgattactttcgcatgagtgtgagagccgaaaactctagagccagcaatccccgtccacagttgagccaggccgggtaccgtagccagccggcgggaccaaagccagccgctacggaagagccaacacactgggtcccgggcgtcgacggcacccggggctcaacttaaggctaggataaggctagaaaacttagcccccacacttagtgaagaatcgttcatgtagatgggggagaggttgggctcttaccaccgagggagcaaacaaatgcgcaacacgcgggcgtcgcagggccatgagaatagaatggggggaaagaaatataagatttcaagctaatgaattgaaaaattgaaaatacttgaagcttgaaaggacgatcagttgagccgggccgggcatcgtagccagccgacgggaccaaagtcagccgctacagaagagctagcacagggggtcccgggcttcgacggcacccggagctcaaaactgcaagagtcctcccaggagtgaaccgaggcagcagcaggttcatgggccaaccccgcgcttggcccctaagggccatgggaatgacgttcgccatgacccggtcgccaccacccgccacctctatgatcgccgtgcagatctggagggactcggaggggtcggcgccatcgtcgtacttctcggtgaggcagggctggagctttgggggccctcggacattctgaagactcgccacaaagaccaggtagccaagattacctggtggggatgtggggggccttgccccctgcctggggtggcacgacactcctgaggatgttgcgccttccccagtagcggcggcgcgacactcaccacaccggcgctcgaaagaacctcaaaaatcacgaacgcgccccctacctggcgcgccagatatcggagaatgaattcctcaaccagggaaccgtgaggcccccctttgtgagttcggccgggggcagcgggtgagattcgagggcttggtgagcagagctgtgtgatcttgagggggttagccccccccccaagacgatgagacaaaaaaggtttatacaggttcgagccgctgagaagcgtaataccctactcctgtgcatgattgattgaatgtagaacacaagtgcttggggttgggagacccaagcgccagttcgccccgaagtctcccctccaccactaggcctggacctccttttataccttaaggggttaccatatgggcccaacaacctaacctagctctggtggagaagtattgtaatctttgcattaaatgcatgtcttgtctcttgacttgggaagccaagcaaacgtcgtcttgatgatggggcctgtcaaatcttgccgcctgacacggggggtgcccctgtcagtcaccatttaatgggtgaagacttctgggctcctattataccgggaaacgggagccttgcttttactagagcgggaggcctgactccggctgagataagaggatgagaacctctcaccatcactatttgatgggacatgtcaggctgcacgccgcctgacacacgagcagcgcacaggcgcactagccagtcccatcggtcattcgaccggtcacagaacggttgagtgcactgcacgccgcattaaatacggcgtggcgcgatcgctcgggatgccataaatgcggtaggtgggcacctggaggcggacgcctaacccaccgtacgtggtgacctagagagggggtcgggggagcctgacccctagtcacgggagggggcggccgccgcccgacctcgggcccgatccccctcggggaggagccacgtggcgcctggggcggcattctccctctagtctcggccagggagtggccgccgccctacctcgggcccgacccccctcggggaagggccacgtagcattggagggcagcatcctccatccagtctctgggaaggagtggccgcggtcctaccttgggcctgactcccctcaagggagggccacgtggtatcgggaggcagcctcctacctctaaacctgatacccccgggcccatatcaccgacaatatatatatatatatatatatatatatatatatatatatatatatatatatatatatatatatatatatagacacgggataggaatgaaagaacttcttactctctccgccaacccaaaaggaaagaaaagaacagaacagccggaggaattggtcaactcatcatgctcatgacctgaagactgcaggtttgaatcgggctgatggctagtctaaagacattgaccatctggagcgaaggacaattggcgaagttagttagagaaagcttgaaagataggattttctcgtgtggtaactcgtgaaatgccgagttggtacgaattctgggaaatccttccttttactctctcttttgaatgagtcgtggtgcgcgtgaacaaagcaaccctattaataggagggctagctcgggggcaaatctctagtattggtaccgggggccggtgtctagggataggagccgtcaaagggctagtcatcgctagaaaatccgaaacaaggctatcgctagctttattggggaatttctaatcttagtaggagctttccaaagaaatggaaaagtaaggaattttctcgagattgttttcgcttaaccaaagaaagaaagagaagaaggaaccatttttactaataaaatactataaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgccttcgttcaatatctatagtattctcggatatgatagattcatcgcttgttcgcacagtcttattgaagaatttggaatgaaaagaagagtaatgcttcctagggtcttggcttatacctttgcttctcttctctagggatctatacttggatatgcaactttaggtagtcagacagtcaccctcgtatcggctggatatatatagatcagtggtcgtaactggttatgcttaaggaactgtaacaacaaaaaaaggttcttcgtttttcaactggctctaatgcaaatttaaaaaataaagaagagttccgtcaggcgtactgaatctcaagacgttcctcaaaccaatcatatactttattgagataggtaactaacccgaaccccagaagtcatgggtgataattggtctgatgcttcgggcgaagccaattcccagggtgtgacgggcggtgtgtgatcatacgtctataatgcattgtatgtcctagaatagggcccttttggcgttccttcgtagatctacggatttcacccctacacacgaaattccactctcctctgtctcactcaagtgaattggtttcgagagcattccgccactttttggtgactttcactttcaacccgattcacccccaagacgatgttggcgcagaagcaataaaagtatgatctcgttgtcgctttcatcaacccggaacgatagtgtaggcgagcccggatgtagagatggatgatgtgtaaccaaagaagcagtgcccaaaatgcctctagaaagatcagacagaagtaagacgagctgtaattgtacgtacatgtaaaggagcttagtatggagttgcctggattagatcctcgttggtccttgaagaagaaggcggaagacttaaacccttcatttcctaatttttggttcggctctcctaaagaattgacttcctagagccacatgtttcgtcgtggtgctgatcgcgtggtttgcctcttcgtccaattttagaatactttttgattttttagtcccttatcaacatttcatcaatatctccatcttccttgtcaagttccctaaccccctttatagcttcacgctgtttgaatagttccaattaatggaatcaaagtcattacacgagtgagtttagcaagtggaatatctgactttgaaggagctgctgcgaggtgtatggtttgagtacaattaattcatttttttatgtatatgtatatatatgtatatatgtatatatatatatgtgtgtgtgtgtatatatatatagacatatatatatatatatagaagaagatcagagtcaatactagaaaaatcatttttctagacgatgacatttttttctaggcaggtagggctctcagagctaaatgaccacttgcgaaaattacaaccgtggggtgaaatcgttatccgcctgcaaaaatctattttcgcaggcgaaccacttaagcgatccgcctgcaaaaattccatttatttttgcaagtggacctcttaagtggtccgcctgcgaaaattggcgtggcatataaatagatgcgacatcaataatattttttctaagtcctatcctctcttctcccccagctctcctctctccctcagccctcagctctcctctccctaagctccctcagcgaccgtgggcgttctggggggcggcgacggcaaggcgcggggccggtgggcaacggcgagcgcgaggtcagcgatggcgaggcatgggtgggcgacggcgatgcaccggggctacggcatccaccctcggcgcggctccccttccctcccttctagatgtggccaaagagggaggggagggcggtggtggctgcggttccactacctcccagatccggccggagggaagggggagggcggcggcggcggttcccctccctccccaggtctggccagaagaaggggggagggcggcggcggttccccttcctcccaggtccggctggagggagggggagggcggtggcgagcggctccacttcctctccctctccctcccaaaaccctaacctagatcggccggaggtgggtaggggcttgggtgggattaggcccataagtttgtatacccaagcactatatatatttcactaattatccttgccaactcttatctaacttgtggctaaggattacatagtcagataaattgtgacatgtgacaccttagttgtaaaagtttggtaaattaaaacaagctttcgaacagcccattcttcaacaaaaatatttcgtagaggcatttaattattagccctgcagaatatcgaaaactacaatttcaatacaatggaaagtacatttgtagtttgctttgttttatatttttacattaatcttgatgtattgttattattttaaaaagaaaatcataatctcataacagtttacaacaagtaaaccttgtttttccacttctaggttagaacattattcgcttcaccataagaaaagaaacatacaagtgtgagttgtttgtattgattcggtgttaaataaatgattgatagataagaaaaatattagccacttgacaagtagactcccccttagaatatttaattaactagatatgttaaatattattttatatttaactgtccaagctcgaataattcgtagtaccataaagctatccctcattatggtagcaacgcaagagtgctgaggtcaccttgatgacgtttaagaaaaacagagagatcacccagcttgatgacgcagcgaaattatcctgtttctatattgaaatctaacaagaatcagaaaataaaaaaatattggagcggttaccatatgatcagcaatttgtcgagttggaatagcatttacctaaaccactaataaagcatatacatatgggttgtagaaattcaaagatatgttttaactctctctttttttatgtgggcatatatgccaaagatgatatgttggcaagagacattattgaaacctaattattaatgacctgtttaggacttcagttagcttccccaatgtttttttttttttttgaaatgcacatggcattctcttcatctggaagctagactggaacattttgagctgtgccttttggtttcaacatatgggcaacattcccatgccacacatccataaagaacatcaatctggttaaagagatttgataaacaagacagggatttgggatatttggtagtactagcattgtacgcagtggcgttttgggccaattggaagactaaaaaatacagtgcatggttttaaagtcatgcgtatgtgatttataatcatgtaaaaatattgtttatatgtgttgtttactattggattattttggttttaatttgtctttctacagaaattggagaggcagggaagttaaagacatgctgttggaagacaagtggcaggctgacagcagaagtttcaaagaatcggagaatattaaggacggcgggatgggcgctcgctcgctgcgtccacgtcggattttgctacagtagctacagtgcgcgcggggtggaaattatgcgaaaaagccctccgatttttcgtaataatgtataggtccctagcgtcctgtgtttgaagaggaataatcgcggacaggggcttttttgtgatatgtgaaagaagaggggcttttccgcaaaacagcatccactaacgcataccccccacagccctagctgccgcctctccctctcccaccacccctcccgcgccgccgccgcctgcgcctaccctcgcgccgccgccgccgcctcccactccccctcaccccgtccacgtcgccgagcgccaccgccgcctccactcccgccgctgcgcctaccctcgcgccgccgcctccgccccccctccccctcgtcccatccacgtccccgagcgccgcctccgccccctcgcgccgccacctccactcccgccgccgccactgccgccgcagagtgccgccgccgctctccttgtcccgcgccgccaccgagtgcctgccatctcaccctctccctcttcttctcccaccgccgccaccgccgccgccgtcaccgagtgcagccgtctccacctccaccaccgccatcgccgtcgccgagcgccatcgctgccgctccctgctatccctttctcaccccgcctgcctccggtccccctgcttaccccgcctacctccccaatgatgtggcggcggcggtggcgacgacgacgacggtcgatggggtcatttcctccccacagaggtgggggtccaagctggctgcggcaaatttagtttgttcacgctgttcagaaacggtggttgcgtttcatgtgtacgggctgcgttgattggtgcatgtgaaggcacgtgtctttgagtgtgtccgtggcagcttgggcggtgcatccgtggtaaagaaggaaggggacggcatggcattttctggatgcactcgcatttcctcttcgtcgttggccgcgccattccgtgcgatttttgctccgatatcagcggctccattgttttgcccccctgatttggtattgaatcgatgctctttctatctcagtgccaaatctgtatgcctggtgtgatttcttcctccttatacattttctccctggtaatggatggccagttaattggtgttggatgtttgcttgctgttcttcctcgcttgtctctgcatatcatagcatggtacaaatcgttcagggtgcctgctcacaccactcaagatgctctgattgggccattgtggtgtatgccagtcgagtctcgtcgctgcgggagggtcccaccagtgcggccagtgtcaggtgcactcaccaccactcgtcgttcgagggcgggacagagaactcgagcatgcctagtcaatggcagccggtcatcggggctgcgaggtgattggtggcgtctgtgcgtgttctggcgagtagtcggtcccacggctttagccaatcatgctccactgttgttcgggccccacgtagtcgtggtccatgccaattgcagttggccgttgtagcaggctccgccgatgtgccctttttccggcgcagtgttactgctcggtgtgttacgtcggagagctcgaggatggcctccgtcagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcgccatttcctttgcattgccttttggtgcccgttcgctgttcttcttgtcgtctgttctagcccattctccgctgttgtgctttcttcgttcgatcatgaaccctggggggtgaacgcgtgtgctggtgggttttctgtatctagcctagctgccttcctttgtgtctgtgccgtgtgtttcctttttatcctgtgattaggcttggtgcatctcaggtagccatgtactggcctgtttgttgcacgagacttactgtcacagagtttttaggttttaggcgattttccccgtgttcatatttcccttttcacagtggatcattgcttatctctgttgttcttcttttagtaaatacttctttcagtaaatagatggtggctattacatagatgaagcacacggtcgttagttaatgacaaatatcattgctttttttttcctggttctgattcattattggatcatgtttcgccactcagagtgtgtcccgtggtgttttcttttcgtgcagaaccatgtggttcatttgcatttttgagtctttccttaagtgcatctctgtacgtttacatgtttttttttgtcccttcacatcgattttttttggcgcaggtgcttattgtcgcggtcaggtccgtgcgatacgttcgttgctgttgtgctgctgttccctttaccatcagctcctgttcaggtgagctttgtttctttgctatttctttggggcagacatcctttttgttttgtagtttatttgtgccttgtggtttggtgtatgttctttcttttatctgatatccagcttaaattacattcttattccctgcaggttgcggaccgcatctcctgtgcccgtacatgtcggctaaggtataacaattggcctttgttgcttcagctatctatacattattcgagctgcgctgttccttgtgggttatatgttctatatgtgtgcacgacatttctgtttttctatgcgtttagttcctatatggaagggggtcgtgtggttaggcctgctcgttgacgggatcgccgattgctagagcgtagcagcgcttctcttagatgtatggtttgttgcggtttgttttttttagatgctttagattttatatcttttcctgggtggaaagattaaatcgtctgttgcttgtttagcatcttcctctaattcagctgccagcgaatatgtttgggagactgttgctccaccccatcagggtatgtgatttactgatctgtgtgcgactgttgttgtggcttgtttatatttatgtagtcgttgctcatatatttttctcgctttagtagacgatggatttttccctatctaccctgcatggtattcttcaaaaagacggcaaatgtgttcaaaaaaattggccatgaaacgattggaggctacaggtttttccattggatctttggttttctgcatatgttcttgctgacatggcttacatggatgttatatctccttccctataggcaaaaaaccttgccgtattgctcctgtctcttgcaacaagtttgacagtgattatgccaagtttttaagaggttgctttcatctctgattcgtttccattcccttgtttgcaatgccagcacgcttggtttaaacataaatttctttttttgaatgcttgcatagagacttcaaaggataggtgcgattatggccctcctgagtatcgctgccgtatgtgcgctgctcagttctggtaccaggaacagtgcaagaaagattctgctattaccaagcgccgtgtctgttacaacctttgttgcaaaggcgggaaaatttttgtccctccatttgcgcagccaccagaacctttgaattcacttcttaaatttgatggagatgctcgaagtaaacattttttgcaacacatacgtcagtacaattcgctgttttctttcacttcgatgggtgcagatattgacgatagtttaaaccagggtggtggtccttatgtctttaaaataaatggccaggtctatcaccgtataggttcgctcttgcctaatgaagataatccaccaaaatttgctcagctgtatatttatgatactcaaaatgaggtccaaaacagaatgcttgctgttcttggtgaagagaatggtagctgtgatctagatcctgagatagctgctgaattgctagacatgctagacaattgtaatcctttggttaagcagtttaggctcacgagagatcggctggctgaacacggtgatgaacaattagcaattaagattgtaggcgctgatgaggaagggcctgttcagccgatgaactagctgggttaattgtaagtgatttttcattggaaaatgcaaaacgtgatataattgtgcagagcattcctggtccactccatcatgtatctagcttgcatcctgcttacatggccttacaatacccactgttattcccatatggtgaacgtggttttcagcttggtataaatttgaggggggttgatttaaatcgcactgatatacgtactaaggcttccatgcaagaacattattgttactgttgccactatcgtcgagaccagttcaacccatatttatgttgcggtcgtttgtcctcccaaagtcaagttgatggttttgtgtgttttgaggagggtagattgacatttatagatgaacaccagggcgattttagatgcgaacacgttcaaggcattgcagatgcagtcgccaaaggttgtttagacggtaatagtgttggtaagcgacgaattctccctgcaagtttcactggcgggagaagatatatgtaccaaaattatcaggatgcggctgctatttgtcgtgtgtatggtgcccctgatgtgtttaccacttttacttgtaatccgaaatggcctgagattgaagaagcattgcgcattgagccagggcagcgttcgacagattgttctgacattgtttgtagagtttttaaaatgaaacttgatgagatggtttctgatattatggctggtgttccatttggtcgtgtgcgtgctggttagtgctctttttttgcccttaacttagctgtgctctttatggtctattgttttattgatttttatttggttgttttgcctatgatatgtttgtagttctttatagcgtggaatttcagaagaggggccttccccacgtgcatatactggtgtagcgtgatgcaccaagcactgacgccacaccatttgttgtggatacatacatcagcgctgaacttcctgatcctaatgaaaatgagcttgattacttacttgttgaggaatttatgatgcatggtccttgtggtgatgccaatagaaagtgtgcttgcatgaaaaatggggtttgttctaaaaagtatccaaaagattttgcttccgagacaactgtagatgataaaggtttcattgtttatagacggcgtgacaatggtagatttgcatataaaaacaatgtgaaacttgataatcgttcagttgttccgtacaatatagcgctgctgcgtaagtttgaggctcatatcaatgttgagtggtgcaacaaatctaaaatgatcaaatatctttttaaatatgtcacaaaagggtctgatcatgccaacataaagtttaccaaagtgagaaaaaggaagttagggcgtgttgcagttgacgatagtggtacaccaagctctagcaaaaagatgcgtggtgctgatttcactgttaagccgccaagggatgagatagctgagtttattgcgtgtcgatatttatgtgataagcaatctatgtggagattatatgcatatgatattcattttagaaacccttctgttgaacgtttagcatgccatttaccgaacatgaacgtggtctcttttagattagacacaaatttagcatctatggtttcaaatacatttttacaaaaaacaacattgactgagtggtttgtcgctaatgatctgttcccgcaaggccgtcacctaacatactgcaaatatcctacgatgtttacttgggaagatgatttaaaaagttggaaaataaggcagcacggctataagattggtaggatgtattacatccatccttctgcggccgaagcatattttatgaggatgttgatcatgtacgtaaaaagggcactagaagttatgaggatattagaacatatgacggc

SEQ ID NO: 72581 - DNA, 52746 bp, Oryza sativa
cgggcccaaaagtgcccgattgatatatggtcgcacagacatgttagatgggtataaaacttaagcccgtcacggatgacacctatcagtgacgggccacaactttaggcccgtttgaggtatggaatgttatctcaatcgggcctaaagttgtggcccgtcactgataggtgtcatccgtgacgggcttaagttttatacccatctaacatgtctgtgcgaccatatctcaatcgggcacttttcggcccgattgagatgacttccttatgacggcccgctatttctaagcatattagagcccgttacagatagaaggatctgtactagtgatcattggtgggccccacaaaaaccgagccgagccgagtccgcacaagaccgcaagtcgtcgttcttatccatccactcggctacatctctctctccttgtctctttcttctcctcttctcctccactcggctccatcttctcctcttctctttcttctctctctccttatcccgggcggcgccatggtgggaggggacgtgcggcgacactcggtggcgtgaggtggcgctacggtgggagggaggtggcccgctcccctcggcggcaggaggcggcgtgcagcggcgggaggaaggcaacctgcgcagccgagtccctcggcagcgggaggcagtcggacagaggtggcccgcgccaaatctgaaggtgcggctcggcgaagacagccggtgtggaggtggggccgtcggcaggaggtgcgacggcgtcggtggcctaaccagagtgctttcatcaagggccgctcccttcatgacaacttccgctatgtccagcttgcggcaagggcgctccacgccaaatgcgttccccgacttcttctcaaggtggatatcgcgaaggcctttgacatggtcagctggcctttcttgcttgaggtgctagcccagcttggcttcagtcaacgttggcgtgattgggtctccctcattctcagtgcctcctcttcccgggtgctggtcaatggggtgccaggtatcggagaggtcttcgccaaggagatcctctttcccccatgcttttcattctagtcatggatgtgctcaatgcgatgctccgcaaagcctctgactcgagtagttttcttcccctcaatgattgtgctattcgacatcgtgcatccctctacgccgatgatctagttctcttcctttcccccgttcggtaggaccttgagttcatccaaggcatcctctctatcttcagtgccgcttccgggcttcagaccaacttcaccaaatgcttgattactccgatccactgctcggttcttgacctagagctggttcagtcctcttttccttgctcgatctctgagtttccctgcacctacctcggcattccactatcagttcgcaagctgccaaaagcggccctgcaaccacttgtggataaagcctcccatcggctccccccccctcgaagggtcgtctcaccactctggcgggtcgctcggttctggtccaatcggttgtctcttctattctggtacatctttctatggcgatcggcttgccaggctgggttatcaaagccattgacaagaagcgtcaccccttcttgtggacaggtacggactcggccaatgggggacaatgccgagtgtcctggacgaaggtttgccatcctaggtatctcagtggtatgggcattccggacctcaggatagctggctttgccttgagagttcgctggctctggcttcagcgctcaggacaccccaactggtctgatctgaaggcctctgttgagcggagcgtctccgacatgttcgcagcatctaccttcactaccttgggagatggtcagtccacgctcttctggactgacgatggattgatggtcggtcgctagcttctatagctcctgacctcctccatgtcgtgcctccacgtttccggggatcgcgcacggttgctactgggttagcgaacaactcctgggttggtgatatacgcggtgccctcactgtcccggtcatctctcagttcctgttagtttgggacgcggtgcttcctacccagctctcgccgggtgttgaggatcgcctcgtctggtgttggacgggtgaccagtgctactcagtgcgattggcgtaccaggcgttcttccttggctagcactcttttgcctgtgccgacctgctctagcacgcgaagggccctgctaaatgcaagttcttcctatggtttgcatttcagcagcgctgctggactaccgatcttctccagaagcgtggtatcgatagccactctgcttaccccttttgcgcttaggagcttgagagggtgaaccacatcctcattaattgcatgttcgctcggtaggtctggctccgtgtgatgtcccctcctggctgggttgccctctctccccctcgtggcagctggctccaggattggtggtcatcctccagggcccatttacctgagcacctccgtatcggctttgactacttggtactcctaatctcttggcagctgtggaaggaatgaaactccagggtttttgactctgcgctcgcttcggtcccagtgattttggagtccatccgctcggagggccagctgtggtctttagctggcattgctgtttttggggatttcttgggagtgtagtgtggctctgccccctcctgttgtttggagtttcgttttaaccatcgtagtagttcctagcttcaggttttttattaagccaatctggctgattccgttgtgtaacaaaaactcttttcctgctaatattgacgtgcaatccttttacgcgttcgcgaaaaaaatcgatacatattaaaattgaaagtcacttaatatttaataatttataattacataattattgattcagtaaaaaatttaattgagattcaaaagaagattaaaactttgcatttatatcaatattggattgagaaaaattttatgaggaaaaataaaattaatagtacgcaccaagtgcgaagatgcatttcctaattaaaggtccatgttagtcatacgatgttaattattaagtttaattgcaagaattaataaattatgaaatcatcgagactccaagattacttgctagtttcaaattttatactctagcttcgattttttctaggcaaacgtttttttaggtttaaccaagtttattgcaacatttagcaatttctacgacactaaattagttttattaaatataacattgaatatattttgataatatgtttgttttctgattaaaatattgctatatttttctataaacttgaccaaacttaaaaaagtttaactagaaaatagtcaatgcgacttataatataaaatggagggagtacttagtaaatccagaaaaactataagtgcgatttcaaaccatgttgctttttttttatttattctaaattttagtattatataataagaaaacatataaagttcaactccacaatatgtacaactttgtaaatacaaattttgaattagtaaatttactaaatagaagcaacaacaaaattatttgaatggttttgtgtatgttgtttcattaataatttaaatttagagctgtttcagatatatgcaaatcacgtaatatgagattacccgtggttatccataggttaactagtccccgtataaaaacagttactcaagttagaagaatatttacctaaaccactaacagcatgtacctattggatgctttgaaaaggtcgttttaaattttatttacttgtgggcatatattcaaaggcgctaatggtgattacacgtataaatcaaattattaggaccctgtgtaatcttcctcggggagctggcttctccgaaaaaagagtgaacatttagaggtccaacaaatagaacctaattcagcaactaaacaagagaaaaactggaatgttacatttgagattgttctgaattattaaattgggttttaagttttcaattgttgaatagtttcatattagttatgaaagggtaaaagacctagtatagcttgtcacctcattggtgaactttaggggttgagaaaggtcatttaggatcatacatcgaatttgtgggatttttcatgaattatcctacagttgactgggattttcttgattttgtattggctcagaaaatttcatgaagttagacgaagtacaagttccaggaactgattcaggggacttttaaaattttcaggcttatgttatagtagtatattgctgcacgtattgacacaatgatacattagaaaaggatttcttctgcagctacctccttggttgagccgttgaggcacttatcatgaccttcaagtccatggtctatttccaaggttgtcagtatcccgatacgtataccagtatactagacactacgatccaccaaatcaaaatgatattatctcatctattatcctaattttcatagtatctcaatcttactaattgttttcgcacgttcctacgaaatcttaggtagtatcctaattctactatccctacgatcctacaaaatattatttaaaaataggtggattgaaaataatatgaataaatatgctcaagtttacattaaaaaccaattaaatttatcaaaatcaatattatatgctttaatttatacaacatattatatattttatataaaaatatgtattttctaaaatctaatagtatctcgatactgattatcttgtatatttttggccattgcccatatgtcttttggtattaaaaaaatgtctaagaaaaccgtaatctaatttttttgaattgaaagggtagttacttacttgacattgttttcctcttttcttccacctatatattgtcgattgctctctattgaattgaattatcaaattgaaaacgagtagcacttagtataacgtaagagggttaattaactagtgaaaataaacagcagcaggtcatgataaatttatttttcattagtcgtgagctcgattggggttgggtgggggggggtgaccgtccacacgatttttcattaagaataagtcatgacatcttttttgcccagaatcaagactggtgctaacttgaaactctgagtccaagtttatgtttcaggtaacctcaaactcataatccaagtttcatgggtaaggttaacttggaaattagtttatggctgtgtttatatccaaagtttggatccaaacttcagtcattttccatcgcatcaacctgtcatacacacccaacttttcagtcacatcatctccaatataaaccaaaatccaaactttgcgctgactaaacccagcctatgaccattgcccaatatgagggtaactgacgaaaatgaacagcagcaggccagtcatggtaacttttttcactagggtatacagtatggttcaactgagttttcataattgtcagagtctcaaaaataattgctctgttgaatcctggagtaggtcttaatatttactggtacatgttacaccaaccagtggtcaatagggatggaggcttgagtctggggcaaaagagttgtcatgaaaggccctcataatcagttatgacttttcgaatttgctgtcaaaatttagttatgtgttgaaaatttcagctgttaattctttcaattattgtccgcccgcactccgcgcaggatcatgctttggacttgggatgtacagtatgtatgtttcaggtaacctgaaactctgaatccaagtttcaaaattgaaatgtctagccattttttgaatcattcaattgagctatctgtagacttggaccactgaagtaacaggatttcacttcagaggttccgaactgactgctgaagaacaaaaccctggaactgcatttcctacagatgtgaaactaattctacatgtattggataaccattcttgattaatctgaagtggaacaataatcctgagcatctgcatagccagattaggaatgtaaggtaatcttggatctttattcaacaggcatacactgaacactaacaaaacaaagccatcaagctttttgcttctgcaggttctagttcttcctaattcctcagctccatctacttctactctccaaaaacaaaacaaaaagaaacgaattcaaacagcctatccttctcctcctcttccccccattcatttacacagctcaccacctaccatcacaaattcacaacaaactcgcatcaaattctccaccacaaacacatgtaagatcatcaaacaagcccaagaaggcacaaacatttttcttatgttttctgttcagagttatatggtggtttcaatcgaatggcgacttggccttggatgatgagttgtagatcatggcggatgagccggagaagctgctgctgctcggcggcgtgctcgacgacgtcgacgtggcggcggcggcggcgcgaggcggcgaggcggcggcggcgccggacttgaggaggaggtcgacgttggcgtagtcgtcgcggtcgaggcggatctcgttgagcatggcggcgacgtccttcatggcggggcggtcgtcgggggaaggggcgacgcagaggagggcgacgcccatgacctgcagcatctcgtcgacctcggcgtcggagcggccgcgcagcgccgggtcgagcacgtcggcggcgcccttccggcggcggacccagtcgacgacgtgctggccgtcggggatggtggggtcgatgggctgcttcccggtgagcacctccagcaccaccaccccgtagctgtacacgtcgcttttctccgttatcttcatcatgtacccgtactctgcaatgtttgttaatcagaaggtgaaagattgaagtaacttttgtgacatagtattgaaagccactgaactatatgattctgttcaacatttgtgcttaagatgggtggtttgtcctttttggttgcgtgaattttaagcggagtgggctcaattggttgtaccatcttgatgtaattgaataagtttcgataaagcttccattatcttaaagaaaaaacttacctggggcgatgtagccatatgatccggcgacggtgttggacgagcggccaaagtcgccgtcgtcgacgagcttggcgaggccgaagtcggcgatgtaggcctcgaagtcgagcccgatgaggatgttgttggccttgatgtcgcggtgcacgatcggcggcacgcagtcgtggtgcaggtacgcgagcccctgcgccgcaccgagcacgatcctgtacctcacatcccactccagctgcgcgccgccgccgccatggccgccatggcggcgctcgtggagcacagcacccaggctaccgttcgccatgtagtcgtacatgagcagccgtgtcgtcttgttccagcagcagccgaggaacctcacgatgttcttgtgccggatgcaccccagcgtcctcacctccgccgagaacgagtcgcggacgcgcccgccgccggcgacgtcgtccttgtcggcgccgttgcgggtgcttggccagagcttcttgacggcgatgacctcgccggtgtcgaggccgacgcggtacaccacgccggagcagcccttgccgatgatgttggcgtcgacgaggttgcgcaccacctgctcgacgctgaagctcagcttctggaacggcgtgaactgccacggccacgccaggtcgccgccggactccgagtcgctgctcccgccgccgtgcccgcccttcccgccgacgatgcccatcccgcgcgcccgtaggatcccgaccatgcccagcaccatcgccaccgtcgccgtcaccagcagcgcgatggcgagcttgagccggtgcatccgctgcacctcctcctcgtcggcgctcatcaccggcctcccgctggcgtcgatgctgacgaagcacacgtcgccgcccttggtgcagagcccggagttgccggcgaggcacgacgtcgacagctgccggaacagcttcgtgtccgggaggtagccggtgaagttgttgttggacacgttgagcgtgacgaggttgtcgaggccggcgagcggcgcgaggccgccgtcgagcgcgttgtacgacaggtcgagcaccgagagcttgctcagcgccgagatcctcgccgggatcggcccggtgagcccgttccggctgaggttgagcgcgatgtcgaggccatcaatggcgcagagttcgtcggggatgcggccggagagggcgttgtcgctgaggtcgaggagctcgaggttgcggcactttcccagcgccgccgggatggcgccggagagcgagttgccgctgaggacgaggcggctgagcgcctccagcctcccgaacgcgtcggggacgccgccggtgagctggttgtgtgacacgtcgatctcctgcaggccgcggacgccggcgagcgactccggcagcgcgccggtgagcgtgttgttgctgaggtcgagcatctggagctgcgagcagttgccgagctcggcggggacgccgccggcgaggcggttgctgccgaggtcgaggaagttgatgctcctcatcccggccaccgccgccgggatcgtcccggcgagccggtttcctcctagccgcagccgcacgaggctcgccgccttgccgatctccggcgggatgacgccggagaggtcgttggagaggaggagcagcttggtgaggttgcggagcaagaagatcccggggggaatggcgccggtgaggtggttgtgcgagaggtcgagcgcctggaggttggcgaggccggcgagcgacgccgggatggagccctcgagctggttctgccacgcgaacaccacctgcagcgcggcgaggcggccgagctccggcgggatgaggccggagatggcgttggtgtcgagctggagctggacgagcgacgtcgcgttcgccagcgccggcgggatggtccccgtgaggttgttgtcgctgagcatgaggtcctgcagcgccgggaggcggccgagcgacgccgggatggcgccggagatggcgttgatggagaggtcgagggagacgagggaggtgaggttgccgaaggtgtccgggatgggccccgtcagcgagttctgccatagcagcagcttctgcagccgcggcagcgcgcccagcgacggcgggagcgggccggagagcgagttctcgtagaggtagacgttggtgaggttgccgcagccggcgagctccgccgggatggagccggacagcatcgtcgtgtagatggacagcgtctgcaagctctggagccgccccagcgacgccgggagcgcgccggagatcttggtgtcggcgaggccgagcacgacgaggttggagagcctcgagaacgactccgggatctcgccgccgaggtcacggttgccgccggcgcgcagcgactcgagcagccgcagctcgccgagcgacgccgggagctcgccggagaggcggttgtcgaagagcaggaggtccctgagcgacgcggcgaggttgccgagcgacgccgggattgggcccgagagctggttggagttgagcgccagcgacgccatggccgtcgcgttcccgagcgaggccgggatggggccggagagcgagttgccgctgaggtcgagcacggcgaggcggcggcacaggtggaggtcgtcggggacgccgccggtgaggttggcgtcggagacgacgagcgacgcgagcgacgggagcgcggcgcagatgccgggggggagcggcgcggcgaggtgcaccgactggaacgtgacggaggtgacgctccccgtggcggcatcgcagccgacgtgcgaccacttgcacggcgacgacgccgacggcgaccagtccggcggccgcgccgccgtggtgttgagccattgcgtcaggaaggcgacctccgatgaagccgaggcggcggtggaggaggagaaggagaggaggtggagtaagaggagaaggaagtgcatggggcttggcaacaatggtggcaatggcagctgcatcaaaaatcgtgctgtgcttgcttggggcagtgcacaatacactatgctaaccaagcttgcttggttcaagagaggtgatgatctctatgaacttcactctcactcttcactcactcaccatggttcaagagtgaaaacaaacaccttgtttctctctctctctctctctctctctctctctagctactctctctctcttttcctcctcaaaacactcaacaggttgagctgtttgcttgtgtcttggtgcttggttgcttgctccagatggatagtggtggtggtggtgtcatggtgaaatgtgggtgcttgcttcaatgcattgggcttctccccaacacaatttaacaaagttttgcttcttctctctctattcaattggtgatgtgtgtgtagagagagagagagacaagggggtgcattggggggagggaagaagggagaagaaaattgggtgtggcactgacaatgggagcttagctactctagtctctagtgtgcagctgccctttggctatgatcaagtatttctattgtcaaattgcaaacaatttgcaatgctacactcatgtggagcatgtacaccatgcttttggtctcaatcgcaccaatcttgatgtgtatcttggctttgtaaatctatggttgagattaaaatcttgacttagttgtcaactacttaacttaatttgtgcggctgcgtcttctcccataatcagaagctctcacaaacagtacatcttttggtccagattttgagaagctgtagttctagaatccagaaaatgaactaaagccagaaactggaaaacccagcttttccagatcctcagaagctggctatcaaccaactacttctcagaattttaagttccaccaaacaggccgtaagacatgtttgattggcaactacaggttgctacctttttatcaatagaaattatcaaacttacctaaggttatgtgcttaaaatcttggtcatatcgtagatagaattttgcctctctttttagttattattaccacgtgcgatctaatttgttgaaaaggaattttaccacaattacgaatgcaaccaaacagttagtatctgtatttatcaaacttgtctaactctagatatggtaaattgtgctaagctgtggctggcaactaaacatgtcctaattgtgtgctctaataaatgttatttgtggctttctgtggtactggtgttggttgatgggggtgatcttcatggctttagaaagcaagcggcttgtggggaagccagtcggtgttgtgtcccctgcacaagtcgattgaatgttgacaatttaattttgcttgcttcatcagtgagggcaaaagcagcattaaatcccatgaaatgcgcggcaaaaaggtagggtttgtttccgaaaattaacacccaaaataattataggcaatgttcgaccgtacaaaggctaatgtatactatttttttggccaaatagtcttgaagtcaagtcaagggagtatgtacataggttggtcaggattgtatgtattcagagggggacaaaacgttaaaatgcagtttgaaaagtaagactgcaggtttgaagtttgtatattcagactgctatgatcaaatgtctaattgaaaatgtgtaaagagatcacataattgacctaattaatctcctatcatctttagtttggtcgaaaaaaacatgaaaagacttactattttgttaaaaaaaacattaaggaatcctctcaaatggaggattggcacgagatttcaattcccaatggattctttttcatgtaggctcctttgattcaagggaaggatttgaaaatcttcataggattgcatttattatcaatttcataggaaaataagccacattaagacttttcttcagttcaatctttcttggaacaaaatgtttcaacaagcttcgcaagcaaaccaatggcttctttgacttgcacctgccgggattgcaggctagacaatagacctgattgatcaacttgtcggggtctggagtgccattcaggctctacacctggtagagcacgaggaggacaatataacatggaagcttactaaccacggcgaatacacgacatcaacggcatataacgcacaactccttggaaccaccgctaccaacttcaacaggctaaactggaaagcctgggcgctgcgtaagtgcaagacctttgcctggctaatcatccaaaatagagtctggacttctgacaggctagcgacaagagattgactaaacggttccatctgccccttacgtcgccggacccatggaacagccctgcacctcctcgcggaatgtagatacacaagaagagtctgggcggaactagcggagtgggcagcgtgcgagcgactacaatctagccaatggcggcaaacttcgatggtgctagattggtgggaggctaccgtaaatatacaagagacacctaagaaggcactccgcactttggtgttgttggtcgcctgggagatatggaacaaaaggaattgcataaccttccaacagaaggagatttcagctacctccctgttagccaagatcaagaaagaggctaaaacttgggccttagcaggagcgaaaagtcttaataattggctttcttttagttagctcggatggaaggtcctcagcttcttttttttcctttcgttttgtaaagttttccttctctgttcaatgaaagtggcactagtcaatttgttaaaaaaaaaggtttctctttccgtttcgtgtgttttcgattctatacgattgaaaaaacatgctactttatttttttcccaactgtttttcctattgagcatttcaaaaggggcctaagagcctggctattctgaataacgcatgcttgcttgattgtcgcaagtaaacatagtagaatcccattttgtagtactccaattaacagagtgttaactaggccggagcctctagctagttaattaattagctaaatggtaaatttccagcatagagatgtcaagatgctgtatgggttattccaacattggatcacgtgtatatcacgcgcacagcaggcagctgcagattaaaattacagtaagccaacaaaaattagtacaccattgtttaagattgatgcagggaaattagagtactaatagctttttacagtgccaattaaccgtgtgccaaccttgaggtttacattccggttaactactagagcactcactgaatggtgggcctcatcatttacattaatctctcataggacccacatgtcagcgagtaattaccagtggctttgcttgtttaattagtaaagaaaatcatatagattcgcgctagtgttgagttggatgatgaggagcgacccgcacacgacatggggcatctctccacagtgacagccttcattgcgtgcagccactagttattagttaattaattaattaacgtgataagtaaacagagttagtggtagaaattaagaagcatcactctaattaagctggtcagggctagctggttaaaatgaggcaagcatttttctattactttccacattcacaattcagtccctctaatttatctgcatctatatgtacttcacctgcactacataattggagctgctataattctagagaagaacaagaagatcaaatctatcttgtttcaatcgattccaattgttaaattgtcaattcaaatcatggtttcaattaatcctatgtgcattgtatgaacaaatcctcatatatacatctattagtagattacaagtagtatcatgtttggacttgcaaagaaatcttgagtaatccaggatgttctgctaaacacatacatgcatatttaacaatgtgatcaaactgtcataaagtaaaagaaaaattaatgttaaaatcagaatgaaggtggtgtaagtgtgacttctgagaggtgtttaatactttaacaactttaccacgttggctgatgatatcttattcctaaccgagtactactactctctagcctctactcttaattaaccgagtacttgaattaacagtgttcatacaagctagagtctaaaccccagctctcgttgtctaatctacacaaattaaatattaattagcagctagctagtctcggcttagggcaagtactataatagatgtaattgttacctccaaatttatttatggcattcaccaataaattaagatgcaagatatacaataggtcacccctaatacacaaatatcaatgcctttagtactctcacatctttcttggagcttgtgtggaggctacctcttgatttaggggtggttcatcatctctctccttacttctctcctccacctcatcacccaatcctatgtgtcatttttaggggcagcacatgaaccattatagcacttgcccttagatggctcaatggtaagcttggtcttgggctttgagcttgtggctacctatttaaattggcaccatgttagggtgcagctaccagtcaattgtaacctagaaaggcatctcaaagtgtttttgattcatttgaatgttgggtttcttttgaggtatggtgtcaagcagaaggcattggtatgcatcaaaggattaggatgacttgtggtggggttaattctcctcctcactgtccccaaaatatagggcccatcactgttaagaataatagagatgaagtaaggaataacctagtttgatgttccatttctttttgtaaggataaatgtatctaatatgtttgatcgatgttccattaattgtagagtatgttgatcgaggtactagaatataaaggacatcatgtaaggttttacaaattaaatgagcatcctcaatcacgatggcaaggttgtcattcatcaaacaatttatatatctcaatataaacttttgtatgagagtgcatcaaagaagaaaagaaccatctttaagaatgtgtacgaaaagaaactactaatatggagtgaggacaaagagacttatctatctattaaattaatttaatttggtcagcagaactttgtgaaaggaaatattgcaatggtaagaaaatttgaaaataattagtggatagggaagtaagtaaataaaggatatgccggattcacaaaacataaatcatatagaatatcataaaagcatataaatttggatcgttgattctttagtactcttttggatgatgattcttattgcatccgttgtgcatcttacaacgaattatcaagtccatacgtgcatgtgaactctctatcttgttggcgcatgaattgtctatccccaatggtttttgcgaaccctggtcgtcacagttttaaattagttacacactcttaacggtttgtgtttccacaaacatatgtatagtaatgaaaacagcaaacaagacccagagttgtatggcgaaaatccagaaatggccaaaattggtggcaacaatgaccccaaaaaactaatttttcctctaaagtccaatcaatgactcctggtacaagtaataggaaacaagccagctggccaacttcatgtcaaactgtcaatataggtttaggccaaagttgagcgtggttgtttcaaaaaaaaaaaggaaaaatagtttagtgtggttggttgtattgtcacttgattggctatgggtcaaagctagttcctggttttggggagttaaagagcaagtccacattggaaagtttgggatggggacccatttgacggccagatgatctcctggatagcgacaagacaatgcatggtgtggtgtctcttcatatggttctgcactcgtgtgcatttaagacattatgattgggttgaaatagctgtgtaccttagagaaaacctttctgttttcttaactttttcagataactattaaatgtaaaaattgtctaaacttattttggaaataaatcttttgaccacatccctttgaatatgcaggcacctaaacctctctatattccatacagttctactccatccgtcctaaaataacttcactctttatcaactagtttgacccaaataacctcatcctttaagcaattatcgcattagaaatttgtgaaagtgagcaataaatgcattacgatttataaaagtgacagacaattgcatattgaagtttgttagagtaaagggcattctaggttttattttttttacctttgtattggtatgtgtaggatgtgtgttaaaattaaagttattttgggacaagtacactgttacaacactatgatgtgctgaaaggttcaaatctagacctaatatctatgtgaggatttatatttttcatatatatttttttaaaaaaaatgaaaattcaataaatatgtttatgttgacgaaaacatgcccaatcttataaaaattcaattatggtcatagtttcgtccaaaacttgtggctatggttcatgtttgcaaagctttgcatcgatgctgtggaagtgtggagagatgagcatgttcatggtttcaagtttcaacaggccataaggtcaaaatgtcaaatatagtacaacgatgtacatttaaaataatcactaacatgttttttaattatggttaaggtatcaaagctatatgcaaatataatcactcggtatatatgacgagcacaaaacttatcacccaactacttctataaaagtgcattttagtactaatgctaacactgtatatatgaaccatagccacaaacatgcaaatataagacactaaatgcaaaatattataaataatggttacaaagaccatcaaatgttgcaaatatacgaagttttctgcaacggacgcaatgtttcatcatttcctacgtcctcagcatttttattctaattaatgaagcacataagaagttccaaacttcaagaactgatctaaacttgcagcagaaagaatcatgatcggttgtgggtaacacaaggagggatgtgaagacatgctccatgtagaaattaaactgttaaaaccccaagaactggatcatgcagtgcatgtggatgcaggaaaaagtacaaaccgatcgagctgtaaaaattctcttaccggatgtcactaaattactagcttgctctgcagccctgcaggcacaaagctagcaggtttagtggtaaaaacaagaattctagatcccaatgcaatggctgtttgtttaggctcaagtcgtttctcagatttaatttacttaattaccacaagataggtgtaatagacatctgtattttttttactgcctgaattatttagtactacacactagtagtatttagtttacacagaacatggtgggtagagactaatatatgaagtatgatatgattcactcttagctgtagtttacttgggtaattacatgcatctatagaacaaaggcactactcctatgttttagaggtaaatggagatggaagaaagtaactagagatgcccatgaacttgtgctggtaaaaaaaagagtagtagaaaacttaaagaacgccctaaaaagcatctcagcatgcagtgaccatgctgtataatcaccagccacactgcacaccatccatcccggtcagctgctgctgcttttgaagcgagtttaaaggttaaaacactggcctctctccagacggattaactatacacgcatcccaaggttaattaggacgtcacatgctgttagattccatctcacaccgcttaacccacttaagtttatcttaccattccatctccatctctttttcaacgtgtattatgtactatacaaagctacaagcaagtagctaggctcgtagccacgtggaaccgccgccaaaagatccaaatttctttgtgcctattagcaaaacattagtatgcatgattatattaatttctgaattgggcataggtcttaattttgttttgtaggctgggtgatactgatgttcatgatagatgtaaaatctgtttagttttatccttttcaattaaaagttctaattcctgggatgtacaccaactagagctgtacacggacattacacgtaaaactaaaacctgtatttctagcatggcggtcaataattacagttaagggcaaagagtgcctaaaccagtggatgtatatattacatatatgctcctttgataaaggtaccatcaatctcattggtagaatggagtagaaatcacctagtattgtttagatggctgtctacactgtgatttcaattatctgagaatttaaatgatgtggtgactggatttcatataaacagtggtttccactgtaaagttacccctactatcttaccctggaagcgctggtattttacggatatttctagctgttatctaaagaactcgtgtaacaggataagaactttactggaagtactagaacaaaccatagagaaaactgccgttcgctgcagaagataaaaggctcggtaaatagcgtactagtacaagatagaccgcttagtgcaaagagaaattattcttcgtatatttacaaacaggaatttaggaaaccaggatacatactgccaagaaagccctacttgtaatcttgtatgcatctccatcactgatcaagtagccagctgttaagcaagtccagtgttagtcggatcagatgtcctagaaatacatatagtaaacatttcagtgcattttttttatgctagtactacgagcagaagtctagctacaatgagattccagtaaacctaggaaaccaagaaatttgatatagggatgactgaacagaagggtgaaactgcaaattgtcaacaaacctgaatatggcttcaaaagtccacctgagtctatgacccatccatttccacgaccacaggagcaaactgcattcagatgaaaagaatgttttcactctgagtgcagcaaagaaatgctatcactcgatcatgaatcgtgatccaaatttacctcatcatcttcatcaattagattcaccgtattgttgtcaagatcccatccaaatgtggtctccagaagtgattttagttttcgagtctgaatatatggaggtaaacattagaaacatcttttgatattattccaacattacacaataataaagctgaaataaattttctacagaaataatgaggctggctgctcaatggattgaatttgcagcatactttgtctgcaacgtactctagttatgaataaaataaaaaaacatttttctctgatattactctcctctgttcatataaacggcaaccacagaccaatcattcaagtgcacgaaaatataactccctcaaaataactggtcaaaggtccataatttgtggttttgtggatattaaaccaggaatttgaagtaaccaaaatactagtccagctagggtattttcagagaaagtatgaagttctaaactcagtctaaatgtggtaattcaagcatgggctacagaattgcttatgtggtatgtgtaaatgtgagagagaaggtataggaatgcccacccatgacagaaggtcaccatcaacaactgtagcttcaagtatcaccgcaaagaaatcctgacaatagcagaacaagctattcagcttctagctgtgcttctaagcaaactgtttcttactccataattcaaatatgcgataagaaatcatgcttggtcatgattaaatataatgattccaaaataaatcatgaagtcaaatgaactgaacaatatattcacacattttccagatatgcaaattcacctctaccttgatgagtttactattattataggtgtttaatagtcctcgagtttaaaaatgtacgaatgttagggtcctctgcattacgagtcccaaatggacgatcaaacttaagttagcaatgaataggcacactgcgctgctgcttactgtcttcacaacaataaaaaacagtaaacatgtaactaattgaatccaggatatgtctgctaactatacacagtgaagctaaaatcgttttacttcaggtccaagcagtgcattcattgcaattgctaaggacccatttaaatgcaattatggagtaatcaatataagggtgaaatacagtttcaaatgaaaagagcagtgatagaggagagatgaggttttactaactgttgggacatatctggtaggagctaactaaaatacgaaaaatgactcgatcagtagccagtgttggacagtggtgacttgttgtggttgtttcaagatgtacaatctgatctagagatcaatattaccattacttgatttttcgtatttgacacaattaaaaattatataatgttttttcttagtcatacaactagttttaggaaatatttaccttaaacagtaagcatatatcttgtaaccaagaagattttgtagggttatcaacaaaagatggtaataagtaccttagaaagacgatagagaaatatgtctcttgaaaaccatgcttcatctaagaacagagaattccccatttcctcaccacttctattatcctgtgtgtgctgaaagccatgcttgagttgatagtaaattgccctaataaactgaagcagcacaaaatgacaaggaaatggttgattagtcattatcatttcagaccatctttgccctgataaattcagtaaaacgtgcccatatatgaacagtagaataagggcaaatgatacctttacaaacaagttagtccttgtatgaagaggctgtcaaaaggaggaaaaattaaaaaaaaaaacttataagttcatgaatatacttgtgccatcatttcttatgacttatgaggtatgatttaactcggacagtggtatgtgcattataaatttgtagtagtactatatagtgcaataaatcctcaagaaggtaattataaactgtcatgtcagtgcatccgttcgcttcattgttccacactcccagcctcaagacaccaagtaaattcagtttgttaacattgacggaaagcattcatgtcttgaagcatgtgctcagcttcatcaagatgtaccctaagatgacagttttaaccaacagaatctggttactacagataatgatgagttgttgaaacttttagacagcatattcatggaatttggttgaaccaatgcttacagaagcacggtagcttcttcatcaaaatgtgtcctgagcagtttaatcaacctattacatgtctcacttcaaaaaagaaatggaacctctagccatctgggtacaagcgaagctctatttttgcagaatgcagatgcaagcagccaccaaaaaaatgctcaatgacactattttgtgcactctgatttttctgttttgatagaaattagttagcatgtttaaataaagagtagcactattgagtaggcagtacaccatcgatgaagcaaaacatgtacattctatccatcaatttgtgaagatgcagtaaaagtgctgcttaatattaacagaaagttgagataaattagtacttacagcttcactacagctcaaaagaagactaactaatgctttccattgcataaaagcctccagtgactgccccatctaaataactcaaaaatgttaagagaattatgatttattgaatgtctttaaagaagttggtttttttcagtagtaccataaatgctatgaaagcaaactgcagctctcccaagagtaaatcctcttggccttggtaattcttggccaaaacactctccagcaagcatgtctgagaagtataatagcttcatcagcaaataataatacaatttttcgatttggtgcaatttacatgaggcatgtgtgaaaggaatcaatccaagcaatccaccattagtagaaattactatgcctaatgtagaaactagagcatgagagcatatctaacatgaagcccagaatattactttgtccagatttaatgcagttagctcatccccagagatgttactatgcttaattgaagcagggatagttgtatagtagcatcctctccgctcagactgcacaggagcattctttgcaaattttccatcttttagttggtccattaaacgtctctccatgtctgtttgcggagctttatccatccatgatgactcccatgcaattgtaatttctccaccaattggctctggagatatcaaatataaatcaaatatgtaataaatgtgccgacttccaaaccaatatgagaaacaagaaggaatcttgcataccaagacgttcaatgacactttgtggcaagtagcttgagagttgtttccaatctccaaatgaatccaaattatatggtccaagctgactgtcaaactcgaaatgtcttactgcttcagaatatctgatttcctaccaaaaagtaaacttcagtttcctaaacgaaaaaccaactgggcatatctgttatgtgtatttttgtcaagtcatagtgaattttgcagaagcacaagtctgtggaatatgtacaagttaggggtattagacaaatttaattttacctgattcatgtaatgtacactgtttctcactaacaacagtggcaatccatagaaaaacaagttcaaacttcaaacataggttgagtgcattttgtctagtcctttttttagggaattgtctagtctaatttccactgtcatttatggtgcaagtatgagagagctgcaattccaattttaagcaatgtatcttatacctcattataaactgatttagttattcacaagttgccatgtctgtcttcataatgtacaatcacaatacaattgatacttggcatactttacagtttaacagcgcatgaaggaaatatgaaaattacaggatttaaaagaacttgaagctactataccaacattcagcaaaatgcactcttttatcttctgaaatagtggcttttcaagacacttccatctcagttcagtgcaatgtagcctttataagaactagaaagggacaggtgcttctatgctccacatactttaatttgcaccggtttcaaagcaatattaacattgcacgcatcggaggatcacttggatcctagtactggaagtggatcaattggttgaaatataatgctttttgtttcaaatggtccattagcaacatataaaagcagatttcctggttttcagttagcagccaaacagaatgcctagcaattgaaggatcaagacattcatcaaaggaaacaaagcaatggaggaccaatcaatagtccgtatgtctacactgataaccattacaaaagttactagaaaaatataaagtgatataatagattaaagacaattctatcaatcagatatgtcacctcctcttctggtagttttattaatctctcctcctgtgcatgccacttccgaacaatcacctggaaatagcatacagaaaatggtactgtaaacatgcaagttactgccatcatcagaatccccccccccccaaaaaaaaaaaatcaaactttgacttccttcaaaattttaagtacagttgagaatattaatcgtcattcactgtgacaacaatcacaacattcattttcatctcttgcttcagtacatcttacaagtgagttcttctttgttggcttttcttctgttcattctatagaccaaattagattttttttcttttagccaggcatacatatctatatatatacaatacatgcaagtttatccattatttgaaaatgagtggttagatccacgcattcatgtaactacacttcagcaaatcatatcaacagtatcttatttgctaagatgaaaataaaaaagagaataacatacggtagtaatgcaactgtagtaaaaataaatacaatactactttatttagcaggacagggttctacattttgaattcaccgccctatctgattttccgtggctagcactgataaaagaaatattagctattcacagaataataaatgtagtggatatgttgatggttcatccttccaacccccattttcagtaaaactgacatgttcacatacaacagagtagcacaaaacaaaacccaggatgcagaattcagcattaaccctagaatggataatatctggtgccatattatctctgcgggcaatttaaacttgatttggggcatcatgaaagagtacctcagatgggtgagtagtaagaaagaatccgacagtaggtgcgaactcatttgcgtgcctgaaaggatcacagattgtggaagaataatcaatatgtggcttctcatgtaagttgttttggccataactgaaagacacagaccatgcaggcgaaatggaacagaatgcgtaaaacaggcacaagtggtttcatcatcttaacatggttttctgaatgccataactccagatcaagtaatcaaacgtgctgctactgatatatatcaagaccggtttacaaatgttaatcaagatcggtaccagtgatttcaagtcgtctagtcgggactagtcgtaagggcaccgactagtcgactaatcgcgattagtcgcaactagtcatagattagtcggtgactataggctagggatatgcaggataatgtacagatgtttataagtattaattaccatagtatactagtatagtatagtacaaactaaggataatcagattttcacagttgacagttcacacttgacataaggtcttaaagttaaatcatttacctgtcctagttgcaataagtccttcatcttttctcccctctctctcgtgactagatctagatggctggttagggttagatgaggggtacaggccttcttgggctgggcaaaaggcctgccactgaagtgtaaagtccaacacatatttttagccctaacagactagtcatccacgactaatttgatcgactctcatgactagtcgtgattagtcggacgataagttttctggtcaaactaatcgcttcaaagttcatgatcgaggtcagggtagcgataaggataactaatcatgattagtcgcgactaatcggacgacttgaaaacactgatcagtacacaaactgttgtgacccaaagaagcactaggtagttaattacgcttcgctaagattgtcttgtcaaaatggaaggtagaatcgagctatccgatccaattgatgatgctacactagtacactagcaaggttcttttaataatttttttaaaaaaaaatcaaccttacatgcatatcactcagcacttgctggctaaacaactctgcacaagttgactgacggtgtgataaatctaagaaatagagaaatgggatgacgcaatgcaacctgttgggggagcagtagtagaggaaatgcggccccggaggcaccatcttgatccccttgaacttgggcccgacggagaacacctgaaccgaatcgaatcaaaagcagcagcacgcaagaattagcctagcgaggagaaaaggtggggtttagggtttagggaaaccaacctgggtgtcgacgccgaggagggtgcgctggggcacgtcgaggaggaggagcgtggcgcccttccgcaccagctccgtcgccgcctccgggtccaccgccgccgccgcgccgccgccgctcgacatggtgccgcccagaagagaatgaaggacccagaaaagaaaaatcgaaacgaaacctggtcgggcgggtggatcttctgcggctggactcaactcgtgtactcaagcgccgattagttgccgtgtattggtccgttaacttgtgagagagcatctaatgcactcacctcccccttaaataagcaggcaggtttaaaaaagtcacacaatattgatcaatttgcttcttcaaataaaagagtacttcaaaatcatggtgttgttggaggagatggaggaggaagatggccttcagattcttcctcatcagtaggagggcatcggttggaacaaatgggagagagcaatccagaagagatgtgaaggattcataaatggcgatgcagagagaggagacacagcaacgagctcacgtagaagtgagggaggaagaggcaatggagacgaatcaagagctagaagcagagcttctcgccgggataggggaggtgaggttcaagctagagctcaagcggctgattcagggagatgctatctctctaagtatggctcttcctttgcaaattctcatctggcaactaatagaaatgtactccctggtggcgttagggtactagcagtgctatggaagaaaatgacaagctcttttatcaagaagtggatgatcgagctcaatcagaaggaagcaagtctcagtttctccacagagtcaagtcgcacctgactttaggtatggcttatttggctggggctcaagctgctaggaattatggttctcctgctacgatcgggggatgttgttctgtttctgggcatgatgtggctagcgttcctcgaggaaaacttttgcaaactcagcctcaagatcagcttcttgcacatggggattacttgggattggagaaaggtcggctcacttctcaagggcagttggcgccagcccacaaggtgccacaggcaccatgactttcttgagctggaactgccgaggtatgggaggacacctcggcaggaggaagatgcagtacctccgtagtttgatcagctccactctcgctcaggtaatatttatttctgaaacaaaaaatgattctttcacttcctctgatctcactgatgcttttcatgtagataatagctatatagttcctgttgtccatgcttctggtggtttgtggcttttgtggaataatgaagtggacctcactgcgatgagtagttgtgccaattatatagtagctgtaggtgtttcatatccctagtggcacgatgtttaatcttttgtatatatatggtgatcctactcatcttagttctagcagaatttggcaggaggttagtacttttgttaatcaaagtagccatcgtgccaccatctgtatgggacacttgaatgatattatgaaccttgggagaaatatggtaatgctccccctaattttaatcgcatctctatgttttataatcatttgagacatgttggtttgatggatatgggttaaatatattattaacaccagaataacggattgatgattttatcaatgagggtaataacgtcataatcatggaacggggttgtgatacttagcctgagacggtcaatatcggtgtgagaggaggaatgcttcacgcaagtagagacttcggtgacgtgattctcatatgagggtatcactgcgactaacaaataagagtaatatgagggtatcatttttacttggtgttaatttgtacattaatccttaaaacagctaactttctggcattgagggagtagttaagttggtattttgacttttgtggtttataagccaatagcttaaaacccacaaggtcaagagtagtttcctaactccacttcacataataagccaagaaaagcaactcaaatctagctttcagtccattaatgtagtagtaacctatagctttagaagggaaaaaaagcctttagagcaagttttatgtagaggtggatactacatctaattttagccgtgttatctactcttcactacacatacccttataataagggttaattggatccatgccactgcaaatatgtcaattcggaaaaatgccactactattcgcgatatcggctacgtgccactggaatttggcgaaattggaaccatgccattccatcgcattttccgttaaaaatccatgttagaatccaactgcgcatgggacccacctccctcccctctctttccccttcctctctctcacccgcatcaccagctgccgacatccatggcggagaagcacgccggccgctgatttcctcgacgacggcggcgagagaagcgcatctaccggtggggactatgaaggggagggcttgccggcatccaagttgcagcagtggtggtggcgtcgtcgtcgtcagcctgctactgctgctgctgccgccgttcagatccacagcagccacctgcggcgcgtcagatctaggcgtcaccgccgccgcaagccgctcgagctcacttgagatatccgagttgaagctcgagtagtcactgaaatcccgcaagagctcgagcatctccgtggtcgcggcattggcggatgacgacttggccaccgccgccgggcagccgacggccacggtgcaccggtaatacgcacgcgggcaagggtttcccttcgccatcttctacccatacttcctccattggcacccatcgctgatctgctcatcaccatatcgacatctcaacacaaacatccatgcgaagaagaagaagaacactagctgcatatggaacatgatcgagcacacacaccatgggtgcatcggagcgagctcgaacggagacacgggccttccgcatggagtgccccgtgcggcattgcggcacaggtgggtgcagaacgtggggtgcacggaggacgcgacggcgttcgtgaccctcgctgccgccatcggccggctactgctgctgctgctactgctgttgccggccacctgctgctggtattcgtcggccatgctcgccgaagagagatggggaaggaaggagagaggggatggaggaagaggatggagctgacatgtgggtcccaatcccacactgaagtgtgacggcgatggatgaaaaatgtgacggcggtggcatggatctaattttacaaagttgtaatggcacctagcagatttcgtgaatagtagtggaattatcctaatatgacaaaattacagtggcatggatccaattaacccataattttatattgttggttcactttcacactattacactttctctttacacttttcttggagattgcatagatattgcccgttgtatgagaggtggctcgtcctctctcccttctcacttctctactccaccatcacctaatcccatgtaacacttctagaggaagcacttaaagccttatagtaattgctcttaggtcttgagtcatctttgtttgggcttattggtgtagtatttgcagtccctggtgtattgcttggccatcgtaaataagtatcatttagtgggaatagtgagtactacaaaacctatcatttaatgaaaatagcaagtgctatctctacatgtaaataagtaacattttaaatagcgatacagtcaccaaaacgctatatatttgtaatcagagggagtgtatctctataaaacaatctcctgtatacaacatgaagtcataaaaatatgtgatgttttatataacaacaatatcaccaaaatattagttcttatcattttgtagtacacaaccaatgagaaatgtaggatatatattattggtgttatgaataaggcatatataatacttttgtgttagactcggcgaggcatcatatactaaatcttatacggaattaagcctcatatatagaaggtgttccgggtaaggactactcggataatatccgtacttgactccctaattctacttagataaggggacacccgaggcgaagagagacggagacaagtcaagacagatctagataatctaagacaagcctagacgaactagatacagagctacagaggtcgacaagagggatctaggatgacctccaatctcgccaagttcatattcgagcaagcataaagtagattagatcatcctaaatattgtactttctcgccccttctatatataagcaacaccgacttcagctaataaggagtaagggtattacttgtcagtttaggggctggacctctataaaaatccatatctcccttctcttttacatcaatctcacgtatatcttagcaccaatgatcggggggaccctaatgggcatgtgatcgctgtgggcgatcaccccccatccctcttacacgctcctctcccccttcctcctccacttcttctcttactactacaccataaattttaaaaaataaaaaaacaaagttagaaaaaaaattaaaatagaaaaaaaatctaatactcttattttatgtgcatagactctgtacttatgtacagactttataccgtaaacttcgcatgtacaaactttatgtatagaaaatactatatataaaaaatatttgaattcaaattcaaatttgaatcgggtatataaacttttgattataaattttgtgtctatgaactttaggtgcataaactttatatatgtatagaaataatatatataaaaaaacatatttgaattcaaattcaaatttgaatcaggcatataaacttttaacttataaactttgggtctctaaactttaggtgtataaactttagatgcgtacaaactttaggtgtataaatttactaaaatagaaaagtaatacggtgaaaaaaaagaaaaccaagtgcatgtttggtacaactccaactcctaaatttagttccaggagttgggtctgaagtggagttgtagagctgcctaaacccagctccacaactctagttcattttgtgagagctccacccagctacactcccatttttggtggagctgaaactgtttggctgagctccagctccaggaagggtggagttggagctggagctgtgccaagcaggcccctcgtgaggagaggcgatcgatcgatcgcccgcccattaagaatttcgccaatgatccccacactctatcaatgccataggcgcttatatcttaccatactaattcccctttttttcagtccaaatgccgccacctcacagttggggattggaattcggaatttggaaaggagaggggaaagtgaaaagaaaaatttaaaaaaagagtaaatttcactttgggtcaccttttattaccagtatttcactttgggttacccttcaactaacgttttcacattagactgggtaatcttacatttgtttcactttggaccaccccgattctcttctcaagcatatgaacgacctcgagtacgccagctcctatttgtcaataaacctccttagctgtatttagaccgtttctttaacatatgacaaattagatgtagatgaataagagagttgagggtagtccaaagtgacacaatggtaaacatacccgatccaaattgaaaacatttgttgaagggtggtccaaagcgaaacaccggtgtcggagatatgggcccgggggtatgcaaagtgaggggaagttaccttcccatccagccacgtgactctacagtctagccctccccccacgcctcgggagacgcaggggcagccagggggcctcggggtgccatgttacgccccttaggcccccgcgttgacttgccccgaggccctcgcccgaccgccatgtggcggggggagcgagcggggaggagacccaagccaagccgctaccaatgcgcgcggtgccccaactgcccctcatcgcatttaatgcggtaagggcagacaaacggtgccgcccgactgatgcacgtcagtcgggtctgaccagtctgtgaccggcctatcgtcggtcacgtctgactggacaggcggccgtacccccacgtcgcctctgtatccggcggagtggaggtaggtatgtcctgtcacatcggagcgtcatccggagttctctccacgtaaggagagcagccacaagtctccgcccatttaagagcgagtgacagggctgtcccccatgtcaggtggggggtggcgccgggtgacactgaagggcggaccgctttttagcttccgggcgaaggcacgaatcacggtccggtcaaggtagagtgggtccccctcccgtagaaagagcaggtagaagcggtgcatgtggtatccccttgaactataaaagtaggaccttgtccaccgggaaggggaacgccactcagtaggcctgaactctagggaaagaagagcgagagtgctctccggagtttaggaacccttgtaacactcgaccataatctcacacacaagagtagggtattacgctcgatagcggcccgaacctgtataatcttgttgcccatacgcgattagcagcattcagggtggatacgcaatctcgaaaagcgagccttttcccccggccgaactcacaaaagggggatctcacgatctcccgctagagaggatcactcctcgatagctggcgtgccaggtagggggatttcgcgcgctttgaagacaagtcgttttcttctgccccaagttttcctccgccttcgacgatcatggtcgaggtattggaggaggaggtggcggtgcacacccccactagcgggagccgcggcccccgtcaccgtcgccgcaactctcagactccgccccgccgcgacccctcgcggagggaggattccacccggtcgggtggctcggcccactccccgcctccgggcggggggaagccacgtcgcgtcggggtgcgacaccgcctcacttatggcgacggcggctcgccccgaggcgcgcttcaggcggcgggtgcccttctacggcatccccccgtgaactcagggccagagacccccgtccagcgatggttagacgacgtggccaacctagtcaccactgcccagcggcagttggccgcggccggccggcccaccgctgctggtacatcgcgtacccccaccaccctctcctcgtcagcaaggaggagggcccatcggtcggccacggcctcgaggcgatccacggccccaacgtcgtcgggggcctcgggaagtcgaagacatcacgacggcctctacggggaacaggacgctcgaatcaacatcgagcgacgccgggatgagcgccgcgctgcccgcatgggagaaggcgcctcctcgtctagagtgccacgttcctcctcgcgaggcggcccgccccccacgttcaccttggagggactggttgtagggccttcgttgcgagtctccggaatgtccggtggcccccgaagtttcgccccaacctcacggagaagtatgatggcaacatcaatcactccgagttcctccagatctataccatgatcatcgtggcggcggggggatggggggggcacgaccaggtcatggcgaattatttccccatggctctcaagggtcaggcgcgcggctggctcatgacccagccccccgactgtcgcgaccgggaaaattgccttttcccgaacgctagtgtattaatccccgtcccaggaaaagccggggtacaccatacaaacatgatataaaagacacatctttattacatcgataatatttacattattacaaaggcacataaggcctgacaatcaaaaataaacagcagcggactagcgggcctacggctccatcttcacaggcgctcaactggggtataagccaggactccacctaagacatcttctccaaagcttctcttactgaagggggaaaagattgagcaagaatgagtacaaccacagtactcagcaagccacaccggcggatgcataattaatgcaagggaggtacaagggaataataatataggggttaagttttgcagtaaacggcatttaaaagtcacttagttgccccaaagccattttataaagacgatcctagagctacacagtattattaatcaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataatcaagagtaccgacccaatcctcctacggccgggacacccgggacaggcaggcaggactgagccccctagcagcagggcaccaaccctctgccatatgacatctcgactaccgggccgcagctcgtgtagccttcatttgccctggagaatgtccatcgacccccgacttcatccatctccaatccgtgtacttttgtttatgactagattgagccacaaactaagccttacccactagacatgtggaagtacggtagtgctttgcaacagaggcccgagcttaatccttatagtggccggggtgctacttcccacaactggcatgcacccaaaccccaccgaaaataggttttaggggttttgaaagaggaagagaggtgtatgtccaattccaccataaaccaacaattcatagtgtccaggtgatatgaatattcccaaagtctaaaattataaaaccacctaatgttgtcctattaatcggcgaagcatctacctaaattcatactagtggaaccataaatagagtgtccactagttggggttttgtttattctagggtgaacaaggtaataataacaataacaataatagtatggtcctaacaaaggtaaataggcatggctaaataaaacagtgataacgcgggaatttaaataaagcgataatgcattaatttaaatcaaattaattttataaactgggattcaatatgctcaaggatgatgtgacttgccttgctcgctttcccaaacgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaatttttaattaaaaatcccatttattgcgtcagccgagggagcggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgctggcgcggccgacgggagcggcgcgcacccgcgctccgatggtcgccgccggcgaccaacggcgcggcggagtggcacccgagagagaggagggaagggggaaaacgaacggcggtcttcggctcaccccgggacaacgacgacgacgagagcggcggccggagcggaggaagacggcggcgcggttcgggatgacgatgacgacggtgctccggcggtcggcgggcgaagcggagcggcggacggggtcggcaaccactcggcgaagcggacggaggtgtcgccgagtaaggaggaagtccggagcggcgacggcggcggaacggagctcggcggcgatggcggagagagcggagcacggcgcgagcacgattccgacggcgagagcgagcggcgagcggcggaaacggaagagcggagctcggggaacgtttttatagcgtcgggagggagagagggcggccgggcgaagggggaaacggccgcgaaagatgcggccgccattgatgccggcgaggtttaggggaaagattccgagcgaatccgagggagagagagcgggaaaagtggggggaaatggcgagggaatcacggggagtaattccccccacttcaatgcgcgcggggacggcgggatgcggcggatttggcggcggcggcggcgctagggcacgggcgggcggcggctgcggcgcgaggagggagatgacaggtgggtcccacccgtcagcgagagtggcgggcgggcccgcctgtcagcggcgcgcgcgcgcgagggaggccgatgggccgcgggggaagagagagagagagggagggactgggccgagccggcccaagaaggaaaaaggggggggggggaaagaacttcttttaggatttttctttttataaaccttttcaactttgtttatttcttttcaattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagagaatgatttttatttcgggatgaatttatcaggacgtgacaccgactccatccactcctggaaggacctgtgccagcagttcattatgaagttccaaggcacgtacccctgcctaggagaggaggcggacctgcatgctgtgcagcggaaggctgatgagtccctccgctcgtatatacatcgtttttgccaggtccgcaacactatttcgtgcattccggcccacgcagtcgtttatgcgtttcggaacggcgtgcggcacaaccgcatgctagagaagatcgcctccaaggagcccaagaccaccgccgagctcttcgagctggcggacaaggtggttcggaaggaggaggcgtgggtctggaactcccccagcaccggcgcggcggctgcggctgcccccgaatctgttccccactctaagcggcgagataggaggggcaaaaggaagccggcccgctccgacgacgagggccacgtccttgcggccgatgggccctcacgggccccgcgcaaggagaaagccaccggcgacaagccaagctccaccgctccctctggcgagggtcggtcggcagacaagtggtgctcggtgcacaacacttatcggcacagcctcgccgactgccgctcggtcaagaacttggctgagcggttccggaaaaccgatgaggagaagcggcagagtcgacgggagggcaaagcccccgcgacccctgccaatgaccggcgaggggaggccaagaagaaggccccccagatgacagcgacaacagtgaggatctggaattccaaataccttagggaaccgtcaccactcttgataggggggcttgcgctcacacctcccgccgcggtttcaaggccatgaggtgtgagcttctggctgccgtcccaactcacgaggcggcacggaaggcgcgctggtcagagatgaaactcaccttcgaccagagcgaccatctgacagtgctcgctcagggagggaagttggccctcgtggtctcccccaccatccacaacgtcaagatgaagcgtgtcctggtcgacggagggggggggcagcctgagcatcatctcctcggctgcctttgatgcgctcaagtccccggggatgaagctccagccgtcattgccgatcatcggcatgaccccgggtcacacgtggcccctgggtcatgttgagctcacggtgacctttggcgactccaccaacttccgcaccgagcggatcgacttcgatgtggcggacctcaacctgccctacaacgcggtccagggcaggcccgcgttggtgaagttcatggccaccacccactacacctaccaccagatgaagatgccaggtcccaacggccccatcaccgtctgtggcgatgtcaaggtcgccctcgcctgcgcggagcagcgcactgataacctggcggcggccacgaagccgcaggccccggaggcctctgcgtcccgcgcttccaagaagcgcctcgcctcggccgatgaggtgcccgtcaaggagattctccttggcgatgatccgtccaagaccgccaagattggtggcaccttggacgccaaataggaaagcacgttcatctccttcctgcgggcgaactccgacgtcttcgcgtggaagccgtcggatatgcccgggatccccagggaggtgatcgagcaccgcctcaccgtgcggccgggtgcgtgacccatccggcagaaggtacggcgccaagccccggagcggcaagccttcatccgcgaggaggtgacgcggctcctggaggccggcttcatccgagaagtcatccacccggagtggctggcgaacccggtggtcgtcccgaaggccaacagcaagctccagatgtgcattgactacagagacctcaacaaggcatgccctaaggatcccttccctttaccgcgcatagatcagatagtcgactccactgcggggtgcgaccttttgtctttcttagatgcctactccgggtatcaccagatccgcatggctagggaagataaggaaaaaactactttcattactcctgtaggcaccttctgttatacaactatgccttttggcctcaagaacataggtcctacttttcagcgcatgactcgcattactttgagtaatcaaatagggcgcaatatagaggcgtatgtcgatgacttggtggtaaagacacgccaccaggacacattgttgcaggatttggccaagactttcgacagtcttaggtccacgtgcatgaaactgaaccccgaaaagtgcgtgttcggtgtgccggcgggcaaactcctcggttttcttgtctcctcccgaggcatagaagctaatcccgagaaaatacgcgtgatagagaggatgcgccccccagcaaacttagggatgtgcagtgcgtcacgagatgcatggccgccctaagtcgattcatatcgaggctgggagagagggcgttgcccctattcaagctcctcaaatgccccgagccgtttgtgtggacggtgcaagctctcaatcagttgaaagcttacctcacttctccccccatcttggtggccccggggccagagaaaccgttgctgctctacttggtcgcgacctcccacacggtgagtgccgcccttgtagttgagcgcgacgagggcgacccgcgttgtgagcccatctatgagaagggaccaggggcccccttgactggcgatggcccctcgtcgcccgacagcctggtgcccgaagcccccaacccccgggagggccccgaggcccccgtggaaggaagagagactctggcgggtggccccgaggcctatactcccgacatggcccgagatcccccgaggcccctgagcacgggcgccccgggccagctgcccctaacaacaaggaccggccccactagaaggtgcagcggcccatctacattgtcagcgaggcactccgagacgcgaaaacccgatacccacaggctcagaagatgctttacgcagtcttaatggcctcaaggaaattgcgccactacttccaagcgcatcggatttccgtcgtgacatcttaccctctcggccaaatctttcacaaccgggaggggaccggtcgggtcgtaaagtgggccattgagctcgctgagttcgacctgcactccaaaccgcggcacgcgatcaaaaaccaggttctagctgacttcatcgcggagtggaccccggtggacgaccctgttccgtctaatgttcccttcctccccggagacggaggagacccaaacgccgacattcgcgccgggtactgggttatgcacttcgacggctccctccaccttcagggcgcgggggtcggagtcacgctgacttcgccaagcggggatgtcctaaagtacgtcgttcaactcgatttccgagccatgaacaatatggcggaatacgaaggactcctagcaggattgagggcggtggccggaatgggcatccgacaataatactcttcctgagggtcgcgcaaaacctgagaagctcacgcgtatctctaagcaatacgtgctcgtagaagggaccctctaccggcgtgccgccaacgggatactcttgaagtgtatttctcgggagcaaggtgttgagctcatcgccgacgctcatcagggtgagtgtggggcctattcggcctcacgcacattggtcggtaaagccttccgacaaggtttttactggccgaccgcgttgcaagatgccccagaatgggtctggcggtgcaaggcgtgccagttccacgccaagcaaacccatcagctggcccaagccttgcaggtcatcccgctctcttggcctttcgcggtcttggggctagacatcctaggacccttcaaagcggcccaaggcgggtattagcacctgtacgtcgccatcgacaagttcaccaaatggcccgaggcttacccggtcgtcaagatcgacaagcattccgccctgaagttcatcaggggcatttcatcccggttcggggtgcccaaccgtatcattacggataacggcacctagttcaccaatgagcttttcggtgaccccaagagcaacggccaagtcgagcgagccaacaccaaaatcctcaaaggcctcaagaccaagacgtacaacgtcctaaagaagcacagggattcatggctggaggaactgcctgccgtgctgtgggcgaatcggaccactccaagtcgccccaccggggaaacgccctttttcctggtctatggtgccgaagcagtcctaccttccgagctctccctaggttcgcctcgcgtcgtgctgtacgatgaggccaaccaggatgatcttcgccgtgacgatctcgactatttagaagaatgcagaaggcgtgcaaccctgcgagcggcgctaccaccagcgccacgtcctggcccgatcactacaagtcggcgacctcgtcctatgtcgcgtgcagtcgcgcttgggactgagcaagctctcaccaatgtgggaagggccataaaaagtgttggcgttccccggccgggctccgttcgactaaccacgaggacggcacggggttgcctaacccctagaatatcgaaaacctccgccgtttctatccatagggtcgcgcgtctttcgctttcatggtgctcgggccaacccccgcacatccttcggcttgtgcgggcttggcctggggctaccactgttaaatatgttgtatcttgttccttccccagcaataaatttttctgctcaagtggaagccgttgtgtaccctttcttactccttcctatggcttgtccgggtttaaaggacgattcgcgcttactccggaccctaagtggcattgggcggcctgaaaaccgccgaaagggagcctaaacgcgggccgcgccccgggctgcggcgaaccctgggggctcggaagggccttcacacggccatccccgacccccggtcgccgtagccccggtttggccagacccgctgggcagctttctcggggcgacggcattgcccctcgccacctaggtaccacggaccgagcgtgagtttcccttttcaccagaacgagcccgaggggggtataaagggggtaagaacgacaacttaatcataagaaagttaattgaatacgttcgctttggtttttccttctctccttgccgcagacattgaaaggcggaagcaagaacgtaaaggtgcgaagggtaagctttatttgcaaacaggatggcacgatggcctaaagtttgaagcgttcaccgcgagtacataaccaaataaaagaagaaaagcggggatagtcacggagtgcccgggcccctgagtccggcgccgctgaccacctcgtcccagtcctcgccgccatcatcgccaccaccgtcctcgctcccgctctcctcgtctgaagcaagcgcgaggttgaaccgaggggccgacccgtcgaagctggagacgattacgtcggccgcctcccagacttgctcccgagccctcgcctaggtccccggggggaagtcctcgagcgcgcgccacgggaggaagtcgttgtcacgagcttgatgacttgcgaggaccagctccaccatagcctgcgccaaagctgacgacgacttcacggtttcgccgacctcctcctctagcctctccaaatccgccgccatcccatccagccggagcacgactgccggctgtgtgggcgggagtttcctgtcctggcgcacggagatgcctattcggcgccccgcgcgccccagccggtcgacggcgtcggagagttggccaggtccaatctcgttggtgaggcgaagggctgtgatctccccgacttggtcctgcaccaggcgccccaggtcggcgagagtgctttgagccgcggtgagctggctcaccaactccgcgccagcgagttgcccgcctacctctagctccttctcctgggcctccagctcggaagacctcgttgccattgcctcgcgctcagcgcgggcactttctagatgccgggcctcgtgcccggtaacggcctcctcgcgcttcgcgagttgctcacccagccagcgcgccgccaccccacggcggttctcctcggcctcgcgtacggcaagcgtggcgtcccgttcctggcatgcctcctctcgaagccgcagctcctccgcgcgatgggccaccgaagcctctacggcaagggtggtccggttgcgctcggctgcggcctcctcacggaggcgaagggaggactctgcctcggccgccgttctctcgtgggcggccaaagtggtctcgcactggtctagcatgcgcgcccgctcttctagtgcccgggtatgctcctccagtgcccgagcgtgctcctcaagctcccgggcttgctgcgcctgtttccagctgcgctcgtcctgctcgcgctggttacggtcaaggacctcaattcgtcgatggatcgtggcctcgaactcttgcgcggagcgggcacgctcgtctaagaccttgcgctcggcctcgagcgccgccgactgagcccgcagcgaggcgtcgacctccgacgcccgccgctcttgggcggcagcagcgtcgaggactccgcgggtgtcttcgactctcttcgccagatcctcggcgtgggtctcgtactgcaaacggatgtcgcccagcgcctcatccaagacgctcgaggcgatgagcgccgcctgccgctcctcctccgtctcccgcatgaccgagtccagcgtctcttcacgcgcctggatctccgccggttgggcttggcgcattttgtgccccacctccaccatgtcgtccacggcgcggcgcccctcgtcaacccgtgcgcggtccgccgcgagctgcgcccactccgcctctagggccgcccgctcgtccgccagggcttgaacttgggcattgagcccctcccagacgatggagtcggcggcggcgagcacctacaggagtggctctatgctcgcgggagtcagggaagaaaaagtcacggtccgcccccgagatgacagagtgctgctggaccccccgcgggactgggggctgctctcagccccccttccgcgcggccagccccgagggcgccccagatgcagaggggaacagttgcccccgtcacccccgcctcgggccctcgggcagactcggcctcgacctcgacctcgggttcgggcccgcccccggcctcggcctccgggtcacgccctgcctcggcccccggagcgcgttccacctcggcctccgggccgcgatcgcttcggcctccgcccccgagtggcgctcctcgtaggtcgcaccctcgggatcggccctgggggggacgccgccaccactgccatcgcccgcgaatgggtgcacctcggctgtggcagactcagagccaaacccggcatgtgtcctgtgggccccgccagggtactgcgaaggccccgtggcactgggtcggccgggcccctctcgatctggtcgctcagattttgacccctgcgagggatcggtcgccgagaccccctaggaaggaatcccactacaggaggaccccgatcacgttaagaaaaaaaacagaaagaggaaggaacaggagcccgagatggatagagagcaccgagtcggatgttggcgatcgtacctgcgagggggggcgtttgaaggtccacttcgggggctcgatgaaactcccccggcacggctccgtttgccctatcttccggagccgcttcttcttccttccagcctcggacgcggcggggcgcttgtggcccgccggcggtctgtccgccactcgctcagcgccccctccgcgcgggggagagggtggccgagattcgaacatcttccgtttccctttcggatcaccggccgaatctcccccgggcccacggctcggaccaggtgccctgaagtcgccgtccccgccggagttgccggttcggctgccgcctgcggacgcgctgctgctacccgcgccgacggcgccgccaccggcgccgccccgacgggaccgacccctgccggcgccgacggccgacatcacagccaggatactctcccggtcgcggaagctgcataaggggaggatcccgtccggagtcagcgtttgctcgacagtgtccaggcccagcacccgccggatcaccgtcttcgcgtcctcctcgcccagtcccagtgctcacccacatgggtgcgcatgggatcgttgtacctagtgtactcccacgcgccgcgagaccgctcctggagaggcgcgatgcgacgacggaagtagtcaccgaacaccatcgcccccgttaggccctggcttcgcaggcccctgaggcgatcccgcactgcgtcgtactcctcgcctagttccgaaactaccaaccacgtggcggatcgttcgggagggccggcggggagccgaagtcgtggatggtccggcagcgcggtgtagaaccaatccttcttccaatcctcccacttcttgcataggtgactctcaatgtattgccccgccgtgcccggccggggctggaagcagcatccccccaccaccgcgccttgcagcagccatgggacgaagaaggacaggaactgccgcatcgtcggccgcaccccgatgaacatctcgcacaagtgcgctaagatggccagagtcatcacgacgttgggcgcgaggtggaaggcgtgaatttcgtagaaatccaaaacctcatggaagaacctggaaaatggtgggatcaaccccaccatggcgaaggacaggaggtgcacggatcgtcggggtaccgcggccgcagccgcgactcccccaccctcacggcggcatcctccggcatgatcttgcggatgaggctaaggtgcctctccgccgtgatgcgcaatgccggaaggacggcgtcaccagcgtcttgggccatgatggccggcgggaaaacggcgaggagcttggtgtatggagcagggtggagcgagaggagcgctagggctttaggagcgagtatgcgagtatgcagttggcgagagaaaggggacgaactctccgcctccccttccttttatccacccctcgcccgcactcgcctcctcgtttcacacccctacggttgccccctcgattcctgcgcctgcggttgcctcctcaaatctcgcgcccactcatcacgttgccccgcggagcccgcgtcccgcgtttagtgcgcttgtcagcggcacactcggcgtggggcgtgcgatgctcacaggcacggttaggcgggcccgccattggtcccatcgcatgcttgacaggcgggggagtcgaggcggcgtaaatagcgattctgggcatggtctgaccaaacccccgattttcgcgccctaagtgcccccatcatcagcgtggtcagtggcggtcaaatcgccattttggctaatgtgccatcctggttgccgccggcaaccgtctggagtcctcgtcgggcccacaacctcggcacggtaagtcgtgaggcgccacgtcagactgccctcaggggaccaatgtccgacgtggtgccgggggctactgtcggagatatgggcccgggggtatgcaaagtgaggggaagttaccttcccatccagccacgtgactctacagtttggccctccccccgcgcctcgggagacgcaggggcagccagggggcctcggggtgccacatcacgcccctcgggcccccgcgctgactcgccctgaggccctcgcccaactgccatgtggcggggggagcgagcggggaggagacccaagccaagccgctatcaatgcgcgcggcgccccaactgcccctcaccgcatttaatgcggtaagggcagacatgcggtgccgcccgactgatgcacgtcagtcgggtctgaccagtctgtgaccggcctgtcgtcggtcacatctgactggacaggcggccgtgcccccacgtcgcctctgtatccggcggagtggaggtaggtatgtcctgtcacatcggagcatcatccggagttctctccccgtaaggagggcagccacaagtctccgcccatttaagagtgagtgacagggctgtcccccgtgtcaggtggggggcggcaccgggtgacactgaagggcggaccgctttttagcttccgggcgaaggcacgaatcgcggtccggtcaaggtagagtgggtccccctcccgtagaaagagtaggtagaagcggtgcatgtggtatccccttgaactataaaaggaggaccttgtccaccgggaaggggaacgccactcagtaggcctgaactctagggaaagaagagcgagagtgctctccggagttttggaacccttgtaacactcgaccataatctcacacacaggagtagggtattacgctcgatagcggcccgaacctgtataatcttatcgcccatacgcgattagcagcattcagggcggatacgcaatctcgaaaagcgagccttttccctcggccgaactcacaaaaggggatctcatgatctcccgctggagaggatcactcctcgacaaccggtaataaaaggtgacccaaagaaaaaattactctaaaaaaatgaaaaagaaaagaaaagaaaaaagaaggagaagagatcacagcagagcacgcacgtagcaacacagcaaagcaaaggcattcgatttcagagacgcatcttcgctttttgcctcggcgtcggtgctccacggcggcggcggcgggggcggcgccggagttccaccgcgcccgcctacatccgcgtgtgtgagagagagcggctacaaatggcctccgccgccgaggaggccaagggcgtggaggaaggaggaggaggagccagcgccaacggcggcgacaaccccgccaccgccaccgcctccgcctccgccgcggccgcggcctcgtcgtcttcccccgctggtgatccatccatccgtaccccccacaccccgcctgcctctctcctttcgtcttcgttcgtgtagctttgctgcgagaggcaacctagggtgttgggattggtggcggttgctttgccttccctagttcagcttcgcccccccaaatctgcggcggcttctgccatctccgctcatgtggatggctgctagttgcgagcgcaccttcgccttgttggtggacactctgatggctgcttcactgtctgtgtcacgctggttgctgggaatgctgcgtgtgagggtttggtgtgggggtttggtgctgtgttgagtgctaattttaggcgttgactccacgactagtgggtgatggcctgccttctcctagattttacctttctgaataatggttttctcaaatctcttcacaaaacgaagccgttttggagggttagattacatcgaaaccccaatgaactaaacttattgtaattttgtttacactgtcaagcaggttgtgctcttcagctctggttattacacaatattgtaggtccattgcacagtgtgaaagtatgctttactcactactcagggtaacactgctaggcttagttgtaccatgtggcttgtgagttgtgttcaataggattatgcagtggtgtttatagttgtatcattttttaaaggataatttactgcagcaaacctcaaatcatagtgcaaatatatcttttgttgatacattttaatctcactttgttcagtaagttatgatagtgtaaaataaaaggaatgttgtcatccatatttttcaaaccatcattatgtttttgtagatgacaggggcctccccagatcaagcactatgccaggtgggattaataatgttgaaataaccaatgaaactgctggtccatctaatctggaaagatcaagaacagagaggcgtcgacaaaacaatccagctgatgatcctactaaacagttatttgatgataaaatttccctaaaaaagaaggtgcggataacatagtcctgttgcctatgtcttgcctttccttcatttgcaatgcaccctgtttcatctatttacccttgtagcttccttttcttcatgcatttgacctttgaaatttggagcatgtatatgttcatataagagaagccattttgaacagtcacgtgaactgttagccttatcttctgagcgcggacaagatagctatatctgaatttgatacattttagtataatgcagcattgtgaaaaagggctaggagcctgttgcagaggtgagggctaagatagctatatctgttaaacgattatgtgtgatactgctgattaatcagaattttgatagttatgctctactaatttatttatttataactaaagtcaattaaaacatgaaaattatgacatgttataaccacttaaaaacagcacttgctaagcttgacatgttgtattttgtgcttcactgcttcatctccaaagcaaacactactacatgagatcagagattagttcactgtaattagggagtaaagtctattttacgattaaacttgagaaacattccaactgattgaaaaatagttgattattcagattattatgcagccaattcagcctttttttcacaacaattgtgtattgtgatacactgcatggtagcttcgaatagtcaggaactcagtgccagatgtactcttttgtatctggatgcttgatgttgttcaacagttttttgtgatattttacattttattgtagctcgaaatgctaaatcggatagctacagtgaaagatgatggaactgtggtggttgatgtgccaagttctctggaaacaagtacaactgatggtgtagcatatgatggctatagtgatgttactgttgaggaaccattggatggagcagacatatctgtgaggcctcctatggatattgttattcttattgtgggcacaagaggtgatgttcaccattcattgctataggcaaacgcttacaggttagatcaaaagctaccattgtttgttaatttcacattattttatctctcatcaggtgaactattttgcttctcaagcttaatgtttctaaatacatggtttctgtatgactaggattatccattacctgttttttttaggattatggacaccgtgtgagattggcaacccatgcaaactttaaggagttcgttctaacggctggtctggagtttttccctcttggcggtgatccaaaaatacttgctgaatgtatgaaaataaatccttgtattcacatagttgattttttttcagtttctacgtcacgatgattaatatatttggtatattcatatttgagcagacatggtgaagaataaaggattcttgccttctggtccttcagaaattcctattcagaggaaacagatgaaagaaattatattctctttgctacctgcgtgcaaggagcctgatcctgacactggtattcctttcaaagtggatgctatcattgctaaccctccagcatatggtcagtatatcttaccagctttggattgatttcttgcgctttgctttactttctctctaccttacaagtgtaactccaagtttgtttattatatgctcaactaagtacctactactctaaaaaacaccaatttctgacatactcatatacaaggttgtgaggatcaggatccaaggcaggattttttttttgtcctgacatgcttggagtcttagtattgcactgtgaaaattgttactgtgaaggttatatgttataagttactaatttgcatggtcgtcagaattgaaaagatcctatgcacgttaggatccaacgggatcagcgtcatcatattttatggtccagtcaagatcatatattttttaaaacgaaaagatcttaaatttttataagtttgctcatgtacaattctttcttactgcttcaatttggtttatttttctgatttgaggcatccatttcagaacaatcatttcttgattcatgccttatgatggtggtgcttttctttggtgtgcaattaataggcagactgacctagtaatatacttgggaagttgacatctttaaaagctctttctgtttcgccaatctttctggaggcatctcttttcaggatttttctgtgtttatcactttggaaccaatcatagtcatttccagctcaaatgattaggcaatgatgtgtttacaaggtgctctagtgtgaatttttttgcatgttttgtattttatggtccagtagccaattgcaattcacttctatgaaaatttataaatgtttctttgctgctgaccttaacgattattcaggacatactcatgtggcagaggcactaaaagtacctattcatatattctttaccatgccatggacgtgagtcactattgttctgcttcctctttgaagagcacatttgctgaggaatattctcatttggagatctaacttgtgctgcttgttcaggccaactagtgaattcccccatcctctttctcgtgtgaaacaagcggctggatatcgagtgagtttgcatcttacatatttattcaggaaatattttaaacttcttctcttagacacatttgttatagttgctcaatgattaaattaaccctaccggcataacccagctgtgttagctaaacctgattttgtttttggcagcaaacttagacagtttaaatgcaattgccattaggctagatatgtggttttgcttcattaacagtagaaaaaacagaatcattagtgcttatattgtggtggttagcttactctatgccttttttggtgggtagcttaattataggtttgagcccataaccatctcttaatttgaaccaaacccacagcattggcacatactacaaactaatactgtggtgtaggccattctggatcattgtaaatttcacagaaaggataaacaacacatacttgaatgatttgtctgggaatgccctttctaagcctcatgaaagaacaaaaagagatatgagtatctatggaaatatattctaagaacataagaaagaaaacactctgctgtttgctgttatacattttcgcatttatagtttaagttcaatattttcaaggtcagtagatctttaatccttgaaccttatagttgatttagaggggtatttctgatttgggacatggaagaatagaagcagcattctaagggctttagacatttcccatttttcatcaaccgcgtctaattgattaactatcatattttgtgacacttaggcttattgaaaactgcagttggttttatggcataggcctcaggaatacttctttttggagtaagcaactaagcatagcgttaatcatatgttagaaaatggcaggcaaggattgatcttcgatttcccatttcttagtcagtatgctaattgatgaactgaaagaaatactacaaaaaaggttgccgggagcttacattctcttttaatcaatacataatgatccttatactattaaatgcggcagacactgcagggaggatagctggcagtgtcagctgcttgtgatgagagaacattatatatgacgaacacttagatgagattagattttatttgttctttcttgcgttcgattactatatctggctgccttcttaagtaggtgactaacccataattaagcaaagaccttatccaactgaacaatgtgccaacagatagattaagatgcagaacacctggctgtaatttgtttggtgtccagatggctagtctgctggccatagccatgtgcacgcttgtgcatatgtgtaataataggttgtccttaacatgttcttgcccacggatgtttctgaactattcattattacatttgttaatgccagagtaaatttcagaaagtgcaactattctgtcaaaactatcttcaactttagctgggcatttcaaggaactgcaaaaagtgtaggttttattagagaaccgacattctgttagcaacatgcaatagggcctttacagattgggccaacctattggacacaaatggggatggagttgcagttttctgataaaattgtgcactaatgttgcagttttctaaaatattgagctaaagtttatcagaaaacagagattggaaggagagggagaaatcaggatgatcaggagagaagaaaaggcaaagaagaaaaaaaaaagagaaaaaaaggcttgggaccttgggttgggctgggccgggggggggggggtctacaatagttattttaaactcatgtcgaattggatacgtaccaaaattccggtggaaacatcttcaatttttataatagtagagatatttgaaatggcttgaactgttattttgtaaatggcaatcagacaataggttttgttgtgcttactttgtttgcattgttgtgcatctctgggataggatcccaactctgacaattttggcctgcctgcttgtgctcgtttgttgttagactgatttgggtggtaaactcaagtgagttactgtatgcaaaaagttagtttctggcttcattcaatgtggctggtgttcttgggagtg

SEQ ID NO: 72582 - DNA, 666 bp, Oryza sativa
agcggtgtggtgttactcttgtagaatgctcgcaggtcggctagaaatggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtgcttagcctaaatacaccaacatggccaatgtcacactcttattatccagattaccaaaatcatttcttgaattttatggcatgccagc

SEQ ID NO: 72583 - DNA, 3932 bp, Oryza sativa
gggaagaacaggacacagaacaagagctggccatcaaaaaccaagaaaacaaggctatcactgctcaatttccaatcttgcaacaccagagaaaaaggcaaagccaagcataaagatcaggtggacatgggcagcacaggagcacatcattctgaagtgtggaggaagcaaaggcagagacagacgagtccatgtagaggaggagaaggaaaggaaggccatgggaaccagggacaaagaggcatacatacatgttcttgaagcactcaaaagggagcacacaaaattcgctaaagatcaaccccagcttcgcaagaagaaaccacacaccctcatctttctcactctctctccactttggccccacaaaacctctcatccaaccacatcaattgcgagcattaaacaacacaaagagaaaggtgaaaacaaaagcaaagcaggaggaatgcaaatgcaaacctataagctcacatattaaaataagatgagaggttcagataagcttatacctgacgagagaagttcaggcctccctcctctactctactctatccctttctcctcctttggtatgcgtgtgtacaagtctacaagaacaagaaatggaagaagtctttgtgcagagagagagagagagagagagagaaagagagagagtgtgagtggtggtggcagagaaagagagagatgcaatgcaacaacggtcaaaagacttgaaagaaggagagaaatcactgggaaggaagagagagaaaagtggagcagcagcagcagcagcagccagcagatagtaactgagttgagctatgaccctacacttgtagttatttcacaataataccccactcatttacttcccttgccattttacacaaattgctctctgaacattttgttcaatgttcagtaaatttcaggcaatttatgacattttatgtctctaccgagatgaatggaatttgtgatttgtgggagaaatttcacattgaaattcagagatattttatattgggagtaggaaaaggatcagaggggctttcttgagaaatactaccagtctaccaccactaggaaggatgactgcaagacattcatgccctttggagttatcagttgaataatttatggcattcaccaatacgacaacacttacgttagagaaaagaaactgaagttatgaccgtgacaacagattttggacgtacagctcagacttcagagaaagctacaataaataatttaaaatttgttttttctacatgctttaatagcagcacgttgaatgaaaaatcattacttagaacgtactattcaataatacactattaataccattttatcaacttgataaatgaatgaattatgcacaacatgaaggtctgcatttttgtcagttcacaaaagaggagaaagacgtctttttttcctctcttttttactctgaaacttttgaacaaacttccggttagtcagttgagttcaggcttcatgcatgccgctcttgacgcatcacacttatctcatttcctggacaaatcggttgcatcaagatacacttttaaacaaaccaaaaccttttctttttttctacacgccaaaagaaaaaaaaatctgatcagagtaatctttagcaaagaaagaacaatgggaattcagatctatctatgatatctactagtatcaatcaatcaatcctgtgtgtgtggattgccactgcatgcggcacctggctaccatgcacaaggtgtgggctaccacacaaggcaagtttgtgcaaaaatgcgagctcatcgatccccagaaaaggcccagagagaatagatgctctcatctttctttcttttaaggtgttgatcaattctgatgaaagttcctcagatgcctgcactagtaggtagtggttggggttttcggtcgagtcactctaccgaatccatgtattctatcaaggactagattatttgttgattttatcttgcttttatgtgttttctaagaccaaaaacagtacgaaattcttaaggagatgccgagtgttcggcttttcaaattttaaattctatataacatatgtaaaagcacaaaaaaaagagagaagccttattcaagagaacacgtcattgcggtggtgcgttcagatgtaatgatatagattttagtatattacaacagctaccactgcacagaaaaaaaataccattatactagtcatcaataaacattattttcaaatactacaaagctagattcatacatgctttccgcttcaaaagtccttacaacagagtcaactcggcacaactattgcataggatggtagtctactaggatatgtcctagcaaaaatcctggattatcacggatacatttcctgaacttctaaaagtttgcaaaaaaaaaaaactttgtacatcagcaattttaagaaaaccttttaaaatcaccatttgaacattctaatatttaattctttcatttgagacctcgaataatcgacataagctcatcatccattagaatgttagaacacacccccatgaaattatccaaatagaaccatatatcaccggtgtgctgcatattaggtgctcagtagatatgttcataggccatagcacttgtacaaaatgaaagattatgttgaccaaatgaccatgaagaggaaggcatgcactgcaaaagcaatttgaaaaaagggtctcttgtattggatggatatgagcatgcatgggaattttcaaaaagataaagcacagtttgttagtctgcctcccccctctatcagagatgaaaaaaagcaaaagagatgaaaagattcttccacatgtccatgccccagaatttttttagaggtccttttctcacacctttatcttggcttagctgcctaggcttggtgctgttttttatcagtacagcccttacactatacttctttactgtgggaaccctttccacttggttgaataacatttattatatttagcttctcgggcattccactgtattatcacataaacgtgagcggaaaagaaacaaaaaaaatggtcatactttaaaaaatagcatgatgagaaaatgtaaaaattcagtttgaataatatttactacaatgtttagcttctcttccattccaccgtatatttgtttacttaaacaccgtgggaatgctagaaagttaggggtgccacgtcagatgttacttttgtaaaaaagcccccacagttctattaattacacattggtccccactgatatccaccgtaaaccgtcggatctcgatctagttatcacaaaggcatgagaagaagaaaaaaatacaaaaagtggtgatactttataaattctgaatctgttttgtactcaaaactgttttgtacgtaattctgaaactgaagattagcagtggttaggaggagtaatgcacataaattcagatgttaaaacaagacaaataaggtctttccataggataagtattagtcaagttggaagtttttataatccttgtgcccatctcctgctaggaagagaacaaagtgaggaagactagttgctcataggatgccactctaatctagatcctatggttgcaggcttgcagccttgcaagttactagtacttagcatttgacattatcaaaacaagacaaatgaaacaagcacaacaaggccctgttttttcaatgtctcaccagccaggggttcagaagaagacatgattggcaaacatggccattttgtcttcgtttactgatgcctcagctcccagatccacagtacaggactaaccttaaccaaatgctctactcttaggacacaccaagaatcttaacttgctcttttcatcaatacaatgtgggccaccacaatgaaaaaaaagtagaaaaaaggacagaaattatatagagagcaactacactgaacac

SEQ ID NO: 72584 - DNA, 671 bp, Oryza sativa
cctgcaccccaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatatgatagctttcataggtcgtaacatgagctagtcgatttattacccaaggttgacaaaggacagatatcaagtaaatatggcacaagcaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatctgatagctttcataggtcatagactgccctcacagaccaacacatgtcttttctgcacactttgtcctcactcgtgtgcacccgggaagaataattcttcccggtcggtcacccatcccaaattgcaccaggccaagcacgcttaaccctggagttctttggagattggctttcggaaaagaagttgcaacttgttgatataagtattctattaatcctattaaaccctaggccgggatgttacaccctcacccccttaagagagatcgacgccc

SEQ ID NO: 72585 - DNA, 3728 bp, Oryza sativa
agtatgattaagaatgtcagccttttttgctgcatctgtttatgtttctgtttaattatgtttgtacgatttaatagcatgctgatgggaaaaaaaaagtaactctttcgaattcaacttgtgttgtgttacataactgaagaatttgttgtgttacataactgaagaatttgttgcaaacatgttcttgttgagtttatctgtatgcagtcccccccccccctctctcttgtaaatagtagattgctttacattcatttacaggaacagaacacctccagttgtgcatacctacttctgcatgcctatttcatcacaatgatcacattacctacgcatcctatatctgagatcctaatagctgaaacaattgtaactggttatttactctgttgatcaaattatggatcccatttcaatagttaatatatgcgcattattgtgtttctactctcactatgcaggacaccaaaactgaacaataaactacagaaacgtaccctcggatcaactccataagctgaggttgcatctcctcgtctcttagaacttcaatcctcgctgatattgactgaactgtgtgtattgacaccttcatccgagtatgtaaacttctcaatgctgcacgggtcttatcgacggaggaaggctcgtcgcctttcacatcctggttcctcaaatggttcagccttttctcatagtcaattcttaatcgttcgcctgcctacaagtgacaaaaacaaagcatgattcccactactcacttctattgatcttctggtattagttcctggtggagattgtacctttacttctttgtataatttcttctcccatgtatacagtctatctagagtggagtgatgacttccagacattgtactgcaggattcttcagagtaacagctgtttgtctcattgtcatagaggtcctctattgagcttgtgggagcaagaaggaagcgggaagacgatgaccgggatgatgcagaccgcaataatgcgactgggtttagcatctttgctgcattattaaattcattagtaagtcgagtgagttagatctgaaatagttttaagtaattccagtattggtttgtaaaattagtaccagaaagatcgtttgaggttgagtattgagctctacttgcctccaacatcactgagatttcctttgcagcatcgcagatccccaagaactgactgtcaatatccttcatggcttcagccagacttgctggtctgcggttcagatacactgtgaaaccaggtgtttcttctgcatttgctactttgttcctcatcagttctttcttatgcgccttgatctcaagttctactttgttacgcggttcacactgaactcctttggattcaaagccctttgtttcctgcttgccattgacctcagtcttcacagggcaagcacccccattagaaggcatacatctctcatctgaatgatcacattcatcgtcgccatcatcgtcatcgtcatcgtcatcatcgtcgtcatcatcagaatcatcattgtcatcgtcatccacttgttcctctttctggtgcacctgttcatgttgttgacactcatcatcttcttcttcaagttccgggattccttcctcctctcttacacgctgtaatcgtgccaattcatcgtcggtgaccacattgtcatagctactccgaggtcgcggatacgcaaagctgtccagcgatgagaatgggttccagaagaagtcccactgtgatgattcctgctcctgaggcgacggaggtgggtagcttggcctatcatacgacgcgtaataagaagtccttgttggctcctggggtgatgcagctggatagcttggcctgtcataggacatgtaataagagttcctcactggctcctggggtgatggaggtggataatttggcctgtcataaggtggtgtgtagtaagaagatggcctcattggcgaggattgcgctgcgaagaacctgtccatgccaccaaagttatctgtggggtaatgtgactcaatacggattgtttccacgggtctcggttgctcttcaactgataccgatgggtttggtcctgacctcaggtactttgagacatgaattgtcctcttctcatatgaaccataagggaggccaagcagctctggcttctgttgcttcaagggagaaatgaaggggtcaaatatgagctcatggtgatcatccccagcaacgaaccactggagcgccatcgagacgcgcctcaaggactcaatgtaggcaaagtgagacgacgcgaagcggttccgctgctccagcgcctgcttgatgaagtccctcctgtcccggcacatcttgacagcctcctcatcttctaacctggaagcagcacatcccatgtctccaaagcctttgtgtagtttcaactttcaagaacccgtcatgcttggatcagaacttctgagttcaacatgtggaaaaacattggagaaggaaaatgtaacaggtcagttctgacttgaagaaaccaggtatttgagtcatgtaacattgcagaaattacctaatactgtacaagaatcgacatttggtgatgagcacattccaagcaagaagatgacctgaatcaaccctgctgtctgacaagtttcccaaagttcagaagctgcagaaacaatgcagaatgattatatgcaatcaaatcatgcagcaaaagggagcttaggcataagctaatgaagtgcaacagcagtcatgaatgttgaaactggttgaatacaaccacaaaaactggccactcagaagccacaggcaacaactgcaagctactgaaaaccaaacagagcatgagatgcatctatttatctggaaacctgaaatatctttacaaagaaaggggagtgaaagctacaaggctacagaaagatgctcctttgcaggtgaaataccccactgcaaatacgctacactacacatttgttcggtagcaccagcattctttttctcccaaaagagggctgagaaggcaagagagtgaggaatattaatccttggccctactaccttcaacttgcagtaagtgaacggacttgacaactaaactaaattcagttcagtacacagtatggagtgtgagtgtgtgaggctagtgctatgaacacacaccaggggttgtactgcattggacttccaaagtcacactttttttcagggtaaaacagtacagacagaatcatctttactgtcttcaagttacagaagaaacgaatgatttagttctgaagatttaacagtaaaataagtgcaggattctaaatttcagaacagatggaccatgctagacactcttctgctgtataagcaaggaatcaggcagaagtaaaaaataataatcttgtgatgtaaaaactacaggccaaagacaaagctcaggtgatgattatgggtaataataagtaacagctcttgtctcatagtgcccccaaaagaaaaaaacaagtcttggacttagctccaagcctccaatttaatgtcaaattatcttgctacaacggacaaatcaaatggtagacaaacgcgacccgtgagcttacagacgaattctcactctaaaatattcagaatcgtggttctccttgcagaaaaaaatttaaaaaaacattcagaatccctgatgaaacagatgaccaaaatcttggagcaaatatatgaacaggcaatgtactgaataaaaccaa

SEQ ID NO: 72586 - DNA, 794 bp, Oryza sativa
  unsure (1)..(794): unsure at all n locations
aggaggttannnaagtgagctgctatcttattcctgcagcccggtgtgtacttgtgttattgcctttaaattagagtactccctagtgctaatggcactaagccaatggtttactctaggattagttgaacacttgaacgtactagcaggcatgcatgctcatgtcagacgtgacgacttgcaaaatgtcgtgtatcagtaccaagtctaaggccaaagtttttttccaaactttcaacttttcatcacatcaaaattttcatacacacaacttttctatcatattatatcaattttaaccaaactttcaaactttagtaaactaaacacagcctaaatgaacttcactagcaactcatcaaaagattagattatatatacacacaaacacaagattaattaaggagaggtgagttagtatagaggtggaaattctctacttgatcgaacaagaagagcacccaacgctcgcaatctcctcaggatgccgccgccgccgccgacgccgncgccatcgccaccggtgcgcgtggtgtcgacgcgcacggtgaagccatcgcggccacggccgcgggagcgcatcccgctcaccacctgggacgtgtccctcctcgccgccgactacatccagaagggcctnctcttncggcncaccgccgccactcttcacctcgtngaacatttcgccgncgcccttcgcgacgcgctccacgtgtactaccccgtcgccgggccgtttcgccccgacaagcacccccggcggcggttgctccgtctccatcgactgcgacggc

SEQ ID NO: 72587 - DNA, 578 bp, Oryza sativa
ctatagggcgaattcgagctcggtacccatatctcatcgtcgtcacgtcgtgtgagttgtgtttggacttaatttctatggtgtggtatataaatattgtcaaattcttttgagaattttttagaaccatttagataatttttaaacaagccagggacatctcctcaaggatcaaaatagttttccgagtaataactgaaataactgtcgctgtgacgtcaggtgaggtacaggagagcggcgaaggcgatgatgcggctgaacccggagtacctcaagtcgtacacgccggaggacgtcgacgccatggagtgggaggcgctcgagtcggccatggcgctgtggggcccgcacttccacgtggccatctccggcgtgctggcggcggagcgctggctctgcgcgcgcgtgctcgcgccccttccgccggcggtctggccggagtgcttcgccaagatcgccgcccgcatcgccgccgcgttcttccgcttcgccgacggcgtcgacgccgccgcggcgcgcgagccgcagcggctgttcaggctgctcgacatgctcgacgcggtggcccgggagag

SEQ ID NO: 72588 - DNA, 4803 bp, Oryza sativa
gcttcagcaccagtaattgaaaacataaaagtattaccgtaaaataattttttggtaaattttatgtaaattaacccgggtattatggttcttactgcgtagaaccacagtatcgcgtgcctgggcttaaggcaataccctaaatttaccttcgaagtatactttattatccgcactgctcacgtggtggctatcacgccgtaattcaaaaaactacggataattcacttatacctaattaccctactttgtgtctttttctccaactatgtgtttacgtatattcgttaggatttaaatttgaggcctctaactctagtatcatatattcatacgcaatcagctagtccaacccaaaaaaacaacttaatttgacaaggagatatggacaaattccaagaggtcgatcgatcgcctgagtaaacacatgggttaaaacccaaatttgccggacaattaactagaatcaaaatcacttgaaaaccatacaaatttaagacattgactttataatcacatgtatatgctattccctccatcctaaaatataacggattttgaataaataagacacatcttatctatctagatttgtaattctaagatgtgtcttatccatcaaattccttatgttttaagacgaatgtagtattatctagctaaatatggaagcccgagtcgagtcgataagcacacaaatggatagaattcgccgaacaattaaacaaagatcacttgaaaaagcacacaaatctactaccaaaacacaacataaaacagaacagaacaaaccaaaatgaattaccactagtaataataataactgataagtctattcttcataaaaaacaaattcaattttttttgttctgctcccacgtgaagtcgcgtccccccaacacttgtccagccaccaccacttgttctttccttcccctcctcttcctcctcctcctccgatccccatgcctcctccgcctccgcctccctcccccgccggccaccgctagctgccgccggcgccacccccgaggttcgtctcccccggatccgtgctcctcctccccctccgaatctccccgccccatttcacccacctgattttctttacagcggttgcgcctagggttcttgattttgagcttcggagcgaggcgaggcggagatgtcgttccgcagcattgtccgcgacgtgcgcgacgggttcgggagcctgtccaggcgagggttcgaggtgaggctggtggggcaccggagggggaggtctcacagcgcggtgcacgagctgcgtgacggccacgcggccgccgccgccgccgacgtggtccagagcagctgctgggctaacctgccgccggagttgctccgggacgtgatcgagcggctggaggccagcgaggcggcgtggccgtccaggaagaacgtcgtcgcgtgcgccgccgtatgccggacatggagggacatgtgtagagagatcgtcaagaaccccgagttttgcgggaagatcacttttcctgtttccctcaagcaggtgatgatgatgctctcttgcttagtcttgtatttccgcgcttcgatttcagatttgtttaactaacatacatctttgatggttgtcgtatacacggcttaatatgctcatttatagtatgcgaaatgaaattctgatatagaaatatttgatatgttcattaatatgcttttcttgaccatgttttgtttttcagcctgggccccggaatggagccatccagtgcttcattaaaagggataaatctacccaaacttacaacctatatctatgtcttagctcaggtaagcctttatcctagtattgtgtttgtttttgtactcgctacatggcatgattatttgggggaaattggttctacgacactgaaagatcctgttgtgagtaatttgctatctaatgatctctatacactttaatatcatcgagttaggccgttcacttttataccattccatctgaatttaataggttgccattaaaacggactcatttgtcctctagcaacgacataagtgccacatgacacactcgcactaaaccctttcatttggctttgtcttccttgcgccgaaactacagcgccagcccccgtgatggccgccctttccattgcgctctcttctcctcttgatacagcgcgcttctcctctgaatcctttctatgcctcctttttttctctaaatcgaggcctcatcaacttagacattttcgctgctcaactgtcatggcttcaaggctgcatcacgaaaggatctgagaagcgagaactatcatgccatggtcgttgtgtgctgcaattcaggctgatttggattttcgtttggctttgtcttccatgcgccgaaactacagtgccagcctccgtgatggccgccctttccattgcgctctcttctcctcttgatacagcatgcttctcctctgaatcctttctatgccttccttttttctctaaattgaggcctcatcaacatagatattttcgctgctcaactgtcatggcttcaaggctgcatcacgaaaggatctgagaagtgagaactatcatgccatggtcgttgtgagctgcaattcaggctgatttggattttaatttggctggcaattggtgcttgtaaatttctgaaatcagaagagcccgcacatagcatccctgagttatttgggcctgcttgatgattgccgtttgccaacgagatgggaatcgtgttgattgaagctgtagctgatatgcatttcagcacatttcgttagtcatttcaaatttgtcaccggtgagcatgttggcctgcttgcaccaggcatggacagttgctgccttcttgaatggtgcagcgctagcatcgtggcagagcagtcgtgaccatagttattgagaccggaccggtcattaaaccggcgatgccctcggttcaatggtttgttggttcaaccggttgaaccactggtttgaagcggttcaatctaatgtaaatatatagtttattccttcaaaacacaaggtgtatcatagcccggtggttggttggttcagttccatgcatgaggtactgggatcgaatcccacctgtgcccctttttctcacatttttccctctccagctgccgaggtgaccgcgcgcaatgcagaccgggcggttgaaatccggttttcttggcggtttttctacaaaaccgggcggcccaaccggtttatactgggccgattgcacagccggtcttttagttggaccagaccggcggaggctccggttccggttttttccggtccaactgctggtccggtccggttccaataactagggtcgtgacagcctgataggagctcgtgctgatgcacatcctgcaacccgacgctgcagctgtgcaacgtcttgaggtgcttcctcatcagtttcaccaggtcctccatgccacccaccactgtggccctgacagcaacgtgaatggctgtgacttgcattccaaaaccttgcaaatccaaatcaacaagatacacactagagcttgagaatatgggtggcacagcaggcggcactgcagcggtgctggtgacaatctggttcaagaagctcaagacgtatgtctaatgggcataagtgtaagttttgagtgcaaaaaagggggaaaatccggtaaacactaatggaaggggatgcaatggttaaaaactgaacgacgtaatctttcgataatattaaagtgtaccaagatctttcaatggtaaatttctatgaatgggatctttggatgtcataggaccaattttcccttattatttagactgcatcacagctagcacttcctgtgaggggcttgtatgagtatctattgtttatataagcaagaatgcatgataccttgcataaacaacaaccagagattaatgtatagcttgcatatgtggcataatcatttacgctccatcaccgctagcattccctgtgagggacttgtatgtggtatctattctttatataagcaacaatatattatacatgacagtatttctccttgcataaatatcaaccaaaagttaatgtatgatttgcactgttagccagtatgtatgagttattgaggcatataagttatgtatgaccgtacagcttgtttggtattagtttaattattgcatactgatcttgcttaattattgcaattcccacgcgtgctaatcatttgtgcatatggatattcataccataccacctcctttgttaccccccccccccttttgcagctatttcgtcctgttgtgagctaatttcttactgcatatatccctcccaccagcatacttttttagtttctgttatatttgctgacttcacatgttgtaacacatctcatgtagctgtgctcgttgaaagtggcaagttccttttatcggcgaaaagatactcccgtgcaacctgtacagaatatacaatatttatgagtgctgacaatacatctaggtcaagcaacatgtacattggaaaattgaggtaataacccaaaataatggcaactttgtttagagaaggtacatcgtctaagtgttttaatggtataatctgatatatttactgtgttggacttttaggtcaaatcttctcggaacaaagtttgtaatatatgatacccaacctccatgcaacacagccaatgtttcacagtcagggaaaacaagccgtaggttctactccaggaaggtgtcgccaaagaacccttccagcacctacagcatagctcaagtttcatatgaactgaatgtcttggggac

SEQ ID NO: 72589 - DNA, 55792 bp, Oryza sativa
atacatttacattggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactgattcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagaaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctttattgttcgacaccgatggatctcggtatggcataatgacaaccaatttggcagaggtgtacaactgggtaatgcgaggagtttggatacttccattggttgctattgttgaattcatccttcacggcacgaaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatagagtgaggagatatatgggttcgggatctcaggatcttacacaacgctgagtgcccaagttttttacattccagatccatctaagttaagggtgaaaaagggtcgacaccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcttcttagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtgagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgttactatcaactttcggcgctgcctgttgacataaagtgaatcacgcccactcgtgatcgtcttgtcacatctaatgaataatgtatctcattgagttcacatatattgcagtgaaaacaacgctatataactgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttcatcaggtatgcttcatctattcgaagttcaaatggataaaaaaactaacttcttcgtacacaattgtaacatcttacgcagacatatcgtccaatgtgcaactttatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcttgtgtccaaacattgtcgacgatgatttcgtggtaattacaactattcttttcatcactcctcagtactatcattaacttaactatcccaaaataaatgtacataggaggatgtaaggaaatgtcaattcgtacaatggattgacacagtcagagttacttcaagtggcgggccgataacgcaacctgaaccgaccatacagttcattcatgcttggatggagtacgaacgttgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactattttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggtgccgataggttaccgcatgcttgattcgtcgggatcgacaaatttgtaccgtgtatcgatggcacttcttatctatcttatcattacaatgtttaattatggtggtgatttttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggtgatttttaaaaatcgccctcccagagggcggtaggcgaccacttctgtcaattttcaaaatgaaaaattatttttgtaaaacttttaataaaaaaaattaaaaataaaaaaaattcgcgcttctgggtactacaccggtcagggtgttgggctggactatttgcatgggctacattggaggcccaatttggccgaaaagaaagtggagcttgtctcaactcttgtccaaacagatttcagatgtgcactcaccagtctcattgtcagagcttgtctcaactctttcatggaccagaaaggatagtagtgatgatcctctagggtgtccaatagggaagatacaagagcaatagggaaaagaagaaacatttcagggataacagtaattcaatgtgcacctaccattgagtgtttaattattttttttgtaaaaaaaatcagttgtaagatggtttttcagtgccttctagattcaggatcattcgagtgagcattaaaagatggagatgaaattatatattcaagagaataaaataaagggatgagctcccatgtttgtttgtttttttactggcaacagctattttcatagcttgtgaatttccatttaatagtcatccacgaattcttgatgacatgaactgtccttatatccaaatcaatgttattcagtaaaaaaaacaaacaaacatgggagctcatctctcaaaacatgcaatatattgaaaccctatccaaattagacacgccctaagctagtaaattgaatctgccacctagtaagctaaaaatgggactacgaggaaaacgatttttgtggacgaggcccttccatttttccaggtggataagtttttttggcaccatatatccgcctgtgaaaaaaattgattttcgcagacctttttctacaggtggattggcagttcgcctatgaaggcggttttcgcccgtctggcaaaataggttttctagtattgtggtcacatgattccatgagatcaaattaatactcaccatctgtactcaattgacatagcctattcgtcagttcaatgtcagcgaccatgcattttggtagaatcaaagattgacaaaattagcacaagagttcctgatgcctcctaggcctaccactgcaaaagccataggagctagcagactgcatgggctaatgtatgttcctctcattgcttgcagcatttgtgtgcttctccaccctgcatgcccttttatggaccaaaacatatcatcatgcatatcacaaaaggatgaacgacgtaccatttgattccatgcatgcagttattcagtgccacatggcatgtgcttgtgttcagatattcagttgatcaccttttctttatcgcatgttaccaatgaaaatatagttcactccgtgagttaaccaggcaaggtgttgggggagtggctccggattgaggagccatcctccgaagggttgaagcgctccggagaccatcctcccagggagatgaccgtggatcggggccatgtcggtccccgaccgaggtggccgctccggaggctaccaaggatcccagataatcggatcccgtggacggcgagagccccggagcctggaagggatctggagatcgccggaagggctccgggaggccgtaacatccgtgggctccggagccccaggaagcatctcgagctccggaactcagagggtttccggagcctagcaaaagaactccggaggcggccagggacttcggagctccggaggcctccgaagctcgagatgctgcccggggcgaatcgagcctcaatatgccctcaacggctcaagttaggaatcaggcgactagtgggttggaataaatgcacactttgcgccccaaccacctctgagactgtcgatgatgaccagacggagcacgatattacccgggggatgcctttatccaggtaatagcgggctccctcgggaaccggcgctgctaccttaataggcgcctcctccttgtcacctatgagattactaatagacccagggctgacccattggccagcacctcagattcctcataggcctaggggtaccgaagtcatttcctgttgtataccccatgtattaatatgtaaaaaccgctctcatttgggtggattgaatgcagaggaatatatttacatttgttgagttcttgcaacaactccaggcatggaacggccatcattgcggtcatttgttgttgttgtagacagagtttccctggaactacagcgcacaggcctgaactaacaaaagaaaaaggaatggacggagtataatacatgattactcttcttctactgttctacatgtgtacgtattgatgtgttaactatattttttatcaatttttgtctatgaattgatggcatatatatactgatgtacactacattatcagctcaagggctcgacggtcttgatattttattaactatttatttctttggatttttaatgcatgccatattaaaattaataccacacaaacaatacttaactcgttctggagttagcgacaatgctgtttggtaaaatcataggttgcccaacctaacacaagggctccggtgcctcctaattaagcttaacacgtacggtaaaagccacagaagctcacagcctccatgaacagaactagctagctctaattgctccaagcaattgtgcttattcataaccagctcttttatagacaaaagagagataaacatatcactcaaggatgtattgctgtttgattacaggttgttagtttttccatgcctaaatgttgttagttaatctacctcagctcctttttacttcgcattttgttggcaaaaatatagtccaccgcgctgaactcaggaacgtatataccctcgaagagctaccgaatgtgcatgtttacaaggcaaggcattgccatcgtcgccatagatggtagacacttccatgtaacaaaacgaaaaggcaacaacaaaaatagacctgacaaactgaacatgcacaagatgagtatcagagtcatcagacgtgaggtcgttttgtttaattgttagaatgataaatcaaaattcggtggtctattctctgttcatgtcctgtacttgagtaactgaaacaaaagcagttgcctttggtcacaaggcttgataaactctgcctttcagaaacagagtacagagtgttatgtgtgcagttaagaaaaaaccagatcgaaattcacactgatgcatcattccattaagaaaattctcagtagttgcctcatacaagttaaacactgcaactcttcgttaaactgtctgtttcgcacatcgagctcgtgcgctttcagtttatgaagagctgcaagagagagttgctagtgttctgtgtccctcaatgccacgtccatgacttcacgcactatgtcaacttctgctcgatagtggaaagctcccgatgcctcctaggcctactcctgaatgtacaatctggtcttgtttaaacgttcacatacattcgtttgatggtattttataaccatataattttttttgcgaaacatgatacaaactaaggcgctcatataacaagaaggacggacctgccacctgctaacttgcataatctctatcagtctctcccattctgtagttttgcccctttctacacttctcggaattcaaaatatgcgacatggccccatgatctcacatactacacatgtgtactcaattgacccattgaacttattggttcaaattcgaggtcataaatttgtaaatcatgcctttttccagaatcaaagcttgatgaaggtaccacaagagctcctgaagcctcctaggcctacaacaacaaaagcaacaggaacagagtttttctattaggcctttttcggtacgttgggatattccttccgggggaaatcaaaccatgtggggagtcggggaccgcgttgatctccatttccacacccaatcccctccctcccaatcgccttccatcccttagcttgtttagattgcttggatggacagtggattggaagggattgctactgtttcaaacaatcaaaacaagaaaatggcagggaaaattcgaagaaaccagaaaattcagaaagactttatatatgccgctctccccaactccagaacatggtggtaacggttgccaaaacaattatatgtatgataaccattaattatgcattctcttttggttcctaattgaagtctttcctgcaatcctgctggacagtatatactgcatatgactcttccagttgaacaatacttcagaagaaaatttagggaagacaaagtacaggcacacaactagctatgactttctcgtgattttcttcattgtactgatggaaagaatagtagtaggaagaaacagccataacgcccctatcttattccagagcaaaaggataagcaaagcaatattagacacatgtaaagacatatatagatcgtttgagggttgttgagccgtccaaaatcatcagcatttcagtgggatgagatcactcattttcccttcaccctaagacatacgttaacctgtacaatacataatcaaacaaaattaaagtacacatcaaatcctagccatttcgtccacaccaactattgagctgatcactgaaagaaaggaaaccagctagtttgcatagcttgcaaagaaaaggtatagccatgaaaaggattctaaattttgctcagcttgcagcctttgcaccgataatgctcagccatcagaaggattccagcgtttgcatatggaagattgccgacgccattgttgttattttgagatcaagaacatggagcccttctgctttggtgaatgcatagaacttccctggcaagaaggccatgtctgaactctgaaatcgtaatacgcttcagtgcatataattccatgtggccgtgtgagtatcctgtttgagcaggagatgatggtgaccacaacaatgtgtaacactggtgatgtggagattgggttcagtagggagcagccgacatatatcatcgtgaatcaggaagatcaggttgtcgacggcgaagcagatgggagcaccaccgaggctcccatcttcttcgtcagccacggctgtgacggcggtggtggcagcgggtggctcgcggtgtcagtagtaccagcctggtactatactagttaaggtatggaataagttcacttgtggtcccttaacttatcaacgaatccaattttcgtccttcaaccggaaaacattggaggcccatttaagatattgggctggactatttgtatgggccaaattggtggcccattttaccccaaaagaaagtagagcttattgtttggactaattaaagagagagagagagaactacaatggaatcaatttaagcttaccaaattttaccaacgttcgatgtatttggtttggagcttaccaaattttgatcatgtgttaatgagaataaatttccagaaatgccaatttttatgtcttgtttggcacagctccagatcttagattcacgtttgatttaaaatttatatgttaaattatagtggtttaaaatcttaaatttcaattaaaatgcgaacataatgatttatctaaatgttatcaacgtaatcgcatatctagatccgtggatttatgtagcttgaaatatatagctccaaaaattcttggatcagagctcaccaaagatggccagagagagccgttagtatgataacaatgacaagagcttgttcaacttgctatggtaccaaactttagtaactcaaaaaattagcaggttaaaagtggtggcaaactgaacaagcccatagtcgtttatgtaactttttaattagctttgaataatgttccacgtgaaagaaatccctcaatcatacagtgatttttcccctgaattgaacagattatcatgctaccttttctctataaaagatgatacgagtgagtgcaagtgccaaatgctggaaatgggaatgagagttgatacatagggtgtacggcactatgatgtatgcgatgtctttgttttggtaggtttgggaggtatggggagcatttgctttacattagagagttattttcctgcacaaacttcctagctgactagaaggatcagcgagcacagtcggctctttgctattcagggtgtttgagctagggcagtccaccatttctccacggtgtccatggtatcccattgatcgattcgcatgttatctagtgcccacactgctcccatatactctttgtaacctgacagtgagcaaggatgtgtatttccatctcatcgctgatcgacaaagtgagcaagtcctttgtacataatgcatttcactaggcaatgtctgaaatcatgttcatcgtgcattatttgtgcttgcacagacaagcagggctagaagtagggcaagggtgccagggcttagtttcttgtttgtgtgtgtgaattaaaagtatttgctccgcaccatattcttacaccttccaaatgtggtctaaattttgttctaccgaaaactactctactttaaattcctttatcttacctttcaaaacgtagctcatcagtggttaggtcttcaaaagtttggtatttctttttctcaaacagttctagccaactcaagctgatcagtgctagaccatgatctagaggcagggatgaaaacggtcggaaatggtcggaaacggtatcattattttattatttttttgaaaacgaacgaaaatggtcggaaaatttccatatttatgaattcatctattagtgtcaacttcaatgacatgctgatagaaattaaaaaaaactaaattttgaaaacgataaccatcggtaaaaatattattattatattagttttgcggaaacggtatcggtacggtcgggaaatttccataccgttttcacccttatctagaggtgcatgtggacatggaggaaccagtagctatattgcccccctttgaaatgcaggattatcaaaacattggagtaggaaaaacatgagaatagaacatcatattcattggattcctgaaggatttgaaaacataggaaagtttgattgtcacacaagaaaaatgtaggaattcaagatacgggaagaagaaaacaagaggtaagacctcatacttacttcctccaaaattcctccacaatagttcattccataggaaattcaaataaatcggtaggaatcactcctttgtttcaaaggtgatgcgggggaacttgtgcaacgcacctttcaccatgaactcacaaaacaacacactttgataggttgattcactcgaccatgcaaaattggatctcttgctagctccctcaattccctgcaaggaaaagcaagaacaatctatggcagaactcccaatcactatccctagtttggcgcctgacagcacaaaacctaggaaaagaacaagagcagatacatcacaatatggaaacctctcggtagcaccatcagtttgttttggctcttgtggtggaaccagaatgaatttgtgtccgtgggcctctccatcatgtgggccatgaagtttactttccaacaagtgctcacacgtccaaaatggacttcggacgaagagaaaaaaacgttttagtccaagcatatccaggatggcccaaaccgaatccaagtcaaatattttctttcttatcttcaaactccttgttttcgaaggattcaatccatggggaactagtggatggagtccatcccaaccaaagatttgccttggaaatagatccccatccaaacatgtcgtgcaaggcccatgttcatcatcagcgccgctactcgcgcgtcaaccaatctatttgcgcaacatgtcttcattttgcaattgtcggtgatagaaaactccgaatgatgtgccattggatcctttggaaagtagacttgacaagctttacaattatgtaagctacatctccctagacccacgtgttgtttatgcatgccaatggttcaaatatctcatgtctgaaagtaatcaagtgacaaatattttgtaacatcaaattctcatatatttcatgcttagaatttgagaaaaatgatatcaccttttgttctaatccacatgcaaaggacaatgtgtgcaattggttggcagatccacatcatctcttcaagaaaagtcgttctcggcttttggtaatcacaaaatgtgctaaacaaagagaacaatgtgtacgcatgatatgtgtatatgccattagtttaaaggttcccttttttacccatagtacaataagcatagcagccataggatacaccatacctggtttgtgcaaataaacttatttgtatcaacatttgcacaaataagtttccaattgtttacaccatacctgctcatatcgaaagggcttcatagggtacaaatcctttggaattcctatatttttcatttgttttaatgggggccaagatttaaccgaatggcggcatgttcaggtcattgaattccctcaggggtggaatggtgatcaaagtaccaacttgacagggccgtctccaggaattgggggccctggaacgaaatataatttgagatcctaaatttacttttgattgagttgatcatttaaattagtaaattatattcatggtaatttgatttaaaagaagagtactgaaacattcaattgaccatgcatggatacatgcatgcaattcaacaattcagtatttgacttaattaccagttgtccagtcttactctaatatggttgacgaggtagtcggccagctgctcaaggtgtcattgttgatcaaggattcaaaagctggtttcgcatgcatgcacatgaacacacataggacgtcagttgtatatgctaaggctggctggttgtgctggtcactctgatttgggggccccaaatttttgtggggccctgcgctgacgctccgttggcatgccctcgttgacgggcatgcaagatcacttcaagtaacaagagaactcctggtgcctcctatcccaagcatagcctcaaattctcagagtctctgagagtttattcagctttttatttagaattttgccacgataaaccccagatggatggggcccttgatgaactgttcatacctcagtttgttacaattattctgaagttcagatcccttctctgtttattcatggatcaaggagagattcgaacatcacatatgactatgagagtgtattgtttgacccctctcagttactcgtatatagaacctgaagaattgtccagctgcttttcatagacgtgcatctctccatttagtggaagcattaggaaccttcacagccatccaatcaaatgttgagatgtaattaagagaaatctgcgaacatgtctaaagacaaaaataggcaggaaagttctctttgagccacacaaaaacagcactcatcacaccaagtcaggcgtaaccaagaatgtcaaggtatagtaaccaaattgtatcatcgaaacaccagaactaagccaaaaccccaaactttttgcggaataaaaagttaccctcaaattcgacggatcacggcctgaccgaaggtgttgcgccggtctgaccgcctggaagccgtcggtctgaaagaggttgtatctccggtctgaccacctgatcagctgccgtcgcctgaaaccgccgtcggtctaaccgccttcactccaccggtctgactgccgcgatgccgccggtgactcgccggttagaccgccgaacccgagaaaacacaaatcgaagaactcttaaagtagatgacaactttattacttctctctgtgtttacaaagtgcaacaataacactcctcacgaaaatctcgactaaactcgaaaccctaactaaactcacagctcaatgctctcaaaagtgataccgagaagcctcacgctccctctctatttatacatgaggtaggcagcctaaagccacgaaccaaaatcatactagaagtcctaatccacctaggaaaccttctcatacaagaaacaaactttacaaactccaatcataccaaatttggactccttccaaatttgacttcgcatcccatacgcacacaatacctccatcgtatgccatatggaatcttcaccaaccatgtgcattgaactttagcctaagtatcccgcatgatatctgaccatcatggacatcgtcttatcaccaagctgactcccgatccatcaccggcaatactctcccgaggcatcaagtcacctacacatgaatcaaacaaagaaaccatattccgagaccaagctatctccaacttgactcattagtagcaaacaacagtattacatacgcatagtatccatctagaagccataaatatgaaatccaaataaacaactcgaaaccgaaaccgacacaaagtcggctggtcagaccgcgcaatacaagccagtctgaccggcagcacatgcccggtctgaccagaccacatattcagcagttcctgtatatcacatgtaaatcctatcatctccaaaaccacttcgccaataatcttcaaatattaaaaccaataatcacagatgccaattgttcatgatagaataataataaaaaacactttgattttgcacaaatccctttatctgctagaccaaattaaactgaattccaacaattattcacatgtgaactttaccacaatgatctacttcgtgcattcgtcacttccgcagacacaaggagcttcaccgcagcaccatgagttcttcgagttgtacggtggaacagtagtggtctttgtgaattcatcacatggctgccactgtcccaaccccttggaccataaaccactctacatggagcatcgacatcggttatcagtcaatctgcttttataaacaagaggatttgcatggctgcaccgcagagagaatactagctccaacattccctttctgaatgagaactgttcataattctgatgaaccgctatgctcaagcatttgtcctctacctcttgctcgcagatcctgtacgcaggatgcaatataacagttatttgcgcaattttagtttaagcatgtagaacggtgaaccaactatcgacaagctaggtaaaagtaattaatagtgactatgtaggaacttactgaacatgattcttgtggcatggcaactcctgatgcatcctattctgaccaaagcaacaagaaatgtccatctatcatctcttagcttgagcatcgctgcagctccttcatcgacagtctactcttccatgtatatatagagctgtaggtaccattgaccatagcaatgttacatttctgtttcaatgcagcacctaccactaacatacgttatgggaggtgttttacactggaactaatttaaaacgtttcctttttctaattcaatggatcatatccatttatactattactaccacgcatctactacgtgtagtagaattgttagagtttgtaagtttttcaaatggtagtataactcataaatcaatggttgacatcacttctactacaataatactgatagtagaatactactagtagagatcaccgtaaatgtactccacgtacaatacaacacataataggagctggacattaccagactgtggagctttgtatcagtaggattggcacctactgatggattgtgtttttgccaagcaagtatggagagtgctctttacgcgcctatgattacacctgccgggtacccatgctttcggggcatagatggccataaggcccgaggcccgaaggctcggcccacggcacggcattttggcctggctcaagcatggcacggcccgacttgggtcgggcctgtgccgggccgtgcctgggcctccccaccggcacgctgggctggcccggcacgatgggccgccaggcccggcacacaaagtatagggactaaaaatagacatataaatgtcaccgtccaaagaatagggatgttaaatagacttattttagctatttatagatcacagcccaataggagggaggaaaattacacttattctgaggaaaaacacgatgcgccgtcgtgccttcgggccggccgggcatggcccgagtcgtgttgggccatgcctgggccgtgagtgcggcacgtgggttggcaggcacggccggtgcatcggtcgggccgtgctggcccgacaagcctcggcccaggcacggccaggcctaggctgtgccatgccgggcgggcccatatggccatctatatttcggggggtgatatcctacattggtgggaaacctgcaggagaaagctagtaaaggaacatcgaaggatatttgatggtgtcatcatatacacatcatggtgcatttggctgcagcgaaatgataaagagttttcaacaacgtttacaatgagacagtggaagatgtggtcaacatgtttattagcctgttcagaacaagggaagaagtgcttgctcaaatgtagcttcctaaagtttttagcctaaagttgtcttttttttccttactgtgttgctgctcctgtaaaaagggctgtcaaaaattatatttctaccagtggagcaacagaattataggtcagaaaaaagatgatggaaaaattcattatctagcggtatactgatagaaaaaatatttccgacagctattgccttgcacagaaaatataaactggtgtcagatcgatctgtgaaacttgacgctggacgtgtaactgtcagtaaattttcctgtcgataatggcaccatcagaaaaaatgctgttcatcagctaggttcagagttcagacgagcatcggagcatgcagttaatcatttaagaccagcgagtcaatggtgaggcccttgtgtgcataaagggctatttcaatcagacggggacgaaattgggcagtagctagctctgaacacaaccaatgaaatttgagtagatttctgcattcagtttttagaaattgccatagtgacaatcactgaaatcacagcagcatatagataaagcaaaattccgttctctgtggcagcaacagaccaacaatgattaacaattagaacatatatagaaaagtgaattcatgataattggtaacacggaaacaacccaaaaaacagtgtccagtgggtttgtaaagacaggaaattccatctgcctggctaattgttaccatcatgtactattatctcaatagctcattcctcatggagtcctggaccaacaaagacaagcaactgtgctactcccaatgcttcccatgctgactagctaggcagttcactgtgtgtagagtttccaacagccctacagattacaaacgtgcactcacctgttccattttcagagcctgtctcaactctcttttatggaccagaaaggatatttgtgatgatcctctatggtgtccgggataggtaaatgggaaatagataaaagaagaaccaatttagggataatttgtaatgtagttcaatgtgcaccagcctactattgaatgtttgattaacttttaaaaaattcagatgtaagatggtgaggccttccagttgccttatgggatcaggattattcaattgagcattaaaaaggttgcgatgaaattaggtgagagaacactgattaatatagggatgtttcgtgtcgtcaagaattcgtggatgactatatctgacagaaattcagaagctatgaaaattgctgttaccaataggaacaaaaacatgcgagctcagctctcaaaacatgccagattcaaaatcctatccaaattataaaaacctgtgaaatacgactataattgatcaagatgctgcaatcggttaagaacactggcattccatttgcaaccatgtttaagccaatgcaactattgaatcaagatctccaattcaaaatcgaggtaacatcctgcacaacattgtcaatcaactaccagttctaccactgttcctcataggcaaaatgtttggtcattgcaagaacctaaatcagctacctagtaagacataatttgccacatgctcacatgagatcacatactcaacatccgtactcaattgacccagccaattcatcacttcaaatttgaggtcttcaatttagcaaccatgcattttggtagaatcaaagcttgaccaaactagcacaagagttcccgatgcctcctaggcctaccacagacaaaaccacaggagctagcaaactccatgggctaattgtttttttaactttcattgcttgcaggttgcagcagttgtgtgattcttcaccctgcatgcccttttatggaccaaaacagatcatcacgcatatcacacaaggatgaataatgtactatttgattccgtgcagttattcagttgatcaccttttctgtcacatgtgccagcaaaaatatatagttcacccccatgttgaataatatatagttcatcatcgcttcgcttccattgaacttctccatcgtgtgccatcgatgccatggatctgagatcgatcgcgccaacagctagcgttgaactgaaaggaccagccatcacaataatgcctctgctactcgtgcagcgtcgctgcgtacgtaggcgaaagaaaaatctgttgtttttggttagaaggctttgtaaactctggctttcagaaacagagtacagaatgttatgtgcgcagttaagtaaaatccagaaaatcactgatgcagcaattcgttgagaaatttctcagtagttgcctcatacgagttaaacactgcaattcttgaataaactgtctgttttacacatcgagctcatgcgctttcagtttatgacacacaactacacaagtcaactaccagttctctgcataatccagtacatttttgcagtgttcttgtcgagaagatgacctctgacagcaggccagcgccacttagcattctgggcttatattccagccatagctagtatttggttcagtgtatatactccaatcatggagctattgtcattgcaaacacttgaaagtaagtctccatttgatcaaagctatgactaaatgaattatcatgattgagacagggcaagtagaacatagatagatctagagatcaaatctagctagtagcaacgctgaacatatctactagattagccaaacaaatggagtggtcatcacacctcgacaaatcatgtcaagggaatagttttgcataaaatcgccaatattcagacataattaacatattcatcaggcataacatccaccttcatctactcaagaaggcctgcatccttaaccccacgattatccatcatagttggaaaagtctcttgtgcatgtgtatcctgctgaagaactacaagagagagctgctgttcttctctgtccctctatgcttgtaatgacttgatccactacctcaacctctagtcgtgagtggagagctcccggtgcctcctaggcctacttccatgtgaaccagcactgtttgattccatgcacttatacttactgtatgaaagcttcatgatgcatgtactaattaattaattaatgctgtgatcgatgtttagtttttttcctttcacgttgcatcttgcatgttttcggcgaaaatacaattcactatgctgaactcaccgcacatgtgtattgacaattgcaagggatggccgtcgtcattgtaaacgcttccctaaaactgctcttccatctctttctgtgtctttctttttaagatgttggaacaattgtagatcgcaactcgtttaatttctttttcatctctttaggcatataattccttttaaaagaatagataataataggtttggcactttcaaaagctccttagtgagacggctaacctagacagttaacgttagcactccctggtgtagtcttggatgtgtgggtctcggtggtgggagggcgggggtcctcctactttgtaaatattttgttctttgttttttcttccccttgaaatgaaacgcagttctcctgcattttttagaaaaaaaaaagaataggtaaatgggtgactgtgtgaaagctttacaaagtcgaaaggcacattattttttttgtgctaaagtttgccggcctaagaagaaaaaggtagatcattacaaaatgctccacacactaaatggtgggcaatgccagatttcttccaccaacttgcaaattctttggctatgccataaacttaattaatgtaatttgtccatggaaagatttcagaccaaacttctgccgcatatatacatgcatcgaagctgaaggtccatagctacatgcatgtttggctgactaccaagcttgtgaaaccttcttatgtggtcatcttcctcaacttgattcgttggttggtgtcaacatagaggacaaaaaaattagaagttatccaggagagagctagcctatatctgcatcagcgtagcattatttgtttccagcctatctacaagttggaaggagaacatgatactgaaagttcatgtaacatgacaattctcgatgccttccaaacctagataagtattttggcttttgtgtatgggcatccatatgcatatatggacatgaagtcaccacgattcactatcactctcatgtttcaggcttagagttttctcatctctcatatatatggtccaaaaagatattgtatatatggttaaacattgtcaccttattaattcactacatgcaactatattaaattgggaacctagctagctacagggttgccagctgaaagtgagctgtgtaggttcagagtattctttaacttcaatccttctaatttttggcccaactgtgtttccttttcattaccctccttccattttgtttgaatgcgggaagtcacctgcttagagagaataaacttgctgttgggctgattttgccccaattactagtttggcccagctcaaaacaagaatgtaccccatccgttccatgaaaaacccaatcctacaactataaatctagataaatgtgtatccaggtttgtagctaggattgtttttttttaacagagtagtaaactctgttatgcttatcaatttgatattggagttgttgttttaacatctttctaaaatttgaatactatttattcttgtccaaagtttctaagtataaataaagttttcattcccgatgaacgtttgttagcataaagttatacaatttagaatttttgtggtagaaagttttttattcctttagaaaattgctagttaaactgcttttttactatcgtataaagtttctgaacatatattttttatttttgtagaaagtttatgagtaaaattctatttattatttgaatagactttggattgaaatggaagtttcataatgtagtaaaaaaaggttaagtagtagaaggtcttcctatcaaatagaaagttaaggtttgcacaatatgaagtttgctgtacaatagaaaaatatgcaactcactaatcctaatgacatgctaattacacaatgcgctaatcttgatagtgtgaacacgctaatcaatcacgcatggagaatcctcttgtgggtacgtcttcgtgccacatgtgacaatatgccaatagagtggagtaatattaacccactctttctagtgttaatttatacaaggcactacatgatacactagctagtacaaagaatgttaatttctagtgttcaaagaatgttctttcacttctgaggtgtggaacaaaatctgcacttggaaggggttaggtcaaaactacctacctaacaatttggatttaaaaaattggtggagcgctctctcagccattcaaccgaagcccttgcaaaaaagaattttaggttgtctgataacctcctggtggaacatttagttggagcggaataggcgtattttccaaaaaaactcccacaacggttgatagggtggctaccctaattcttcaagacattgatcaaagacttttggctttccaacccccttgatgctgcccttgtttttttcccttttgctccattttttgttattgtgttttttgtgttttcttgtctgtaaataacttttatttcgtctaatatattccggcagtccttctgccgccgtttccctaaaaaaaaagatacactagctagtatgaatatgttatgtattataatttgatatctcatgacagtatgacattggcctccttagggatccgcaggtagcaaacttgatcaatccaccaatcttagggaacagatccttatatatcatgcagccatggtgcaaacttgtatcggggggtgccgatatactgaaattttgaacaaaacttggtcaaatttgaacaaaatattgccaaattcaaaaaaatgaataacaaattaaaaattcctgccgaaataatatcatgggggggggggtccgatagaaccgaaatttcggaaatttctttccaaaattttgaaccatggttatgtggatcagatcaacaatcgccatcgacaataaagccacagctgatcaacaaaatttgtttttgtttttgtttttttttcaccggactgacggtgaagaaaaggcccaaaaaattttattaagattaagaggagatgttgcatctaaatatgtggcatccccaaatgttatcgtgacaacactccaatcttgggcaatacaatggttctgttctctacgatgcagcctcctccatcgagcaaccacacacacttgtcactcataacacttcatccatcatctttggatgaggctgttgttcgattcaacttctgtcgagcactagtttggagggacatcacgtcggcttctccatcattctgcttccgagagggaaaggtgctcaaatatatcgaactattcgctacgacatgcaatagctaggacactgtagtagttcatcaggcaatgtttaatatgttcaggtagctagcgaccatgctccatatgttttgtgaaatcgtaggttgcccaatcaaactcaatgtctcctggtgcctccaaggcctatagcagcctccatgaacagacctagctatctctcattgcttgcactacttgtgcttatccatcaccagctcttttatagagcaaaacgagatcagtacatatatatcacacaaatacacaaggatgtacaccagaggcatgtgctcatgtacagatgttcagttaaccaacttttttccttcttttttttgaaataataaaataacacctacaaggcatgtattgatgtacacactttcagttagcaaactttttttcttcttcttgtcttttttggaaaaaaaatggcaaggatggacttagcattcattattgataaaaaataaatgatggggggaacataacgatcactcttgtcaatagcatactcttaacaactctcttccaaccaacctatgcatccttctcaaccacttttttttctgaagttgcagatcaaatatttcagttgatccaaaaaaagttgagcgatcaaatattttagttgatcaattggtgaaacattaagttatacatggtgaaataaaaaaaatagtaattaaaacatttaaaaattttgtggaatacaacaagaacacacattgaaatatattgctatcacttatgaaacaatgagttttagcgggttgaatcatttgtttttcttcatcaaaatataattatgtgatagcttgttgtaaaaaatgaattacaacaaatacaatgttgcgtttggatcgtagattggataaatagtttaggagaaaaattattttgaagatcattacatgcatgcgtgcatgcatggagtggagagagagtaattagtatggtaggaaaaagaataagagcaggtagttgcctaaattttatgaaatataatgaaaatgcacactgaatcgtatgatatcttatcataaatatttaattacaacgaatacgatggtgtaatcagatattatatcatataagcagtttagaaaaaaatactttaaagattgataaatgtatgtatggatgaagtaatgtagggagagcagtattgcagatactgcaatactatttttcttccatcggtagacccatgtgaagcggtgtccggcccaatcacttgatgtggcagatagatgcaactatttgacaccttacaaatggcaccttgtcaggccaatgtcaaaactctagtttctcccaatgtcctgagattcatacctgacaaatttatttgggaatacgcagaaaacttgttcatcattgtatcaagatggaatgggtctatagtacaaaacacaaaatgaaaagagcaacaacgaaactagaccctggtaaactgaacacgcacaaagtcagaaatgatcggccaaaattgactggttctttctgttcatgaagtgtactttaataagtgaaagaaaatcagtgatctcggatacaaggtttttatatactctgtctttcaggaacagagtacagactgttacgtgtgtgtgcagttaagaaaattcagaaattcacccagatgcattaatccattgaggaaattctcattagttaccagatatacgagttaaacactacaattctttgaaaccggctgtattacacatcgagctggtgtgctttcagttcatgacacaaatcaactgccagctctctgcgtaatccagtacatgcttgcgacaagatgaccttttccagaaggccagcactgctgagcatcctaggcctatattctggcaatatcttgttaggatataatatttgattcgatgtaattaattattcagtatgtatgtgccgatccattgtgcaattgtcactgcttagagttgtatgtagctcaccattcgattaaagctatgatttaataatcagctgatcagttcatttcaatttatggttgaaacaagggaagtaaaatttggctgcaatttcaaatatatatctccaagattaggcaaccaaatggagtgtttgtcacaccaccaggagaaagtcagggaccagtttagtataaatcgccaagattcagacgtaagatgtacatcagagatagtccgtttctttagttttgaagtatatgcaagtttaacgaacgttgtatttagcgattcaaaactatatatccactttggtatttacattcctgtacacacaacaaaatgaaccattaggatgagagcgaaatgctagttcaaatttatgctcgcttagctatgtactaagagaactaccaagctccagttcatgaatatgaatcatgtccatgattacggaaaatcctcttttccaatcaatggctcaacaaggtctcatccttgggcctcatgattatacatcatatcgctttgtcctacagacaattcccatgcatctttatcaggtaagagtatgatgctggtgttctgcccccctcaatgctctaccgaaaacacgacccactgtctcagcatccacacatattaggaaagctcccggtgcctcctaggcctagctaccatgggcaagcgacagttcacaagacactggagccagtttcacttctatgcgaagttgtgaactaacactcattatggacgactctgtcccttttcagctcatagctcttggttcctcttttataagccaaacgaggcctttatgtgcatataaggaccagtgagtgaatggtgaggcctttgtgtacataacccaaaaaaaaattatgtagatttctgcattttggtttctagaaaactgcagtagtgataatcaattaaatcacagcagcacatacataaaaccaaaacgtcattctttctggtagtgacagtaagcttggaacagtggattcatatgtacttggtactccctctgttccataatataaggcacaactacttttctttgatgttccataatataaggcatgcatgcatgcatacaattaactaggacatcttctccattgaattattattttttaaatcccccactctcaagatctctaattctattagatgcatgcattatatttattaggatggtccaaactaggagatgataataattgtttcttggtctttgtgttaagggtggttgtgccttatattttggaatggaggatgtaacacataaacgacgcatccaagaaagagtgtccatgctgctctgaaaatacaaggaattccatctgcgtagctactctcgttactctcatgtgttattttcaatgggtcatggacgatgtagactcagcaaagacagggatagtcgaactcccaatgcatcccatcctgaccatgggaattgtttcaataggatcagtgagcagagtttccaacatccatgcagattatagacatgcactcaccagttttaccgtgtctctctctctctctctctctctcactcatcagttaacagtgctagctctcatgccattcatatatggaggatgagaagtgttctctatatctacacaaggtcacaaaatgcacaattattcaagggagcatcaggtgctacagtatcaccatgctaccatgtggcaccatatatttgatgagtgagggagagacagtaaaactggtgatcatttttgtataaatcgccaaaattcagacgtaacatgtacatcagggatagtacgtatcttcagttttgaagtgtatccaatttcaacaaaatttggagttaggaattgaaatctaaatatctatgttggttttagtattctttgtactcacaagtcacaacagatgaaccattaggaagagcgaaatgctatattcaaatttacagtcgcccaatgtaccgagacaaagcctatgcttcagtaccacaatatgaacaagtccatatatcagtactgaatatcacctagtccatcatcagctcagcaaggcctttgtcctgaagagaattcccatgcatttgtatcctgctgaacatctacaagattcagatgctggtcttctgtccccctcagtgctctattcaaaacttgatccactatatctctgagtccacacatatcaggaaagctcccggtgtctcctaggcctagctaccatggataagcgatagctgacaagtcactggagctactattacactgttacttccattcgagcattagctgacaagtctctgcttctcatctcttgtgatttttcttttataggccaatgaaggtctaacaatttccgttgcattttgaggcgttcatgctttagcttgactagaattttcctgccaatatatatggttttgcattgcatcttgactccacacaactcgcgaccacatggaatgcacttgctcatcaccgcggagctttcttctgttcaccatgtcaccatggctagatgcattcagttttaaattgggagaccggaactgcgtataaatcaaaatattaggcgaaatttatttgaacatttctggccaactcaacctaaccagtagactgtgatctagaggtgcttgtggacattcagttggcagtaaccataccaaatttaattaaatggcatcatatttggacgctttgacacttcatccatcatttttggacaagagctaaatgtgtttcaagtaacatctgtcaagcactggtttgatggcttcatcacatcagctgcgacatcttagagggaactgtttgaactgcatgtaggacacagttaatgctcaagaccttttggtaaattcagggtagcccaatctaacacaagggctcctggtgcctcctagtcctaccacagcaaaagtcagaggagcagcctccatgaacagaactagctatcacccagtgtttgctctacttgtgcttattcatcacaagctattttatagagaggaaagagatcaacatatatatcacacaactacacaaggatgtacttctatttgattacaagttgttagttattcagtgcctatgagaggcatactcatgtatagatgttcagttaagcagttaaccacctttttccttctttttttttcgaaacgaaaatatagcacctacaaggcatgtattcatgtaaattgttcagttagccactttttttcttcaattcttggaatgatgaatcaaaatggactggtcggttgatttgacagttctctgttcatgattcttttttcttttttgcttgaacacatggacatgcaggagtgttcagcttccttggtcacatgaagtgtactctagcaaatgaaataaatcatctgcttgtcttggttccaaggttttacatactctgccttccaaaaaacagagtacagacctcaacgccttgtggcgaacgtcatctcgtcgacgacacataacatgaacacagttcacacataatttatttttaatcactaataaatgttgataaaagggaagtccatattcggtgaataagcagacatatgcagttgtcagagaagacagatggaggcgagatgagatcggactatcctatcatatcaagtcgccactagaccacaaaggagctggttttcccagtacgtactgcactctggggtaactcctcatgatgtttcccttgggttccatggcttataccgagcactccaaaattcgtaaaactctcattgaaaatacagcacttgtgataacgtaactctcgatgcctcccaaccctacatagccacaaaacgaagtaaatgcattttcagtttggtggtatctaaatgattctgaactcactgctatatatcggcatgtttgtcttagcctctaatatctttcatgggccaaaagagattgtatatgatatgcatctgaaatcgaaatgtactacatgtattaactcagcagcagatgcagtcatgtcagattgggcacttcatctgttggggcctatccccactacttcctttgtaagacgttttggggttcaaatagattcatgtatggatccatttgtatgcttcatatatgtgtctaaattcatatggatattaatgtatctagatgacggatggagatgtccaaatgtcttataatgtagaacatagggagtatatatgtttattgaaaaattaccgatctcactataaattaaactgcccatgctgttgtagataaatttcagttcgacccaatgaaattaggtgacagtgttgaacataaccgacaaatttcagtacagttatgaatttaatatcctaggagtcttccggttagattcacaaggtggtggactagctagcctcggttcgaagcatcatcctttctaattttttgatattaggtcgttctctaatatttgtgtttttttagagtgttattttcttagatatgggataacgtaactaaaattccagcttatgcatgatgtgatattttttttatagaaaccgttatacggctaatcaataaaaccacagcagcaacagttattactagcacattacaacagcggagaaactcctggtaacttcaaaatgatccaaagaggatgagtatggtgatgaaaaacaaacttgatctctgtctagcacaaggaacaatacaaagagaggaaacattccacttctgtagtacatgtttgtacattattgcttgcttttcaaagctacattggctcctcctcaatttgacatgctatgagcctgcagtcatcagtgttggcatgttttgctctgtccatgttccattaacttgtctaaaaaattagttgcacattatcagcacaagggctcagaagtcggaactcatgatgtttgaataactcttggacttcttgttaacagattacagctatattgtgcattgttgcaatttacacacggatcatatgagctcttaaaatcaagtattgagcaccttatctttactcatgcttctttgacttctcttttatggaccatgacaccatagtatgtaaggatgtattaatatttgattcaatacagttaactatgaaatgtctacatgttcattgtgcttgtgcatacagcagcaggactagaaatagtatcattcaagaagtagttacaatggcaagagaacaaagaaatgtagtgatgtacgatagttcgaaattcctcagtcgaggatagcatatttttacaaccttgatctttccatgtctgcactctctatagtataagcaggggagttgcactatgacgctgtgggtaggggcctagcttcctgtccaatttcccggaaattgctagagttgctagacaacatttttccaatacctcctaggcctcatggcaaagtgatagaagcagtctccatgacagatgtatatctaactatccatctgttactgctagctagctattcatctcttatagctagctagatatatggaccaagagaggccatgatctatcgattgaaggatgtactatatatttgattccatgtaattatatatgcagcatctataatccagtatcaagttatgtatagttcattgtgcaaccaacatatgcagagtctaccgtatctagcagtaatgctgagcatctcttgaggaatttagctgctaaatgttcatgaaggcattttcctgcaaatatatggcaccttgtcaggccaatgccaaggctgctcaaagcaattaggttcaaagttcagacttcagacttcaaacgtgacaaacttttgattgacgcatcattcattaggaaggagtgtaattttatcatttttgaaaaggtacctagaggtaccatatttctggtgtaaaattcagtacctctaggtactaaatacctcaaggtacaaaaaattttagtgtaaaatttagttacctcaaggtacttttttaaggactataaaattctttcctctaggaaggaaggtgtctggttagtacaaagcacaaaatgaaaaaaaaaattgtgatgacaaactgaataggcatggcattttcatcagtcataagaaataaggttgtttcttcatttcaaggaatgatcaatcaaaattcactggtctgtgttcatgaattgtacttgtgtaagtgaaataaaaacagatttcttggttacacggttttatatactctgtctttcagggacatagtactgtgtgttgtgtgtgcaattaacaaaattcaaaactcaggctggtacatcaatcagtcaacaaaattcacagaagttagctggtacaagactacaagagtaaaatactgcaattccttgaagagaatgaaactaactattttacacatcgatcaagctcgtgggctttcagtttatgacacgagtcaaccacaaattttctacataatccaagctagcatccaattaaccataaagctcatccttgcaatgccatttatcataaaaattcagttgactaccaacaattctctaaataattcaatacatatatcatatccttgcacaccaatgttgtacatggcctttgccagaatgcatatggaatctccaaaaagcacatcctttggacgtgccaatgttccagttcattgatcaaccgccacacgaccgtgtctctaatcaatcgaatctatggctgaataatttgtcaactcgctctattccactaagaagtcccgtgcatgtgtatcctgctgatgatttgaaagaccaaaatgctggtctctagtctcctgcaatgcttcagctcctggtgcaccaaacaaggaagttcctggtgcctcctaggcctaacatagcaatgcactagatctaattttactcttccatctgaaccagcactcaccacagacgactctttatctctcttagcttggagctcctgatttctcttttataagcctaatagagtttgtcggtatggaggtttgggtctttccatgaaatgtactatagcatcgagaaattttaaaaagcggaaaaaatctagaatgtccgatcttgtttcgtattatcgtgtatgcattcaactacattgtagttcaatgcatgtgcacctaccatattgtataaatgagttaagtgtgcctgaatatatgttctgtagagatctgttgtcatgtggacatgagtataagaaacatttttgtttgcatggacatgtatttaaaagataaaaaatgttagtaacagaaaacttgcattaaaaagaactgacactaatcgtattggtgtccaactatagttgctcaaaggtgctggttctatatttttttcatcccgtgaagaagagaaaagaccaataggtactgaatttaaattaaccggcacctatgagctggtacctagctattatgggttttgtagtagtgagtccttccaatgaataactaaacttcgtgctaattgatacaaaaacacagtgaactgttataacaccaatagcccatgagttatttattcatttcacgtcagggtagagaagttatttttttcccttcacatgtgcttctatggaccaacgaagatggttataaagcataaggatcgatgtactttttgattcaaagcagttccatttccaccttcgaagtgttgtatttcagtatgccgctaccatgtgcttgtatactaatatactgatcaacatatttttagtgtattgaaagggtctcattcagtgaagtgtaaaagtttagaagcggtaactagctagcaagtagtttaattatgagcaatcagacacacacttagtggctttgctctggaggagcttaacaactctatcgtgcgctgaaggattacatccagtactgtcttcagcctgtggcagaaaaaggttcccaacgcctcctaggcctagctaccatgctcacacaccattggagttctcttctatatgaccatatgaataatatgagctcgatctctgcctctctgctcttgtgacatctttttgtagggcaatgaagaacagtattatctcttaattgcctgcaaaaagtgtagtccctttgaaaatgatagactgaaagcacggatcatgattcatgaaaaaaatgatcccgggatgcagagtttttattcagcaattagaattttagttggggtttgtcccatcaccttatggcttgattttcatataacaaaaatcattggttctgtgccttatggtggagaccagagatgtaaatcattttcattatctaaaaaaaattcaacaaatgccaaatcaatcacctcaacattaatttttcctgtggaatgcgattatgattattcaaccttttacaataagctaagtgcaggagcattccactggacaactattgactcttgatgtccaacggagactgatgaatgaagatcttgatctttcaacttgagaaccagttttgtaccctatgcctcccaggccaattgttgtccatggcaagaagacaggatctgccaccttgtcttgctcatcctctctatcagatcaatgcctgccatagttctccgatcctcctatctgcacttctttgtggccaaaagagctcaaatgcatgctcccatgatctcacgtacgtactcgacatttgtaccaaattggcatggcaaattcataggatcaaaatttgaggtctacactttgggggtcatgatgttcggtacaatcgaagattcgtagatgtaatagaagagctcatgatgcctcaatcacctgcatgttcttttatggaacaaaaagagaccacaccaccatatgtcaccactaagtgttgaacactcacggccgtcttgttgagccaattaatttagataaaaaaaaggataggcaagaaattagttatgccctcatgtgtcacaaaaaataaaggttcgctgtaggattatagattcatgaatggcgtgatatggcaacatatgtaaaatgttccaacatggtacatggatgacatataaaatgtgggagaatttaggattagttggagaccagtgtgcatcatctctgcagtttacttataacaattcaaggatttccacgatagatgattttatttttcgaaattcctatgaaaatgcttgtgcaaaaattcaaacttctctttggtcccaacactttatatagagtcaaaataataaaatgggatcttggagtcacaactcgcaagcaagttcgaagggttgagcgggaccagggtcagagacacatcaacatgctcgtaaccatgtacttgttcatttacaaactttttatatcattttttagagaattcttctatttagactaaggaagcttgttattgaactcgtatgattttctagagattttttgtatgatatattcatatcacacaaagtggaaaacattaatttgaactacatatgaaaagatcaaggactaacaaaccacatgatttacatgcacatgtcacactgtctggtgcatgccgtttaaaaaaaagaacgaaataagtggaagtcatgtcgatttataagggattcaattaacaataagcagacactgaaatcagctcactctgtcccaaaataaccgcagagagttttactgattggcccaaaatttaatgtgatcagctcaacaatgtgcaaggatatatctcacgtacaggacatggcagttgggatcacctagccattgtagattatgtgcaccaaggagaatgaaatccaacaaaggctagtagtaagcggcggtattgctccatcgcaagagtcaggtttacttggcgatggtaaacctgatgctggattggggggaatggcaactcctttcacctcttgggcagcgccttgcggcatcaccatgtctgtcccgttgtgagcaaacagctcctggtgcatcccaggcctagcatagcaaccgggccactggtctgatccactcttatcatttcactctatcagcttgcagcacttgccacttgggcttttatgtctcatcttatatggagcaaaattggcagcaaggtatttttgtttcgataatggataaaatccagccttttgcttcaacagaagttatatccgcgtagtacaatgtacctggttttaaaatcaaaataaagtatctaaccaaaaataaagagaagacacgttataaagccaccaacataaagggagaaatacaatttattcaacccctgttagtaaatttttgtttaaagttggcgaaaatttagtaaacctttgtgagtatcgatttacgcaggggcggatcctgttgtgcgagatcacccatgtcactgacagatgaattatttgatccctccttgaggacagttactttgcagccaagaagtattctgcacctacctttcatgtaatgttagtatatctctccattgagaggagagatcccagttgatcagcacacgagggtaaaatattaaatctgatgaaaattctgaatatccctaaagaaaaactatgcaggaaagctatcatcacgtcacgtaaaaactgcaccgaatttatcacaccaagttagggatttgatcctaccgaaagtacgtacaccgaccaaatttaataacataagtgtgacaacatatatacacaaaaatcatcaaaaggtgccttcacactgattttggcttctacgcctccaagacggaactgatgaggatatatcttactaaaccttgagttcatgaagcatattgatgttctacattacaccaaattatcttcgaccttccgataaatgtagtttgttgatgctttgtttctaattctgctttttccctttttcttttgggtaataactgattttgtcatttccgcaactcggcattaataagatttgatcgtccaaatccttcaactgacccggcatttttagaacatagttgtgcctcccaagcattcaattgcaggcatgatatgaggctgcaccaaggaaccttctgaatgtgtccaacatttgtattttggcagtgaaatgtctccaattccaatggactaatgtgctcaaacatttcgctgactctaggattttgcaagaactgcaatatgtacgcgtgcaaatttatagttagttactgtaggacggcattcatcaaatcgatctaatttgagcttgtaagctatttttttgactgaaagaaaagagagataatgaggcaagaacttacagtagtgtcacgttgtagggtgagcagggttcactttctcgccggtaaccgcgcggtaaccgcggttaccgggcttaccgtggggggtcggtaacgaaaaccggcggtagggtttgggcaaattttgctcaaattcaaaaatttgaaaaataatcgaaaaaaatcaaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctaccgtttttcccctctctcgcgtagctgcgctcaggaccgaaggggcgacggcgtgcgcccgcgccaaatccgccgccttcgcgccggcgaggccggttcccgcgcggtaagcggcggtaaccgcgcggtacgcgacggtaaccgcctgggtcgacgggcaagaggtaatccctccgttttgaaggttttcgcgcggttaggagcggtaaccatgcggttttgtacggttaccatcggcttcgtaatctatgagacgatatacgtatgtgcggtaatcgtgtgaaaaccgtggtaaccgtccaccctaccgtggttaccatggcttgaaccgtggtatggtattttttactgtgatatgcatggacatatcaatagaacatatttttaccaatatgcatgtgaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagtctcacgacaagacgaaaactttaggaaggatgttgaggagcgtggtggcacttatgagcatgccggtgggagtggatccgctcagccggaggcacggaaaggtagaagtaacccaattaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgcgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtagtacgcgaaataggctcggagcatgttgttcaaattatcacttacaatggctctaactacaagaaggcgtgcagactactacggcaagaatacaagacaattgtgtggcaaccttgtgtggcacacacagttaacttgatgcttaaggaggttgggaaaatgccagaccacgaaatggtgattgagagtgctaggaaaatttgcagatggctatacaatcataacaagttgcatgctatgatggtcttagctataggtggtgaactggttaagtggaatgctacaaggttcggaacaaactacatgtttctccagagtttccttagaagcgagatcttttcatgcaatggatggcttcctctgtcttcatgcaaagcaaatttagtgggactttggaaggtaaatatgcacatgcatgtctatctagtctgtcttggtgggagaacttagaggcagtagtgaattctgtccaacctatgtactcattccttcggtttgctgacgaggacaagaaccccaatttgagtgaggtacttttgagatatcagttgctcaaaatggagtacgacagtctttttgcgaatcaaagggacaagtttgaagcatacatggagatcgtgaacagaaggatgcacaacctaaccaatgagactctcatcaatgccggtaaatattgatcataacataatccacatggcatattatgtaactcttacttaacctgtgccatgttttgtagctgccgcattgaaccctaggacgcactacgcgtattctccaagtgctactgtcttccaagacctccgacaggcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttgcgttgcgtttggttggtcaatgttgctcctccagtggatgtgaaaggaattggagcacattcgcattcgtacatacgaaggtccgtaatagacttacccacaagaagctcaacaagctagtgtacgtgaattacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggttaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagaacctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatattgttattctggactgtattgttattctggacctacatgtggacatcgttatgctttgaaatgtgagattgatgattgttattgttgttataatgttatgaattattgtattgatttgaactccacaatatagagtaggtcatgccgaatttttctgttgtataaccacatcttaattaactaaaatactcacattttaggttttttctattatttttttcatttttcttatttcagttccaacatatcgcggttaccgtcgtcttaccgcggttaccgtaccaaaccgtgcggttaccgtgtccataccgtggattttgaattcaaaaatttggaaacgaaatttgtgcggtttttcgcggtaactgcacggttaccgcggtaaccaccataccgcggggggtcggtaaccccccccaaaacggtaaggtgaaccctgagggtgagtagtcctgatgcctcctacgccaagaaaacaactcattgtctttgtgaaacaagaaaggttcatcacatgctcttctagcctacaacacttcttctccttcacataatcttccaatgtatgaaccatcaggaccaagccaaagggctgtatatatatttgacttgatgatgatgcaattattcaagccatgggctggggaaagtatgccgaccgatgggatttatgaagataagatcagcgagaatgggtatacaatcgacaataggattaagggggtgtttagatccagcgatgtaaaattttggcgtgttacatcaggtcttatatagggtgtcacatggggtgttcgggtactaataaaaaaactagttacagaatccgtcagtaaatcgtgagatgaatttattaagcctaattaatccgtcattagcaaatgtttactgtagcatcacatcgtcaaatcatggagcaattaggcttaaaagatttgtctcgtaaattagtcacaacatgtgcagttagttatttttttagcctatatttaatactttatgcaggtgttcaaacgttcgatatgacaggttgtaaaatttttacgtgggaactaaacagggcctaaaaccatacaaaagtgaaagtaaaagacaactgaagcaaactgtcaatgctgcagactctcataagtcatagcatcccccctggcctacccgtgtacaagacaacactccaaaggaagattttgcacagctagaatcaacaaattggtaaagtaaaagctcccaatacctgccaaacctaaaaaaaaaagacattgaacaagcagtcacattatcatatggtgtactccaatatgctcttcttcgtcttatcttttatagagaaaaaggtatagcacaataattaaatgcactgtccaggtgaaaattccataggcttttctttggtatggaactagtattgatcaaggcctattagactgcaaattaaatagttgcaaacttcccatgtcgataggatcgaggaatagggtcaagaaacatgatacacaatggccttttacaaggtggggacgaaaatgcccccgtgttctaggccatgggatgacgtccttaggtctatcaaggttcgaccttgtttcttgtgatatttttagctattggctactactcccgaagagctgataatactaatggttttgaataaggacgcggtcttcgaaaaataaatttgaccaccattttctattataatatatatataatatcaataaatataaattttactaaagtactttttaacactaatctatacacattttgttaataatggaaatggattacactattctatacacatggttctatgtttatgacaaacattttcgaaattattcatactcaaatattttaaagtttggcgctgtctctgacggcagtagcctctcatccacatcctgcaacatgtcggtgtagtccccatggatccgcggccatcgccatccgccgtgatcagaaacagcctccggcgaactgatgtcatcaaggaaaaagaaaataaatggcgtataacaaactgttgtgtgttcgttttgatcagctcgtgttgaccagatttccattgacggtatatatatgtttgtgctgattagagagagattaattagtacctgatccctaccatgttcatgtcgatcagtggtgataattggtcgatctctggccagttccgagctgacggtggtaatttttttactttggttgttttttgctttgctcgtgtatgtgctccggtttcttggatggtggtggagagaaagattacagcctttgccgtagcaggctgttcattgcactccccttgtgaaagggcatgtagcctagtagttgcaatgacctgagtagcagcctaaggtcctgagtttaaatctccataggagtgaatttcagattgggttatttgaggactaaattccatattcaataggctaagttcctaatgagcaatgctacacgtactaaatttttcttactaaacttttactaacaatcatctcaaccgtttaatttaagtagatggaagttaaaaaaatctagatgcactcatagcatgacacatcagtgttagtaagaatctagtaagaaaaagttagtacgtatagccttttccgttcctaattaatttaaaaatgatgcatatatccgattggatgtataggcagggtaaaaaaaatacccttctctaaataaaaaaaattgtattatgttatttgagggctaaattccctgtttgataggctaagttcctaattaatttaaaaatgctgcatatatccgattggatgtagaggcagggtaaaaaaaacccttctctaaataaataaaattgtattatgttatttgagggctaaatttcctgttcgataggctaagttcctaattaatttaaaaatgctgcatatatctgattggatgtagaggcagagtaaacaaaaatacccttctctaaataaataaaattgcgctctctcttttcgttcttctgtcttggtggcgagcggcagtggtactgggctccgacgactgctccggacgacactctgccactgagagagatggggaatagtacacaagcaatgtacagttagttactacataggacattctcatctagctaggagaaatccgagattatgccatttgttaaaagtgcgtttcacctcaacgccacttggcaaaagggattcgataaaataccattcgttttacctcaatgccactcggcaaaatgaattcgataaaataccattctcaacctgtgaacagcacgctataatactatctgagaccaaattgtcatccgctcttcctcgtccttcaatattccttccaacgcgtggcaatgctatcgcgtcccagatcgacatggcgtataacctaagcacttacattgcatatgccataatgctgcatcgtataacctttcgaatgagaccaaccttcgtatttcgcctgtgaattgtctacaatggcaatggcacaatgtgctcagaaatttcgcaggcgcgcttggatttggcaggaactgcaatacacaagcaatgtatggttggttactataggacatatattcatctatagttgatctaattcgagcatgtaattagccatcttttggactgaaattaaccaaggagagatgatgacgcgagaacttactccactgttactctgtggggtgagaactcctgatgcctcgtatgccaaccaaattgaagcaagaaatgtactatgaaacaagaaatgctcatctcctatctagatttgaacatttctgttccttcacatgcttttcaatgtatgaactatcaggaccaaggcaacaagggctgtatatatatttgacttgatgaccattttgtaatgttatttcttattcattgtagaacctacctctctatctttatgtcgtgaattattggttttttttagaacatgtcgtgagttattggaggtgtaatatgttcacctcacttggaaggtttgacaaggaaactaaaagttctcatccatcctagcactctagcagggccgtccttaggggtgtgcggccagcgcgcccgcacagggcccccaattttcagggtccccctaagcccaaaacttcaaaactagatatacaactcaataagtaaattggtagcctaactagtctagaaatatgttatttttcttgttgtttcggcttcgattacacgcctttgccggttcgcacagttgcgccggttcgcaatcttgaatcgcctcccactgtggatctcgccaatcgccaatcgcaacgaacaagaggagtaaacgacgcctcacctctttctctcgtacgatcgtgccgcctgacgcctgctgcgcctctgacctaattctttctggtaatttctaatccggtaatccctaatattggattatcattttaggccattctagattgctatgaaatatattacggagaataaattattttcatattatatcattaattaagtttttatccttcaactttccacagggcacccgaatttgacgggacggaggccagtccacacctcgcctcacccctaaacacctaaatcctaatccatccattccaaaatataaatatagtaactattggctatgtatttggacatatcctcatacagatacataacaaaaatcactacactttaacaacaaatcaagtataatttttttttcttttcaatatagctaacatgaatatttgttatgaaactatagatctaaaacaatgtatcacagaattacatatttaacttcaattttatcacacaactacagctttataaactctaaattttatagttattaaataactttatcacaataaaaatgtggttgtgtaataccataccttataaataaatctatagttttgttaaattcgcctctctcttttttttaattgggccaaacaataagactcagtttcacatgggcttgaaatgggccttccgtgtggcccatctaaatagtccatctaaatagaacactcacacaccattcctctctcccaaacaccgccgccgccgccgccgccgccgccgccgacgacgacgaggaggaagatggcggcggcgcagccgccattgccgtggggggacctcccggcggacctgctgggcctcgtgctcctccgcctcccgtccctccccgaccgcgtccgcctccgcgccgtctgccgctcctggcgcgcgggcgccgcgcggggtcgccacccgcggctgcccccgccgctgccgtggctcgccctccgcgacgggggcctcgtcgacctcgacggcgagcccatccgctgccccacccccatcccccgccacggcgtcgtcggccacctcgccgtcgacaacctcgccttcctgatacaccgcgacggcggctgctcccttctgaaccccctctcctcgtctgcttcagcggcgacggcggcgatcacgcctctcccatggctgaacctcgccgccgtggacggagcgatcggccagccgggggtattcatcgggatcggggcctacgtcaacgtgtactccaaatcggtcctctcctcgccgctcgattcgtcgccggatcccctcgtcgccgtcgtcacatcgggcgggaggcacgtcgccgtcgccccttgcaagcggcgaggcgtggtcaccatcgtctccggcctcatggcgccacagattcccggactgaatcctactcggttctccgacattgcgttcttgggtggaaacctctacacgctcaccaatgcagaagggctccttgttcttgatctcggcagcaatggcgtcgacgatccaccgaacgcgtcgcatcgtcggtgcatcgccgatgatcccaaccagcatgagtattacatcgatgggagcactaagaacaagtctttggtgctgagatacctggtgggttccaatggcaggctgttgatggtgaggaggtggatgaactgtcggcagcagtattacgcgggtgacatggacaagacgcggggattcgaggtctttgcggcggtaatctctgatggccatggccagtgggtgaaggtggacagcttgggtgaccaggcaatcttccttagttcagagtgctccaagtctgtcactgctagccaatgtgcagatggaattcagcaagattgtatctacttcatgcataggatctacgacaatccgacgaaagagtgccacggcccatgtgttgatcctcttggtgactctggcgtgtacaacatgagagatgggacaatcaaccttttgcggcccagggcggtgatgtctgagctgcgctggaaacgccagtatctgacttggttcttcccttctgatgagtaatggtaactcctttctaagctgaacatgttgctctggtctggaatattggtatggtcgatatgtagccaactatgcagatgttaaaatccttttcatggatgaacgaatgttgaaagctgtgcaaaatttagaatcactgtgatggctataaattttccttgcaagctatgaaaaatatattgccttcaagcggttaggttaatagttggtgtgcaagaaatggctaaaatttgatgcattgaacattcatcagtcctgaatgaaaatttaagtatgtcttcatctgaaggaaaatgcattgaatgtcctgctgaaatactgatatttagatggcttaacagccctaggaggatcgatctgcatctgtccatgtgttttacattgcctaaaacatttttcttcccgcaataagtgcaacgatgaaaaacatgatcaaaaaaatcatagcgctgtactttcactcccgtagtttcttctgaactattgttcaactggaagcatcatatgctgtaaatagtccagctggaaggcttcaatggaccaaaagggaatgcatatctgcaaataatatctttaccactatacgattccatgcaatcactagtccagaaaatacatgcagtactgttcaattgaaattgagtattattgtcgtcaaattatattgaaaaaccttgatcggcaaaccaaattccagaaaggattttcaaacatcattttagcccctaggcaaaattactgatctcccttaaccaaaaatccttcttatttttcttttctaaataagttcagagctctattggctagacacctctaaaagaggacttctagatgctgatgtccatgcggacatagcagaatgagctgaagccctagcgcccgctaagtccagtacttctgccaacgcccacagccagctgcatgtatggaacattagatctctcagccagatctttacccctaagcggccatatcagcactgcgattgcagttcaatgcaacacctgccacagtcatattcttccctcgtaacagaagaactcctgatgcctcctacgcctacaatagcaacccaattggcctagcgtcatgagcctttcatttatctctctcttgctgtcagcttgtagcacttgtgctcgtttgtctattcttatatgcagcaaaaaggtgagcaggatatcatatatgaatgcacaatctaattcccatgcagttattcatgtttgcagttgagttcagtgtgcatctacagttgcaaccttaatccttttgatggttataccttttctttgcaagatacacaaaataggattgccttcagataatcaggccggcggtcagtgaagaagaaatgggtaggttctaactacaattttttaaaattttgtttcattatgtactggccaaattattaattaatcgtatgtcttaatctaaatgaaaatgtattgaaccttattaattgtctcctttctattcagtccaccgaatgctaggtagctctagaatgttcttagttagttttgaaggataatatggccatttcatggcaagcaagtgattagctaaatatgcatactatggtcaaaagtgataactaaacgtgaacagaggaagtaacaatttgcatggcatttgagatgttcacgctttagctcaaccagaatgttgctatcaacaatctatggcattgcatcgtagctggactcgcaattatgtgaactgtgcgtatcttcttgttttttttttttgggggaaggaatgcaaaagctttgcttttttttattaatagagaaggagaaaacccacaaaagtattatatacatggtctatcataaaaataatagacctgtaaaacagaacaaaagactactctctgaaggggatgatctctgtgattttggtggctcctgtcttgatccacgtctgtgctttttccttaatcttagtgacgaccatggttgttgtggtagctatgtgccagaagatattggcattgcgctcgcactagagcccccaagccgcaaggttttcctcgggacgtggggtatgcgtgatggcttgtaccaccagtcttctacgtttgtgcaatcgaccttcatgaatttggaggtctaggtttgcccatctctggacagaagtccagagtcttctcaggtttggtagaaaaactcctgatgcttctcagacctaccatttggtgtagcactcagcatgaccatgtagactacccaggtctgaactcagaggagagatccttatatagtcttaccttcatagcaaagagaacaaaagaaaaagaaaagaagagaagaggccaatagaaaagaatgctgcaatctggctacatgcatttagtactcaaaatcgggtggacataactgtctataaataagtgttaggcacttaggcctatatcttgcatgatcctgcagatgtattcgtctagttgatctctgcctattgaaccgtactcatctaggtgacacgtccagtctcaacaaggtctctgtatattaaaaagcatccacttctgttcatgatcagaacaacaagtagcagatgattatgcatatgcctgaacaagcactgaaaaagttttggaatcatttgcatataattaatataatttactctgtttcttctttagataatttactctgcttctacgtaggtacagatctgccaaccatattagaagagcatccaacatgccagtaatacatttttcatcaagttatctataaagcagtggcacattatcaggaaaaaaagggctcagaaaaacctttttttaataatccttcggttttttctaatgatggatattacagatattgtgcattcttatatttacacacaggtcaaatgaactcttaaaatagtatagagaaacttcagtcgccattgctaaagataatttatcagtagttctaacaccattggatttaagtaggcaaccatgccatttagtaatatatagaagggtcagttataacacatgaactcctgatgcctcctaagtctaccattgcaaatgtcattggaggcttggagcagcctgcatggactactgttcatgtctcaccggtagctttgcggcacttggttcttcttttacttctcttttatggaccaagacaagtcaccatatatatcttgtagggatgtattgtttggttcaatacagttaagtatgcaatgtatatagtcatgttcattaggtgagctagaaataggactgggctgccagggattaattagctgactaagggcccaactcatttcatgtttacttggtagttggtatatattaaatcaccatatctaatgagaattaaacatttttgctttacacagattttttaatctacgaaatgttgtctaaaatttgttctgccggaagctattctactctaaatttcctggtcgtaactaactttatgtattagtttctaaaaattgataataatacatcgttcaccattttttattctaccttaatttgtcaagattatggaaacagttttggagagctcaagttgggcaatagaccatgaatagatcctagaggtgcttcagcccttgtttagtttccaactttttctttaaatttctaacttttccatcacatcaaaacttttctacacacataaacttccaatttttttcttcaaacttccaattttagtcaaacttccaagtttgtcaatatctggaagatgcttaccaggacataactaaatgtcatcatgttcaggtctttcaactcatgacaaagtagtgtgaaatgcaccccatgagctggccacaagtgacaaactgccagtagaactcccgatgccttctatgcctatgatttgccaggaaatgctggagctatttgagctttaacatccatatgaacctgcactgagcaccaatcctcagattttgtttcaatccttttatgggccaaataaaatattgtgatgagatatactatctgatgatctgatctttcttaagaagaaaggccagaagttctggtattacaagatggtcctcttgattgtccaatagggggaagatataggggcaactgcctgaacaaagaaataaaggagacttcgggaataattttattgtggttcaatgtgcacctactagtttaccagactacatactgaatgtatgcatgccccactatataaaaaatttcagtgggaagccctaaatgccccatggttaattaacttcacttgctagatggtgattaattaaactttcagtgccttcagggccatctgaatgaacattaattagaaggtcgagataaaattaggtgcactgaaacatggatatagggacggtccttatcttcaagaattttttgaataattgtctagtggaaatacaaaatattcagaagatgtatggatatatacttgttgcacctagacatgccagatcgaaatcgccacttagactcttaacagtggaatattattatgatcattcaacctgttacaatcaactagttagtctataaagcattccactagccagtatgtttaagcatagtaatttacagtccttgaaaaccaccaagaggcatcaaaatgtataatttttagtacaaattttgatacctcctaatgctgtaggtaccaagtgatactaaatgttataataaaaaaatgtggtaccttccggtacctttttgattgtaatttaaatcactcttaagcaactattgactcaagatcaccaatgcaaaatgcgcgaggcaatgctacaggttgttgtagcgctctgcttaacaggctagttgttgtctatagctagaagctggatctgccactttggcgttgctcatcatctctaccaaaggcacttttgctgtagatcttctcatttatatagttatttgagagcagaaaagatcacattctcccatgctctcacatactcaatatatatgtacccaattgaaattcatccgttcaagagagcgatcttcaccgatcagtggcgaacccaaaataaaaatatttactgcgttcttttgcagtagttcccaacttccttctctctttttccgcgcacacacttttcaaactactaaatggtgtgtgtttttgcaaaaagtttccatacaaaaattgcttaaaaaatcatgttgatctattttttttaaaaaaaattagctaatacttaattaatcacgcgctaatggaccgctcggttttccatgcaaaggagatgggttcccaaccccctccaacgaacacatcctaaattactaataatctctgataaactgattaatacagtataaattagctagagttgattaattacccagtatcctattgccccaagaattgttggaaatatggtcatatattggcatattttaatctaaaatgttaagacaataatcatggcataaacagtgtggggtgatctagtgacaacatgtagcataaccagtagcatgctaaaggtatcatacgcatcatgaacgtcatgaacatgaacatagcaagaacgcaattgacttgcgactaacaggactaacagcgctatgaacgaatgggttaacagcaggagaaggatataccctgagaatggccctccgctggattgtgaggcagaattgcctccgttggtgttgacgttcgcggctccagctccaggcgcgccatctccggctctagctccaggcgcgccatctccggctccagctccaggcgcgccatctccgactccagctctagcagcagcggcggctccaggcgcagacatggtggacgagcagtcgtatgggaagcactccccaaaaacctgatcacccgcctacccggtgcagatctcaggcgaaggtgtggttccggaggccctgctccttccgatctctcgtgtgcgcaagcaatcagaagcgaggaggcgagagcagcacaggcgcgaaggaggaagaactaacacccgggaaagaagcaagcagttcattctgatcggactagcggcctccttctatagcaggagagaggcagtcgtgggaacatgggcgcaaaagaatagcgacatgatgtgacgtgacgcacgcccgccagccacgcccacgagatcagaagcgaggaggcgagagcagcacaggcgcggaggaggaagaactaacacccaggaaggaaagaagcaagcagttcatgcggaggaggaagaactaacaccattctgatcggactagcggcctccttctatagcaggagagaggcagtcgtgggaacgtgggatcgtgggcgctattctgatcggactagcggcctccttctatagcaggagagaggcagtcgtgggaacgtgggatcgtgggcgcaaaagaatagcgacgtgacgcacgcccgccccgccccgcccacggcctcggcccggcgcgcgcgcgcgcgtggctttccaactcccacctcaaccggttaacaaggagcctccaataactccctatttaggttgagatactcctcgcttaaatcctgaggtggtattattatccttaacacttattatgggcctttgagatttaataggataaattgggcctagcccaattattctaataagaattactatgtggaaacgaacatgttggtaaccccgccttcttatagaatcaaaggccaccaaaagtaacagaagattagctcctgatgcctcataggcctaccacaacaaaagtcaccaggaatcatctccatgaactgactactaattcctctcgtcccttgcagcacttgtgctcatttcttgatgtgctcttttatagacaaaaaggaaaaaaatatcatcatattacacaaggatgtactatttcatcccatgcaattaattacttattcaatatcatgcactaatattaatttcagttgttcattgatcacttcttttttttttgttgcactacgcatgctagtggagcccacgagcagacagggatatcggatcgcaacaaaacatattgtccgtgcagaaaagatggcttttttttacccaaattaattgccaatttaacgttcctctggaaattaatgcaatatttgacaccttgtaattatgtatcactgaagtgttttgcaaccttgacagccaccagattgcatatttctgctgccgtttaattacttagaacaactcaaggttttccacggtgattttttttctcaaaattcctacgaaaatgcatgcacgaaaacacactctgtttgtgtacttttgttttccattgcctagttaaaacacggatgtctctctctctcccttttttttcatattgtaattaatcagtacaaccaagaaaaacatgatcaaatcatagctagttgcatgcctgtattttgtgtttcccatagtttcttctatggtattgttcaattggaagtgccatatgcagtaatctgtcaagcaggaaggctttcagggactaaaagacatctgcgatcgatctgtgctactctatgattccatgatttataactagtccaaatatgtttttagataatgtactagtccaaatacatgttgtatcgctcaattgaaagtgattagtattgtcttcaaattacatcgaaaaaacatcatcatcgatcaaaccaaaattctgaacagattcacaggcatcatagattttgatgggcaaaattctgatcaaaattcttcacccatatatctgtacgtccatagatttgatcaaaattcgatctatatatggacgtaaaaatttgatccatcgtacattttgcccatcaaaattcttaaccaaaattcataggcatgaggatttttatctatgggcaaaaggtttactatacatcaaagagtacatcaggacgcaaacctttatgcgtcttcacggcagcatccatgtatgaaacattagatgaggcgacctgtgggcaggcggacgacggcttgaaccgaccgatttcgacgaacgagtcgtccaagtgggtcgagatggttgatatcattttgctaggcggcttgaacctggatttggatttaacatgaatattcctctaaatggaccatcccatcctatccatctccaaatcaaacaccaagaaaagtgcgttcgtcctatcctcatccatcccacccctccaactaaacacaacatcagtcattccatcactgttttgtaccgctgtcaacactgctctggcagttcaatgcagcacctggcacagaggtaatttcgacgagtaatagaagaattctcgatgcctcataagcctaccattgcaacccaatggcctagccctcatgactctttcacctccccccccctcttttcttgtagctttagatatgtgctcgttcaactattcttatatggagcaggaaaaaatgaaggaaggggagatataatttatgaataatgaataatcctattttcagtgcccccttattcaagtttgcagctaagctcattgtgcatgtacaagt

SEQ ID NO: 72590 - DNA, 2552 bp, Oryza sativa
acatatgctaaaaaatcaacggtgtcaaacattttgaaacggagggagtataatagtttgtttaatgataaatctagaaacatcaattttacatgattgatcttttttattttttattatcaataggcaaaatttaaaatgtttgatttgatactattctaaaaatatttatattttaggatatagtgtctgtatgtttccaagttgcctcctgtaaatattttcttcatccattccatattataagtaattttaattcttttatcaatcaaatattttagtttaatcaaatttatagaaaaatattttaatattttaaatacaaaacaaatatattattaagatatatttaatcttacatctaacaaaattaatttagtattatatgttgttatttttttaaagttaattaaaactaaaaagttttaagtagcaaatagtaaaagcgatttataatatgaaacaaaaacagaggcagcataccatactgtctatacagctaacttttgtaccaacctatattcctttaacttttgtaccgtttataaacgctacttctccaaatatgctagtactaattgatagtacatctcgtctcgatcacactctcttataagctcgtgtagatattactccctgtggagattatgggtaccccatacccacacagcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacatgtctaaatcctttgtctccacatccatccacttttaggtctcgtgcgctaccccgttttattattgccgaattcatgtttcgacactccctttcactctcttttttcattaaatctcttaccacaatttcataagcctagcttactccctgtctttaaaaaggacaattataccatttacattttagctttttttttgaaaaccacattttagcttaaaaatacaattctatggtattatcttccccctctaaccaccctcatatagtcacatatttaaatttcttcccatcttattattaacaaccctcctacgactctctcctgttcctcacttacggataccgtccaagtcatttttgtatcccagttattttgtttttttaagtaattgacaacccattttatttgctgaacacatcatcctacgtggagtattaattatgatctgcaacacccttcctttaatttagatgtgttacactgccgcatgcattgatcgttctttgtagcaggtgggtactcggttaaggctgtctttagttcacaacaaaatcgaaagtttggttgaaattgaaacgatgtgacggaaaagttagaagtttgtgtgtgtaggaaagttttgatgtgatggtaaagttggaagtttgaagaattattttgcaactaaacacgacgtaattacactagctagctctctaaattattagtccctccgttctactccatccgtcccacaagagtattcctagtatcccaaggtaaaactagtggagagtaaaaaagactaaaatatccctcattattgaaaaaaaagttgtaatggtgatagataggtaaagtgtatttaagggataaaactttcttattttatgtgctaagcctgagttcagatgagggggttcccaacccctctccctcgtattccacgcgcacgcttttttaaacggctaaacggtgtattttttataaaaagtttctatatgaaagttacttaaaaaaatcatattgatctatttttttaaaaaaatagctaatacttaattaatcacgtgctaatggaccgctctgttttccgtgtggaggagttgggttcccaactcatggtatcgaacacagcctaagggtagatagagtggtagaagttggtttttttggcacaaaatttaaactccataagttgagtttttttagacggaggaagtatgatataagatttacccttctaacttgtctcacaataataatatatataagggattttattatcaagaatactttatttcccatttatcgagtctttatagtttattttcccagctatctcttgtgctactacctaattatcaccttgtgtactacggcaaattggcacgttctttttctactctcttcatttcaaattaaaatattctctcatattcatattcgtaatactgggatatgtcatatctctatactaaatttatttattttgaaacgaaaaggatacttccttaaattttattatataaaagtaatatactccttccgtctcataatataagagattttggatgga

SEQ ID NO: 72591 - DNA, 5532 bp, Oryza sativa
tgttgggcgcctacgtcttcaccgaccggctcgcctacttcgccgccgactggtgtccacgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgcctttgccgccgctgactggtgtttccgcctgcacggctggcctattatgccgccattgttgggcgcctacgtcttcaccgaccggctcgccttcgtcgccgccgaccggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgcctttgccgccgccgactggtgtttccgcctgcacggctggcctattatgccgccattgttgggcgcctacgtcttcaccgaccggctcgccttcgtcgccgccgaccggtgtccacgcctgcacggctggcctattatgccgccgttgttgggcgcctacgtcttcaccgatcggctcgccttcgccgccgccgactggtgtttccgcctgcacggctggggcgcgtcttcaccgaccggcttgccttcgccgctaccgattggtgcttccgcctgcacggcagacttattatgctgccgttgttgggcgtctacgtcttcaccgaccggccgccgcatccgcagctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctcaacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgctgttgatgggaaacttcgtcatcatagtcggctatctctgttgccgctaatcatcattaccgttggatgcgtttgtcaccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccatggttatgcaacttcattacatttgattggtggtatctttactaccattgacatcttccgttacttccgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgttcaaagactggaccaattattattccccgtaaaggttatcaaccgaatacttgcgccagtcgggattcaattattatatttattttggagtatcccataagggataatcattcagatcagaagctattcatatgagctacacttggtctatattactcggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccccatacccacacggcatggttatccgactagttatagaggataacttatatgtatggaatatgtaacagatcatgacttgggtattacgtttccctgtatattatggaacggcctaaagtcctggtttgataagattgtaaagtagatttaggaaaccgataccatattggttaaggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacacaacggctgggctgcccctgcctggtgcgctcgattcgctcgacctgcactgcactatacgtacgtacgtactgcaccggaaatgtatacgtactcgatactcccatgtacagtatgtacgtggtgcacatcttgtatagttgtgggctctccttttgttctaaaatataatcatatcattttaggtaaatatcattttaggtaaatagctgatacagttcctggagtttcgctttagactcaatttagtcttttgggtttcaaatcgtctaaacaagtcctccaaattagttatttgggttaatatggtctttggaaccgcaaaaaatgccacgtgagcatgcaagtcatcatcgcatatagtggtatagatgaaatggccattctacccttatataccatatacttcatccatttcatattacaagactttctagcattactcacattcattgttaatgaatctagacatatatgtgtgcctatattcattaacatctatatgaatatgggtaatgctagaaagtcttataacctgaaacggatgtagtacaaatgaaagaaaaaaaagaagataaatggttcacatgtgtatgatcgtttcagaattgccacttacgattgctgcagccaagcactgatcgcgtaaattcctttgtcggccacctatccgcaacaatgctgggcctgggctggcatgttattttttttgtttgtcttttccttcttttctatatggtatataagggtagaatgatcatttcattcataccgctgcatgcgaggatgacttggtatgctcacatggtattttttgggtccaaggactatattaatggttaatttggaggacttgtttggacgatttgaaacatcgagaactaaactgagcccgaagcgaaactccagagactatattggctattcaccaaatcatttttagaatagcgtctagtcaaacattttaaactttgaatattatagtaaaaaaataaaaaaaatcaatcatgtaaaattggtattacaatatttatcattaaacaaactatcataatataactctttttatttaaaacatcttacttttagatatattattggtcaaactagcatttcaaagattatgtcaaaacaaatactcgctccgtcccaaaatataaacattttttaacttcgacacgatctttgggatgctactttgaccaacaaaatctataaaagtaatatgtattaaataaaaaaagttgcatattactccctccgtttcaaa

SEQ ID NO: 72592 - DNA, 10997 bp, Oryza sativa
gccgccaccggcaccggcggccggccaggtgtacggtacgtgaggtgtttggtgttttgtctccggcgacagccagccgccggccactgcgagcgtgacgcgtgtccatatcccacagcatctccgtacacatacggggtgacgtcatccacagctagcgcacccggtaccggtagtactaccgccgcgcgtacgtcgagccaaataaaaacgagaggtggtcccgtggatcggatccgggccgtcgatcgcgccatcgacggtgtcacgtggatcttccaatcctactactagtatagtacgtgtcgtgtctgcgtgctgctggatgttttcctactttcctttggtccaatcgctatccaattcagcatccagctagcagcttagcttttgcaacgacaaggtattatttcgtcaacttgtgtgcacgtttgtagctatagctttgggctcaatcgatcacgacgtactctactacactttacataaggtggccaaagagagtggtactgctacaccaaagtgcagctatagctattttttgctgctgttggccatgtttgtatgcagggatgatttcagtaggaaaaaaagttcacttcttgtagtagttcaacatagctagaaatgctctcacatttcgtagatggggcctagatgatgcttggagcctacatttcataggtagagaagagagaagattaaaaaaaagaaaaaagtatatattttttttgaaattttaaggtagagataattaagaaaagataaaactagagagaaaaagatgttttttaatttttttttcctatttgactgacatgtagattcttatgacacatactcactccgtccaaaaaaaaactaaacctaggagggggacaatgaatctggactaccctttgtccagattcgttgtccttaaactaggaaggatcaaattccctcctaggttgagttttttttggacggagagagtatgtgtcaccgtggcatgtcacatcagcgcacggagtgagatggagcctgtttgaacatgtatgatatccaagaaaagtttcgggatacggatatgcattttaagatttcatggatctaaacgtaaaagtttagaaacagttcatatacttcactcgagatcagattcatttggtgctacctaattaattaggctgagtagtgcagctgggcattatatatgatctctgcaccaagaaaagtactgggtagctacatatggggttatggtttgtccttaacgaattaattagttcgagaaaccgagtaactgatcagtgcgtacatctctgatatatgcaggttagttattaacctagtttcaattcattaaggacaaaccattcatgcaattacatttgctgggtttgtacactgtactcacatgcaacaagatatgccaagagctagggagtactacagtactcattagtgatcgctagctaggtagagaccatgcattcttgcatcaaaccaccattcttgcaattacatgcatgctcaatcatcaaaccatactaccaacaacccaacaagaaggacgaagagatgattaactaattaattgattaacccttttctgaaaggccggggtccagtcaccgatcatcagatgacacacacacacacacacacatatatactactacagtagctgtagcaactagcaaagcaagtggaacagagatgaatctttctgaaaagggtcattcgatcacctcgtcatctagctagcttagctacctcagctactgagtgactgaaagtgacgtcgtagccatcgatcgctcgctcgccggcgatcgacgacggcgagatctaccgtcggcgtccgtcgccaagcttgcggtggtcgtcgacgacgacgacggcgacggcgacgttgatggtggcacatgggcatcgaccgatcgatcgctttcacggcggcgccggcgactattcaacgcggaattgaaacataataatgcatcggagcagatgagatcagaacgagatcgcagcaatagcaacaatctgacggcgtccttgatggctctgttcccccgatcgatttgctcctcctttttggttttttttgcccaatcgttggatcgatcgatcgatcctcatcaatgacgatatgctcatgcatggaccacgacaagggcctagctaccctagctatagctatagctactgttttattgagcggaattcgcaatcagtaaaagctagcagcggagatagctcaatgcgataattggattgatttgtcaaagtgaggcagtacatgtaaacacggctctttacaatatccactcaattaatgggtcgatcgatttcttagaaatagaatctactccctccctctaaaaaagacaaaccctgaatttccatgctcaacgtttgactgtccatcttatatgaaattttttacaattagtattttcatgattaatactttatgcgtgacttatctttttaattttttataatttttttaaataagacggacgatcaaacattaaacacggaaatctagggtttgttttttttaacagagaaagtagataagtacataccacatactacctttattcgagaatataagagattttgcctacgtgattaattgcattagcaaaatcccttatgttttctgacaaagatagtagtacgaaaccaccatatccatctcgcgatctgtgctgccgctgtggaaaccgatcgatcgacaaagagtcgtttttataagtcgtgattgcaactgatgatcatgaatataggcaattagcaaaagctcatttatcggtttataaatgagagatcgacctgacgaactcaattaaagtagagagattaaattacgagctacggctcatcatcgatcatgcagtagctaagacggccaccagccgccggcgatcgtcgtcgtcgtcgcccggcgacattaactgctcccgggcgtctactgttcctgtgttgcgtggccgcatccaacaccatggatggatgggtgtttcgctggagggagggagggagagagctaggagtactaactccataaaaaagaaaaaaaatttatagcatcccaagataaatttagtgagaggtaaaaataaccaaaataaccctcatcaatggaaaatatagtaatgatgataggtaagtaaaggatatttaagggataaaacttctcattttatgtgttgaaacctgaaggtatgtagggtgatagaagttggttttccgcgggataaaatttaaactctataaggtcccatttgtttctccaacaaaagttggatgaagattaagatttttcgtgacatgcttttcaaactgctaaacggtgtgtttcgtgcgaaaactttccatatgaaagttgttctaaaatatcatattaatctattttttcaagtttataataattaaaaatcaattaatcgtacgttaataccatctcattttacgtaaaaaacttaatttcatcttcaggagaaaagaacaccacctaaattgagttttttttttatttagggagtagctagctagctaccaaggtagggctactgtgccgggaaaacgatgcttcactcggtcactttcgtgaccacgtcccagaacgccgcaagcacaagctaagctatgatccactagccaagcttcaattaatgttctgggttgttcagctagctgtcgaatgcgatgacgatttttacctcctttcgtaccaaaataactacgataaaaaatattattattttttcgtttaaatcgttctagaaaatacaatgcacacacctaatatgattagatattttgaggataaaggatttaaagaaaaaagatggttatgtcttatatttgatagggagggttgtatctacatactaagagattgggcgttttactgatatttgtattatactgaaaagagaaaatatctcaagtctaaattttacttgcttattattttttgaaaaaataattaaaatacttgaaatatgttaatattatcaaggtgcgcggcgtcacatatatgactttcactcatccaatataatcatttatagtagtatgtggtcaaaaagtgggacagccatagttaattaaaagtggtagttaaagaacgaaggaagtattaagggcctgtttagatcctccaaaatataaaagttttgcagttttggaccattttttggcaaaatgaatctaaacactagtagcaaaaaataggcaagttggcatttgtcatttgggagtacatagcagcaaatttggccaaaaaagcatagggccccgtgtatgagagaggcaccagcaattaatggtaaaactttaccatgcatctaaacgccaaccaacttgtaaaattacaatgccaaatcttttgccaccaaaacttttgccaaaaaaaatttgccgcatcaaattgatctaaacaggccctatgttgtattttattggaatccgtaccacacgtatactttcttagccttagaataaattcatttttggctcctttcgtttattctaaaataagtttatttttcagtaattattatatcggagttgataaaagtataaaggaaaatacattgagagtaaataaagtggaataattacattagtatttgataatgtgggtgtattctagtttcttttatttgtatggtttatgtggaattggctaaaaagtaaagttattttgagatgaagggagaactcaaaataaatataactaaagagcgtaggtgcacatatattcacttcgttgcaaattgatattccgtatgaaaaggagcatcccaaggtttttataggagcgaattttaaattaggttattatattgaatttatcccttttattcttaatgtgtgagttaaatttaggcttaatttctctctgattttatagactgtcatacatatgttgtatgaatatttgcaacttattcttaaaaaaacataactatttggataatgtttgaggaaacaagaggacatcctctttgagagtttacaagtgtgttttcccattgtaaaactgcccaaaacccctacattatgctgtaggactagtaggtgtgtttgggtacttaatttggtgtggtctaattaattacacgctctagggaagttaattgttatggtgagctagctagctcattaattgtctcgtaacaaatcaatgtgccattgttgaggaagaaaagcaaacagtacctgcagcaagcaaaaccgatcgatatgtgtcctggttttccacactgaccagtacacattttcagttgcctccttgcttgggaagaaattaactactgttcctactatctgacatatatatataaggacagctgatttttcaacaagtgtgaattcaccgcgcaatcaatagatgtgttctaatcctactacgggtgtgtttagttcatgctaaaattgaaaatttgattgaaattagaacaatgtgatggaaaagttggaagtttttgtgtgtagggaagttttgatgtgatgaaaaagttgtaagttgaaagtttgaagaaaaagtttggaagtaaacaaggcctaattaacatgataacatcggacttttcaggcaatcaggctacaggagcaggaagacatctgcaggtatacgtatgttgcttcccgtggatattattagtagctgaatcctatgaaaaaaatatgataagcgactaacattaggaacgatctcatggtagaggggcgggactagaatttaatttctcaaacctatagctggtgtactattatagtttacacataattgtatatttaattatcttcaagcttttgaagtgtacagtataattcaatgggtgtttaggctgtgtttagttcacactgaagtttaaaagtttagttgaaattggtacgatgtgatagaaaagttgtgtgtgtatgaaaggtttggtgttatggaaagttaaagtttagaaaaaaaaaactttaaaactaaacagggcctaattaggttcatgatcgagtaggactacttacggcgcccttaactgtcttattagctaggttaagctaattacgttccgttgtagcagataaagagaagaaatctctcgtgtgttatccacatcttatggagaggcgaacatgggaaacaaaaatcatggtggctcacatgatgacgcggatttcaggtcaagtatacgtactagtatcgatgacgttgtacgtgtacacacaatacaatatatcataagggtagagtttacgtacgtgtatttatataggtgagtgtgtacattgtgagtgtctgcgttgtactgtgtattttttttaaaaaaaattggtgtatgtcacattctcttttagtttttttttttaacggaggagaacaacgccgtaatacgcacctggtccattgtgtatagtacacgatcgacgacgtggcatgcagggaccgcgtgtgcgtgcgtacgtacgtcgcatgtggtggctggcgtccgtccgtgcgtgtctgtctcgaccgcccgcgcgcgcgtggtccacgtgcggtgcggacggcgcagcatcggtcggtcggtcgatcggtccgtccgtacacgtgtgggtggtggtggtgctggtccagtgaacgaaccagttgggctggacctggtggaccagatcgagcgcctgtcactttgtctggctctgccacgacacaacgtgtggagattatgggtaccccatacccacacggcatggttatccgactagttatagaggataacttatatgtatggaatatgtaacagatcatgacttgggtattacgtttccctgtatattatggaacggcctaaagtcctggtttgataagattgtagagtagatttaggaaaccgataccatattggttaaggtttctatcttgtaaccctgccccctaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaacctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccaccggcctgcctccgtcgccgccgattggtgtctccgcctacacggctggcctattatgccgccgctgttgggcgtctacgacttcaccgccggcctgcctccgtcgccgccgactggtgtctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgtcttcaccaccggcctgcctccgtcgccgccgattggtgccttcgcctacacggctggcctattatgccgccgctgttgggcgtctatgacttcaccaccggcctgcctccgtcgccgccgactggtgtcctcgcctatacggtcggttggtcacaccaccgttgatgggcatcgtcatctacaccgccggcctgcctccgtcgccgccgactggtgtcccagcctatacggtcggttggtcacaccaccgttgatgggcatcgtcatctacactgccggcctgcctccgtcgccgccgactggtgtcatcgcctatacggttggtcggtcacaccaccgttcatgggcgtccatgtcttcaccgaccggctggccttcgccgccgccgactggtgtttctgcctgcacggctggcttattatgccgccgctgttgggcctctactacttcaccaccggcctgcctacgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctgaccttcgccgactggtgtttccgcctgcacggctggcctattatgccgccgttgttggatgtctacatcttcaccgttggctcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattgatcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggcgctaagtattattcggaataaatcaaaagcatagagataagataatttattttctactcttaataattgcaaaagtacccgagtagtaaactccgatccgtgaaactttgttccattaatgacgaactcatgtcactcatatgcatgtttgggaagtgcttaggccgactcccagtgcttggtggccatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttctcgcctgcacggttggcctattatgccgccgttgttgggcgtctacgtcttcaccgaccggcttgccttcgccgccgccgactggtgtttccgcctgcacggctggccttttatgccgccgttgttgggcgtctacgtcttcaccgaccgacttgccttcgccgccgccgactggtgtttccgcctgcacggctggcctttatgccgctgttgttgggcgtccacgtcttcaccgaccggcttgccttcgccgccgccgactggtgtttccgccagcacggctggcctattatgccgccgttgttgggcatctacgtcttcaccgaccggccgcctcgtccgccgccgactggtgttttcgcctgcacggctggtctttatgccgctgttgttgggcgtctacgtcttcaccgaccggcttgccttcgacgccgccgactggtgtttccgcctgcacggctggcctttatgccgccgttgttgggcatctacgtcttcaccgaccggcttgccttcgccgccgccgactggtgtttccgccagcacggctggcctattatgcagccgttgttgggcgtctacgtcttcaccgaccggccgcctcgtccgccgccgactggtgttttcgcctgcacggctggtctttatgccgccgttgttgggcgtctacgtcttcaccgaccggccgcctcgtccgccgccgactggtgcttccgcctgcacggctggcctttatgccgccgttgttgggcgtctacgtcttcaccgaccggctcgccttcgtcgccgccgactggtgtcctcgcctgcacggctggcctattatgccgccgttgttgggcgcctacgtcttcaccgaccggctcgccttcgtcgccgccgactggtgtccacgcctgcacggctggcctattatgccgccgctgttgggcgcctacgtcttcaccgaccggctcgcctttgccgccgccgactggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctattat

SEQ ID NO: 72593 - DNA, 10802 bp, Oryza sativa
cgagctgtacccctcgccgccatcgccgccggacagcgctaacccgcgaccccgagcagcctccgccaccgttcatcgccatcccgccgccccaagctgcgtccgccaccggcgccgtccaacaccctcctcggcgccgcccgctgccggcacatcacgcgacgccctcgtcggcgctacccgtccctgcgcgccgctgcccacgcccgtcgccatcccgcccccccaagctgtgaccgcccccggcgccgtctaatgccctcctcggcgccacccaccgccgccgcatcacgcgacgcccttgtcggcgccgcctgtccccgcgcgccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgcctccgtcttccgcgtgtgcctgcatgccgccgtccatcgcccacgcccatccccatgcgccgccgtcttccgcgtgtgcccgcacgccgccgcccatcgcccacgcgccaccacccacgcccgtccccacgcgccgctgcaacgcctcagtagcgacctcactgttaaaggaggaagagagaggaagagaaaaggagatgagggcaatttggtcatgccatgtaaaaagtaggccccttctcgcttagtcagcacaaaaatattaatttaatgaatgcagtgtcccctgataaataaccacattttgagagtgtctttccccaaaagtgacttcgtgcgatgtcctacagctaaaaccacaaagtcgctatgtcctgtagcaaaatttgcctagtttgtatcatgtactagtttcatgtatatattaatttattttttaaaattgtggtacaacatctttaacacacaccgataatatgaaagccagcgattgatcagtggtctcgttgaaatcctattgataacgcaacgccacggacttcaaaaaattttggcatagacatgttaattctttgacttgatccttccgtttagtgtttcttatgattcaatttttatacgtagtaaatgttttttaggattcaaattctatacacaatatatgtatttctagagtatcctatcaatcatctgtcgattaaatttctctctgtcataaatcaccctccctcctcgaaccacacctcatttaattaggaacactatagtaactttttctcagatctaatcttcactaaacaacctagaaatgtttatagatgagaagttgagaacggagtgagcaattgtttatttaatttctaatagtccttctttagccaaatgttttagaacgctgtcatagcaagatatttgcggctcacaaatcatcactttatgagaccgttatttctaacttaaagtatatattgcctagtgctttgcctttttatattggagttgcaaagattccggagaaaagttgtctttttatcacggtggctgaataaattatatgttaacacggaagcctattttgtctttttttacggtcaactataatttttctgacttggacatcatctgttctttttcttgagagtagcattttcaccattttcaaagtagcataaaaccatcatgaccggctaccactaagctgcgcctgtctacttgtcaagctctacaaaaccggtcacagtttttttatgtatatctcttctttccagaaaacttgctctcactgacaagtgggacaagccactacaccctccttctgggcccacctgtaagtgacccattcgagaatatttacgcgagggatctggtacgcctaacgataataccccaacggctacagttcccattcgtgattccacaaaagacagccagattcggagattcccctcgggaccacgtgccgaggcggcccatccggcccggtccggacgcatccgcgccgtccaaccgaattcacccccgcatccggccgtccactcgccgacggctgagatgcgtcccccgcctcgcttgatccgtttcgtaggccgacactttgcccgccaaatggcacgccaccgtaattaaccccgaactccgggggccaaatatctacaaaaacaaagggtatgggcgtgaagcctagaggtaggggggctactcgtagcctccgttttaagtacaaagactccgaaccaaaactccacgcgatttgtttagatcaaacgggttcgtaaaaaaaaagttttattctcgggttcgttgggttttatctatataggcggcgagcgagaccatctcattcagttttattccgcgcgcctcctaaatcgcgcttaatccggcgcatcctgattcagagagtggtttggattcgttggattcgaggtgaacgaacagggcgtggaattttcgaggactctctcctctcgcagaatcccgcgcgcctcctgattcggagagcggtttggatttggattcgaggcgaggaattttcgaggactttggcagcggcggcgggggctggtgagcttctgctgcggcttggagtctgcccccaccattgcgtggggaggtggaggtggaggcggtggtggcggcgggggcggcggaggacgatccttccgcggcttcggtggcaggtgagttcgccgggttgggttcggatttcgtctggatttgtgggggactcagttatgggtggtggttgcttgcggtggttgtggtggcttggtcgtgttgaggtgtggggtctccttcctggtcatctcccagggcctctcgatcggatcctcctcgggagtcgggaatgcgaagctgagtgtgacgcgtgcacgactctcgagggaggaattcccttggtgatcgtgctggagttcgtgggattcgtcgagcttttcgatcctctgctgaaaaaaaaaagtcgttctctgtcagttactcgtttcgtttcaattgggtgagatttttttcctggctcgatttgtgcaggtttgatccaaattgagcgccctgaggatttggggcgtgtttatggaggattagatcgagaattttggttgtttctgtgagatggccgccgattccagcatgggattccatcaggggatcacggcctcgatgtacaaccatcacatgctctccttccaatctaacagcgacttgggcggtggcgccggcgctgcggccggtatggtgatggccccgaggagcatgaacgggactagtagcagcgctgggctgttcgtctctccgaacaccggtgtgctgggcaacgcatcggtggccggcccgtcgaggagctcgtcgggggatgcgttcagtagcacggtggcgcccaagtacaagttcgtcactggttcgccttcagattggaatgaccgtgagctgaacacactgaaggaagggcttgtgaggtagcaaatccctattccccttttgctttctgaattgctattgcctgtgctgtgctagtgtgacttgttgcttgtgcggttgtggctgatggaattttggttgtgcaacaagccgttttttctcccctcttatgtttaatggagcatcaatccggaacaggaaatctggagctggattcattcaattgaaccctgttaccttttgagttgagagcaatatcaatgaatgttctatagcacttttgtgattatttagcgtacttgtagaatcattgttcttaaccatagaacgtctttttcaccgggccagcgaaaccataaaacgtcttggtagccacacttgagtaccttacgactatatgtttgcactatagctgattaataaagtcactatccggtttgtcaatcttatctggggaccagaccatttcttttcagttcctcataatttcttcaatcttactggcagatatgctcgcgaaccgaatatcatgaagtacataaaaatagcagctatgctacccaacaggactgtcagggatgttgcattgcggtgttggtgggctacagttaagttactcttttcaaatgtcacattatctcttctgtttccttgttaacatatatgttgattctggtcatgtgcaaattgggtagaagaacttcttaacttcgctaaaaattaagtcagatgtacactgaagaccaaaattgacaccacctagcaccctcaccacattgctcttttgactttttgatagaggtgcttaagcgcttcatatatttaattttactttttataatcctttatttccttttgtgactgatgtgataatttgccatctgccaattacattctagatgtaggctgactttagtcccaaactttttcttcaaacttccaacttttccatcacatcaaaacttccctacacacacaaacttccaacttttccgtcatatcattccaatttcaatcaaactttcaattttggcgtgaactaaacacacccgtattgtaacttggagtatacagcttttaaagttctagcaaacgatcaattccaacaggcatatcaagtatacacagcatttaaggccataataatgacctgccctggctgaaatagacactttgtttgtttgttttattcttaatacaaagctgttcattgtggtttcagactggaaatagatactttgtttgtttactcccgttaataccaaaatgtacaaagcttttgtgcctcccgtaaaatttggaaatagccaccatgatgcatgtagttgatatttagctgttgctgcatgcattgttttctcttacattgctcctccaacaggttatttgtttactggcttgcattagtatagcagctcatgcactgtattctgctcacattcgtttactgttacagagtaaagatagaaggaagaaacctgatggattttatacagggaaaaagataagagacatgaaggtagttttctatttgtaacttgtttggtgtacctcatttcttttgcttgtatcagccatgttcttttgagtttaatttctcaacagccaatccaggacaagatggttgcatctgcctccatggctaattttcacctggcacctgcaaacactgtgacccctttctcaatatcgatgcaacatacaaatcagcaatgtcaggttcctaaggaaggcaagaccacagcaataacattaacatctatatgtttgctttcttctgttcagctgttttagttcatctttattctgtactacaagtttgaggtttgacccacagtgtgttctaaaattgtgaaaactttaggtctgttagatagtgaggtaaacatcaaaacttaagacccatgttaaaaaaacaacttgagactcagtgtttccctctgtttaatttcatcatagaaacgtggttcacacacttacattgttgggctaacattaagtgtgtgtgtgtgtatatatatatatatatatatatatatatatatatatatatatatatatatatatatatatacatatacataccatatgagtagattttaatgctcttccaagaattcctaacaaactcaaattgcttgtgttcttgaggctgcttactacatttgtagtcagtagaagcatcctctggaagcaaacttcagatgcctttatgtggtgcgcatgctgtattaagattgtgtcacctatagatccccgtgcaaatacaagaaagatctaggacaaaacacaagcaagtagcagtgtttccaatttccatgctaagcaatcttttatatatgattatgaatccttggtaacatctttagaaactgtttttttcttgtgaaataccttggaaaatagcaattgttagctttactattatttcgtgatacaagcttactgatatcatcggatgctagaaatccacaactgcaaaagaatgggggttgctgtatttgatgatcatgtagttttgtccgtttataggtctatgatggaggaaaggttcatacatcccatagtaaaggaaaagggtgttgcgttgcaccctcctgtttatattctttgtgtttgcctttcatcctttcattatctttcaccgtaaactttaggaacataatgtaataaaacaccttgggtttcattatcattttagatacctacaactatctcatgcaatgcaactgcatgcatcttatgatgtcttatttctcccaaaacactcatctggttccattatgtagaagttcctgtcgtggatagtgcaacacagcatctcctggaagaaaacaatcatttactcaaccaaatcgccacaaatatcgaaacattcaaggtttgtatgtccataaacttctcgcattttaattctaaagttgttgcttttgaagttaatgagtgcccttacgttagaaaaaaaagttaatgagtgccggtcaaggagcatatgatgcttgccaaacatcttaatttcattacaatagttggtttaaaagtcggtttatctattgaaaatgctgtcgtaatatgtgatcaactagtccttgccctgaaaatatatgcccctttaactgttatatttacggggcatcgtgtgaaaccaataatgtcatctgccatcaattactagatatggggaaacacttaatataagttggaacctgtcactctcaggctttatgaatattaaaaataaggcaggacaactggacaggtgtgggttaccatttgttttctttttaattttattatgcctgaatcctgagtttcttgcagacgggagagaacacggatctcttttttcggacaaacaacaacttcaaaaatattttaagcaggtaaagcgtcatttatgtgcccgccatgtatcttgttctttatatattgctttgaggacgatttttactcttcatgtccaaacactgccatgccatccattattatgttccaaattagataggagcccctagttaactataccatccattatcatgttccattatcattatcaaagcctgtaccatcttttatcattttgggattgcttcctgttaactggtgtttcttgttctaggcagtattcaatattcatgttcgtagaaacaaaatataatattttttccttttgtgctgcagaatgagcgagacgcctggtatcatgggccagatgccccaattgccagtgcaagtaaacgaagaccatctgagttcacttcttcagctggacagaatggtaagaggggacccgtaatcacaagagattcaaacatgtacgcagtatttttcagcacgttcatcaccatttacttcattttcttccctttgctcttaaagtagtcgatacataggatgttaacagcaggatcttgtaatctacatgccttaaccacaatgatcgacacccactgctaggttccttcgtatggcgtaacgcaaacctctcatatgaagcaagaaccgcgaagctagtataaacatacacgaaaacaaggacttgaaaaggaaaaaaaagagcagatggctggagctccgccgcccaagtttcgtgtaccatgaagaaggctaagttgccgcaccgagtgagcgagcgccaggaacagtcccggcgtttctttcttccagcgagattgttttccagtgatctgattgtctgcccgcctgcctacctgcccgagttgaaagctgttgaaagcaccggaaattgaggcctgcagctgcttgcgggggtatgcgcaacgggcgagcgagttgctgttgttgtacctggttgggtatccagcgaaatgaatacaccagacacttgattcgggagtgagtaacacgcacacaagtgactgtaaatatttggatggctggaggtgttcccctgtcctgttttgttctctctgattggtcgtcaatatatttttcggaagggtaccttgtatgtttttccactttggagagttaggagggcaccttatgtattattgcatagttggaagatcgtgttgataaaaccaacaaaaagatggctttaggttttgaatagaatgcccattgcatttatacttcgttctgtgatcgcccttattactccctcaggtcgttttgaacttcgtttatagtcaaacttcttaaaagtttgatcaagtttatagaaaattataatatttatggcaccaaaatctaacattcaatatattttaaaagtttttattgctaaattttaatataaacttaatcaaaactaaaaaaattgaattagaaaacgttcaaatgatttctatatgaaacggaggcagtatgagtaaccggccgcacgtactgcgctgacaactgcatccgtcctccgccaaccacatctgatcttctactctcttccccttttttttctccaataacagttagattaagattaagattttcgtggcacgcttttcaaactactaaacggtgcgtttcgtgtgaaaactttctatataaaagttgttctaaaatatcatattaatctatttttcaagtttgtaataattaaaaattaatcaatcatatgttaataccacctcgttttacgtaaaaaacttaatcttcatcttcatctatgttccaaaatactctagtagttcaaactttgttctaaagttccaagtaccatgggtaaaagtttacagtgatgaaatatctaaaatacatctcacctctaccggccaggacaattaataaaggcatttctacacttttccttcgcctccataaagaactcaagaaataattactattactatactatattttaagatggagggagaactaggatggacgccctatgggctagtttaggcaaaacacactaatcctgtgtgctagctcagggcacaattttgggaagttccatagtcaaacacgataaataatgtgtcagcaacatgttccaaattttcagcaggctattatgttgatagcaacatgttccaaactaacaggttattatgaacagaaaccaatgttgcgtgttgttgacatagtaaatactgcaactgtacaacaaaaattataatccattattaaaaagccgaaaatgacccctcatcgcacctcaaatagtactactgtacaatcatatacactccagaaaagaaaaatgcaagaacacccctttaatcaagatctgttactggacttgaaaaatgagccttgccccgtgcccgaaacacaaggaaaacatcctatctagcactaccagtgaaaaccactatcctgcaacatgcatatgctatgtagcaagcacaaaacattggaagtttggaacagaagctgtgtgctttctgagcaacgagcagtgcagcaaactataaaaccaccgtgagccatttaaaagccctccatgaacaaatacatatgcagttactttacaaaagatcaactggcaggatgatcaatacttgccttctccacggtaccttctgcaggtagttcttcaatagcaggtgtgctactggcaacaggactctctgcagctaattcttcaactgctggtaagttgttggcaataggactttctgcaggtagttcttcggcagatggtaagttagtagcaacagaactttccgcaggtaattcttcaaccgtgggtaagtctttcacgatagggctgccggcacctgagtttgcaaggtttgcaccggcgtggccaatgctgccatcggaatgagaaataggagtctccttaccaggagataccatttcatgctcatcatgctgccgtggtccattgagggcattacagtgcgggcagtaatatgtaatgaatgcaaagtcctctttccttgcaagacctgcaacagtgaatggtttattatatagaatctgtatgaaatattgggaagatagttatcactttcataccattatgcatatggcagttgccacatattaacgcatagcactgagttggatcttcccctacaagcagagcagctgctcgtgcgagccatcccccatcattaccagctggacctctgaagtggtcaacagtcctctgatttggagtggtgacaccttcattaccatcataggcatatgaaccgcctaatgactcagggccgtatgtccttccagtgctgttgctcaagtgtcctggttttctttgcctcggtccagtagtttgggcatcattacttttactcaatgttgcatccctattcgactcatctcccaagaagactctcaatccagaatcagcacccagtttagatgccaaaacagttgctgcagcagcttttgcagcaggatcaagatcatatctctgcatgaccaaaacgaagtttcagcaatagttagaagatgtaaacctttcaaaggggaagagtaaaaaaatagcacacttgggtggccataacatagagcaagtaggcaacaagcccacctgtataagttgttgagtagtgtagtaattcgttctctccttcaactcatcaatcttagcctgtctttcagcacggaggttttcaagagtatgttgatctctgttgtcaactgcaagatagaatcagtattgcagtttaggcataaaggatagggtgtattaattggagcagtttactagacgtaactcggttgttccacaaaaccattcggcaaatgacaaaaaaataaagtgtggaagtaacatggtcaactcaaaaacatctggagaatctggcaggaaacatggcagtctcatagtttttttttgtctccctgacttctagggataggaaaaatagctactccctttgtcccataatataagggattttggagggatgtgacatttcctaggacta

SEQ ID NO: 72594 - DNA, 42297 bp, Oryza sativa
tctataaatgacaccactaagcaactagtagtggtaaataattaattaggttctgcaaaggaaaataagtcatctcagcaatacgcgaagaatcttacatgctccaacctgaggcatccacaaatggatgccacagcccatgttgataaagcagtcgattcctcctcggcaaatagcgcattgcgcatctgaaaaggagtggacaaagcttagacatagtattcatgtatatacatagcaaatagcttatgacaccagagtggacaatgataaatgcataatattgcaacacatcagtatatctcacctcagccacctctaaacttgtatcacatgaccgcagatcaatagtagaaccagcaatatgaagaactgtttcacctggccggtgaaaccttagaggatgaaggtgatccaacgggtgaaaagtaagggatgaacccctggcaggacactgcagctgatagtactgagaaacaacttgcagagatccatatttttttgcctgaagaaaacaataagttaccaaatataccaacaaaaaagagagagacagatgagcaaaaatttgtgtcattttatgcaaatagcaccttagcccattgcgatatattgttgtggccaactaagtctccatgaccaattgatgatggctcctccaaatccgattcatggctatcgcttctgaaatttatgccttcagaaggagagtcctgggaactgcagtaaatagtgctaactactttattattttattcagctagtgatgcacaaaattaagaagtaacaagacgatttcaagtgagaatatcagaattcaagaaacataggaataggttatgtaaaataacatactagtgccttaattatgtggaggataacataccctggagataattcagaaccttcacaaaggcgagagcgcatgagaggtagaatagtatcattaacaaagatgtcaagctgttcatcgttcacatcatcctgtaaagaatagccacaattttctgtggtatcagattccttcaggataactggtacagaatccagttcatgaagctcaatcccagattgatcggcagttgtatcttctgataaacaattgtcaggcctttcaagagtatcacactgaggagctgttcctgttacaagatcatcctgtactacacattcctgttgaacttctttgcagtttaagtccaattggttatctctacattcagaactgctgtcagtgtcagacagctcctttgaacaaactcccacacttgattcagaggatttttccagatctactgcatgaccatcgaaatattgtttttctgttgcaagttcagttccttcgcagacaacatcatcctcacaggtttcctcaggtgataatgatgtaagcaagctaaccccatcagtgagccattcgagacgctcttccataagaatactgtttgtgaaagtcatatgcaaaagaagtggcatcaaggagaatatcaatattgcgtatagatctggatagcatgaaagacactcatacaacaatgtttaacaaagagcaaattgagcagagacaatcgcaggaactttggatgcaatctaaaatattatttatgccataaatagaaatcctgaacttacatccccatcctgagatcttgaagcattttgtgttcaagctcacaaggaaacaaattaaccattggatacacataataaagcagataattgactccaatgttaagttaaaagcattactagaaaactagaacactgtgccaattgtggaaaatataagggagcaagtgattgaattcatggttttaaaccccaaaccttcttagttgcttattctagtattcttgtctaagatatcgatgcttattctagttgctgtgatgtaaaaatgttacttgcagaagcaaaagaagcaacaaacttgtatatgttttccgaaactagcagcgcaattgaaaatgtaaaagctctttatggctaataaggaccaaaagcagccgatgaatattttttacgcaagaactagtgatcaaaattagaacatacaaatggtacacaaggatgaggcttccacttctgctgagtgcagaccggaaaggtggcaaagcaaaagactgccaaaaataatgaatatttacaattcagcaagataacaagcgataattgcgatcactataccgtacctctgtagcaccccaaagtgcagttcaaagaatgggagcctggaaaagatgcaatagcatcgcggtgtagttattacataacgactccggcgtggaaagacaggtttttcacttgtgagcatagaaaccagcttcgaaggtctctgtacaatctcttcaactaacacgcagcatccatatagtgtagagtcatcagcaacctgcagtctttcgataatcagcaacctattgaagtagagtgatatattggagaaagaaatacatttacctgtaaacggaacacgaaagactggttgctttctttaagttgctcctgaaatgggcaacttactatataagattatggataaaaaaaatcatgacacaggactatattacacaggctgtaaatccttagagagcatcaccattatatggtgttgaaaaagacaaaattagcacggagaaacagtcacctgtcctaggaggatttcattcagctcactgaatgagggggtccgttcaaccgcatggacctaatacaaacataaacataggtaaattgttttgagggtatacagtgcatgatctgacaaaactacagatggaggattggatgttaagcaatcaatgcatatgtgttttcattcagaagaaacaaagaatatcagctgtggttgcagcctgcagcaaaaacaagaaggtaaacactattagcagtatgtagcccaaatgtaacagacctgtacacctccaggaagacagaacgagaggatatccttgtacttgagtggtagaggcctctctggagggtatgcaaaaagaacctaaggagtaagcaggcaaaagtaatcagcaaaagtttcaagtgcatgaaagaagacacaaagcggatgaggtgagctataacctgaggttccaaatttgacaatgcatgaacttggtggtgattgttaccgaatatatttctcggtttctttacatcttcctcattgctccctagtgcaatgttttctagctcatggatatctgcctgaggagggagtccaacaatcacaatgctctcgaaaagatgtgatggttctctgatgcacctattaccctggtccagaaaagaattttgacagttttgagcaagaccagaacgggtacaaccacagaagaacagaaatgagaaatacaacgtcacactcttcaaagtactttccagaaacaactctacagcggcttgcatgctgaagcaaagtgactcgcaataatcatctatgaaaaacaaagtgtatataattctaaagtgtttgccacaatttaccagtcttattaacttaaaaaagctaggttacaacacagtggtatttaaattcatctgttgcactcaaataattactcggaaacatggtgaacacacataaaagtgtgcaagtaaatgagttgctctggtgcttatgaggtgttaggtatgaccgtatgaagtttgccacaatttaccgatcttaccagtttaaaaacgctaggcctttcaatggtgtggtatccaaatattattgggttctttttttttttttgaagtggagagagagcctctcccgtttccattaatagaaacgatagtagttcattacaagatataaactgaaagcagaacagcagaaaagataaagctgaactgactgctcacaaatggcgccatcccaccattttgatgcatcagcagcaacaacttttgcactttggccctacaaagtctaagaaagctgtaccaacaaagacaaaggtagacgagaaacaaagctaccctattgagttcttactgtacatggctattgcactggaataagtactcagaattcagaggcacttgtgaacaagtacataagaatataacaaaatggatatttttgttatgatgctcaggttatttcaaccattacagaacaaaggtaactgctatttataatctatagagtgtgaaactgtccagagatgactagtataaatgtaatcataactgttgagtaaaccttcctaaatagtttcaaataattcagcaaaatgctgataagtcaccactcactacacaagtacacatgatagatacatgagcaaggtgaaagaaccaaagtaaaactttcatgcaaatcaaactcaatgtgtgatagatcattgagcctgacaagcgatattaaatgagttctggtattttctataagtaaaactccaagacaaaaaatgttgatcaaaaaatacacatagttcgtgtaaatggaacaacatagacgttgaagcgactgttatcttgtcttgtgaccatgctatgacctgtataggttgtaatgggaaagaattaagactaacatccctaagatgaactgcaagtttgaatattatgcttgaaaaacaactgccaatgaagacacactattgaacaactagtgaaaaaaatagcatatttagctctgttttgtgcactactgtactctgtcatagcagttaaaggatacaggtcactcataaattaaagctctgaattaaagaccgaagttaatctgcaaaagtatgtccaccaacatatagattgaaaatgcgatacataccagcgactttagttggaacctggaccactggcgcttttgtgttgtgagaacctccgggttgtaagatccagacacttcaggtgacgttgaaaaccctttcaggatcttcgaaaattgttgttgcagcttctgcattgggctgccactctcttctctggaagagtacaccacagatggtcgtgttgactgtacagtggctgcagaagctgcagcaataaatgctctcgctacctcttcagttgtttgcatcaggtgtgatgtgttgaatttgagcccttcagatccatcgttcttgtccaccattctaaatgcttcctattcatgcaagcaaggagattgtcactccagtagtgtgattgagcatgcgcatatccgtcagacaacatcaggacacaggacacatatcatggaaatacgtagggtaacaaacaaaacttgagcattacaccatgatcatgatccagtggtagcatctatcgtacaagtaaatcatcttctcggctttgaaccacttaaattaaattcgacagaacctatggcctacacaacctacagtcctgggaacgtaaatttgtgaaatctacctcatacagaacaataaatcagcttgtacctcactctgatatccaaccagaagccacctaacagcaaaccgtgtgcactttacctacctaaaaagcggtccacttgaataatcatcgaacttttccaaaattaatcactgagtgcatggttgaatccaaaagggcaaaaggtgacaacaaatcgaacaataccacataatccgatactactatgatcgatttatatacttcgaaagtaagaaaatgcattatcagcgaccgaagcattctatattaaaaaaaaaactagcaaaatcgtacagagcaaccactcgatcttagtgttatgacctaaaattcgcgaaaataccacatccaacagactgtttgactactccaaatccatcatacaggcgacagtaacctcaaagtgccaaatcgatagggaaatcgcaccctccaaccagagtcagatgctctcagaatttaacagtagaaaacccatacccccactacggtcgacgaaacatccccgaaaagaatctcaaaacacacacacacacagagaaaaaaaataatagggaaaagcgctccgaatcggctcacctcacctgacgcggcggcggaggggagggctttgaagcttcaccccgcgaagatctcctcgcctcggctctcctctccccgctgcgcgcgcgcgcgccgccgccgccgtcgaaatggacccgccgaactagcaacgaatgggatggcggcctcctccccttcccctctcctcctcctcctcctcctctcctttttttttccccttcggatttgtggtttaatgcgtcgatccgttcgattaaaaccagaggcgattcgtcgcggaaaaaaaattaagtggcgtgatttggttcggcgcttgggctggactggacgaggggggaggagagattttgagaaggcgagtttttcgtggacgagtgggagtctgctggaactggggggcgatctgtctctctgctcgtggggcccgtgcaaaggagggtgcctgagttgacccgagccgtgtggccctccgtgtggccgggtgcctcgcttgccgctacgccatccgacgcgtggctgcttctggctggagccaacagggagtacgtttttttttcctttccgagggaaaaaatgcagtagaagtacacgacagcaggcatgcagaacaggcctttgtatgctcgcgctattaaatagctctatgaaatcttgctatttaggattattaaatatagattattgataaaaccgattctataatctctaggttattttgcgagacgaatctaataatatatattaatccatagttagcggttgattactgtagcatcactgtagcaaatcatggattaatatacctcgttaaatttgtctcgcaaaatagcttaggagttatggaatgggttttgtcggtaatctacatttaatactcttaaatagcaagattccggagggctatttaatagccctccggattcaaacagggcgtagtagaaagggagtgtttagaactttagatcaggctataaaggtttgacgtgtcatatcgcatattatatagagtttctcactgagtgttcgggcactaataaaagactaattacagactccgtcagtaaactgcgagatgaattattaagcctaattaattcatcattagcaaatatttactgtagtactacattaatggagcagttaggtttaaaagaattgtcttgcaaattagtcgtaatctgtacaattagttttttagattatatttaatacttcatgtagatatttaaacgttcgatgtgtcagtgtgtaaaaattttggcaaagatctaaaggcctaaatcaaacgttttcttttaagatgaataaatcaaacgttttgcaacaataattgtacggtttttaagctgtttagggataaatgatactaggacgacttaaaaaccagtggtactagtactcaggaagagtccaacaagtttagtctcggcaatcaactttttctttctctcaattaagttgttttgaatattgattcagtcgttttctgcttggttgctaccgagcattacaccctgtgttgtttttgtattttttggacaactagttgtggatatgctcgataagaatataagatactccaagctcatatcttcgggactttgtttattcttcagaccctttttactttgattggaaaatctctgctcctaaaaaattgcaagtaacaggagtgtgaccaatgaaactggtagagagatgagtatataggaatggtatcctcagatttatacgtgagtcacttaactgcatttgtgattacttcctccgttttaagttataaaactttatagtattacacatttgtatagatattaatgaatcttaatacattaatatatatatgaatattggtaatgttataaagttttataattaaaacggaggtagtaagtcggagtgtgtaaaaggcaagaagctgaggctcaaactccagaatccagatgtcaaagcctctagtagaacaattctgaaggtacgagcagtacgacacatgtacagtgatgacgttttaaagccggtatccatagccatcaatgaagtggttccaccgtttggcagcagttgaaaaaaaattatgtggacacattgtacctacctaagtactcttagggagcgttgcgttcgttctggtgagttagggtgagaaagcacatcgtagtccgcgcacacgctttctaaactattaaacgatgtgtttttggcaaaaaaaatttctataggaaagttgcttttaaaaattatattaatccatttttgaaatttaaaatggtttatactcaattaatcatgcgttaatggctcacctcgttttacgtatctttccaatcttctcaatcccctatccctcaaactcacccttaggctctgttcgttctggggagataggggagaatgagtctcgttttccgcgtgcacgcttttcaaactactaaacggtgtgttttttgcaaaaaaaatctatagaaaagttgcttttaaaaatcatattaattcatttttaaaatttaaaatagttaatactcaattaatcatgagctaatgactcacttcgttttgcgtatctttccaatcccctcctcaaacaaacccttagctatgcaaagtacagtaccattctttcgctcttccatttgtagctgtactctcgtgtttgcagaagttaaactcgctaccaagatttaaaaaaccacgtggttattacgtgtgatatccttttaaattttcgaaaccacgatataactcatgataactatgtggtttcgtggtaaccacacggtttccgtgataaccattaaaccttgagccgtgaggtgatggtaatctcgtccaaaatagtttggtaaaccctgcatgctacccttgttgattttaacgctttgctcctgcgagcaacgatttttgacgttaatgagtactatcaagctgaatactagctgatcatcccattgccgcataagatcagtgagtgctacagcgacacgaactcgcccgctgatctccatctttttctctgtctgggccacgctcaagcgtggcgagaaagccgcctgggcccattgctcggaaatcaatcaatcatttcatttcattgtgaactactccctccgtaaaaaaaaaacaaaccctaaatttctatgtccaactttaactgtccgtcttatatgaaaattttttataattcgtattttcattgatgtttgatgataaaacatgattaatattttatgtgtgacttgtctttttaatttttttttcataatttttttaaataagacggacggtcaaatgttgaacatggaaactatggcttgtctttttatttggacggagggagtaaggcatgatctagttcccaactttttcttcaaacttctaactttttcatcacatcaaaactttcctacacacaaatttttaacttttccgtcacatcgtttcaattttaatcaaacttacaattttggcgtgaactaaacgcacctgaacccatgccatgccacccctttcagctttaaccatggtttccaatgcagcattcagctctgccgtttacttttatacagcagaattttcgcagaaatttctctacctgaatacggctgtgttcagtgcagtgtaaagtttagattttggttgaaattagagatgatgtcactgaaaagttgtgtgtgtatgatagattgatgtgatgaaaaaggactgaagtttagatccaaactttaaatctaaacatagcctacctgaactttcgtagagtcttgagatcgggtcattgcgaaagtccatttgttgcattttggtctggaaattgttcggcgaaaaatctcggaatgcattggtggatatgtcaattgcatcagcccatgcctgcatggtggggagctggacatgggaattgtagcacgcaagaaaacgacgggtgattgagcagataggctgtgtgcactattctgaatttctgattccaattcctggtctggtagcatgccagcccagctctctgcattgctagcctttctcaggctcagaatctgaacttcgtttgatggaggatttgggtttactctgacggaacatcctgcagcttcaccaaagtaattaaggccgagtttagttccaaattttttcttcaaacttttaacttttttattacatcaaaactttcctacacacataagctttcaacttttccgtcacatcgtttcaatttcaaccaaacttctaattttgatacgaactaaacacaccataaataaaaaagttagaagtttgaaaaaaaaatttagaactaaacacagtctaaaacatgagatgaacaaaaccaaaggtgagggatgtatactctactagcattggcaagtgtgacgatgcataaagaaagaatgttcttccattacgtggtgcccatacacgtcgatgcaattaattccgtgatagatgaagaggatggagagatgacacgacctcgcgagcctaatccgaattggatagatttagtgatccggctttacgattgctatccaaatgagagagaaaaaaaatatttttagggggctttctttcctcttgaaaaggaccacatttctttatccacgagctgttagcatcagtgcatcacgccgtcgccaatgaaagaaagaaagagaaagggaggaaaggttagcatcatgattattgagaacctgtcatagctgtcaagcagagttgctgatcgatttgtagactcagataattatatgtcattttgggccctgccaatcagccgttgcctcatcaacagatcactagactgatgaagagtgccgcgtcatccttcgtctgatggcatcattagcccatatgctgctagatgcaagaactcgatcgaggacatgaacatttcgggcttgtttggtttgaatcaaatttttgccataccaaaatcttaatagtgccaaaaccttggtaagttttggtactattaaattaggtggtattgaatttgaactattatgacaaaaaattggtagcaaaccaaacatgtatttgctactattgaagtagccaaaaaattagtagggcaataagttggttgcaaaccaaacaggcccttccttgcatatatctaacacaattactatggatgtgtttagttcacaccaaactccaaacttttccatcacattatatcacatccaaaacttttctacttacattaactcctaactttttttccaaattaccaattttccccaaacttctccttaaacttcggaactaaacacagcctatatggcaaaggccacttgctgacagatctagcaaacgccacctgctctgctgcagaaccccttgctggtaggtaaacagagtgcaggttgtgcatagaaaaaactactagttccctctgtatgcaaaaatgtttgcacttaggccttgtttagttcctaacttcttttcttcaacaagtttttccgtcacattaaacttttctacacataaattttcaaattttccatcacatcgttttaattttttcaaacttacaattttaacgtggaactaaacacagtaaacacaatacacaactgactggcctggtgttggcctggtattaccttgcccgacttctatgtcagagacattgacattgatgctctaccaaaccagccaaattatcaaaagtatcaaacccttcctctttataagaagttgttgaatagctgacgcattcttcaccactagttgccggttgaacactggcgttgcttttatctgaacaatactagcacttccacttgcattgcataagaccccctgaccttgtgttgtctcttgtggcttcaggccttgaacgtccaacaacttcaggagggtaggagagccaaaaaaaacggtctgttgagtatcattggtgtctgactgaaataatgcgtaaatgcagtaggtgagatcatagtggatatggccggaccgccggacagttcgatggatacagaagagataggctccgtgagactttctgtttcgctagcagacaggagctgagcgactaaaccggggagtactgccaacaaaacgtaaggcagatagccagatatggaacttctggactaatctgatgcaaattttccattttttagtccacgactccacatatcatctgatagcaagggcttgttcagtttgctaccattttaaaccttaccaagttttgatattgccaaattttagtaaagttgtcaaaattttggcaaggttaacaaattttgacaagatttcatatgtactttctaaaatttagtaacaaactaaacgtagctaaaattttaactactttaataaaaaaaatatggttgaaaatgacatcaagttaaacaggccccaagtttgtgaatatgaagctaacagttgtactgagccactaaacacttctcgaggaagaaaagaaaaaaaagacagatgtgcaagaccagtttaatgcagtgttggcccatgagtcatgctgaccacaagggctcgtttcgatgggcctaaatgaggcccacttacatgtatgggctagacacgatgcctactcatactgaaccgatacatcatattatcgtggaataagtccattttacgttcatcatttcatcaaatttaaattgcacccgaaaccataatacctgaaatcttcgcaccctcaaattgtaaaaccaggttaaattacgtcctttagtattatagatggttggtttcactgacgtggtaagttgactcagtcccgtcctgactagatgtttacgtggcaaaaacaagagtggaccacatgtcatgcttactctcctcccctcttctctccccctcctctcttccctacaaaaaatggcctcggagacaactaggaaccgggtagcgaacgtcaacaagcatgaccacctcaatcccatacgtccacgtcggcctgaacacgccgcaatagcttcctcctccactctcgccaccttctcttcctatcgacgccagcaccctcctcctccgcgcacctcaatgatttgtgcaccgaacaccaacattgtgtgcccctcgtacgcaaccggcccacctcccccttctccacccactccgcggtggagaccgcttcatcttactcatttggctccatcctagccaccccctagtcattctcaatcttagctcgagagccataggggatgggaggtcaagcaggaactcctagtcatgacgatgccgaattgggagatatgtgcagtgagctcagagatgatgtagaaggtcgaggatggggcggtagagggtgcgggaatctatgccaacgatgaagctcagcctccccctccaacgacggacgggaaatgggatcaccagccgcctccctcgctgccaatcgctgaatggtgtgcgtggttgggaaaaagagaagaaaaaagtggacattgatatgtgggttcatatatattttttattttcttcttcccactcaccccatccgtcccaaaaaaaaatccaattatagctatgaatctggatatatgcgtgtccaggttcgtagctaggatttaccttttttctgagacagtagtacatgcagggctcatatgttttttaattactttttgctgactaggataccatgttagtgaaatcagccatccatattaccattagatctaatttaactcggtttgcaatttagagttaagattttgggtatgacgatttagagacgtgatttaaactcgatggaaaaatgagggacctgaagtggaccttttctattctcgtcgtaaaaagatgcccaaattcactcgattccgtcggccattggcaactaatcacctccaggctccagcccagcccaaatcgttctcctcctccagaataagcccatccgccgcgcggcatgcaactcgcgcaaaagaacaccggagagcgagagcaccgtgcacgacgccgatggccaacgttgcagaagatgccgctgggcgctggcctactagtacgcgctcagccgcacacgcacacgcccgaatgctcgatcggatcagtctcctgcctgcgggttgccatgtgcgcgcgtgtgcaatgcgctgcgctcccacggcgaagcccccacggagacgcgcaccggcgcaacaagcgaaaagatgggcaaacgcttggagcccatcttgctgccgcccagtgcccccacgaaccccatgcctcgttactgctcgtcgcgtcgccctgcttgcttgctactagtccgctgccgcttggccgtttcttgcttgcctcatggctcgtcggctcgtgatcgtacctgtgccgcgagacggcgagaccgcgtgtcacactgcctcgtggcttgccgtatgcgtaacgcaggtatgggcaggccaaagaaggaacagtcccattgtttaacatattcgaggaaaaggtaaaacgctacttgaaaaataatgtcaataaaatttttatatactttgtttttaataatttagaagtaaagactgaaaaataaactataatgaaaataatataaaatttaactttaaatttaaatttaaggttgattttattttctgataagtataaacgtaaacgaaaagataaggctgtaagtagttcatcagcccatcatcccatcgaaaagccgctgcagagtttagcagctcagcatgctttgaacctcttgctacttctctttcatcgcatcctctctgggctgtttggacggcgtagaagttttgtctgtggagcgaggcagctataattaacagtggatcatcggattcagattagtcaatactcggctactcgcaggtactgtacgcaccaggcgacgttgttaatggggttgttacttgttagtgtacttctttctgtgaattaaaggagatctgaccggaatcttgaccacgtacatgctgatgagttcattcgtaatccgtttaattctacgaggacatttgactgtacaacaagtattttgtgcgtctgtactggacagtttgtagaccgggatctagttgctgtacttgatgggacaagaggtcgctcacgtagatactgcagatcgtgtagaacatctgtagtctgtagtcttcagttgaactgcgtgcatgcatgttgcacgatattgtagtatgtacctattcatctataacatctataacgcatcaaatcatctgtttctataggacttctttactgtacacagcaagtagaaacgatgaagttcttcagcctggggccggaaaaaacaagaggccaagagggcaacgcgcgacctcgtggtttctctttcaaagttgagcttttcaattcaaatggagttgataggagtgcgtgttagaggacacggtttaggccatcatcgagggtgaattgacaaacaatatttaaccagcaaaacacagctcgaaagcttatatatcacgccccctgtccaggatgcagcctttcgagcttcagctttgaggatcatacggctcaagaatcgccatcattaacccgtggaagatttgcacggcgagtcttttaaagatcgtggagctgttaagcagtgcaagcgttttcgcaatcaaacctgctgatcaaaaggctgcctcattcgttggccaaagaagcatgacggctcgttagtgccttcacatcccgtcctttttgtgtttttgttgttgttcacttacgtagtactccctccgtattttaatgtatgatgtcattaactttttaatcaacgtttgaccattcgttttatttaatttttttgtgtaaatataaaaatatttatatcatgcttaaagaatatttgatgatgaatcaagtcacaataaaataaatgataattacataaattttttaaataagacgaatggtcagacgttgaataaaaagtcaacggcgtcatatatattaaaatatagaggtaatactatttatacatgtgtctctgattgctggtagaatactactacttgatactcaaagagcaagattaatctttggctagtatcacctttgcagttgcaggctacatcagccgtggtgttaaaacagcaaaataatgtagtactatatttatcctaaaatatatctatcttagatgagacttgttctagactgctacttttgaaacggatatagtagcattttattttacatagcgggtacattggcctttatttcaacagaaactataacaacgtaacataactatatatgtttgcatcacacaagtccacagaatcgatgcccagtttcagaatgccaatgtaccaactgcttgtgcatagggaaacaaatgaatctgtttgttcgtagtcgtagacgcatcggcggcaaatggtgcagacctgcgagagtttcttcttttctgttttcatttccggccacacggtgtgccacaggagttgtgccgcggagaatcaccgattcgctttcggcccaggccgaagggatctgctgcgcttgtgctcaagatggatgggattttgtcagagaggtggacgtggaatgggccctgcgctgcagctgggccttgttaccattggcctgtataattaatgccacctttcggaagcatttgagggctggcccacaatgcatgatatactagattttttttgcacgtagtactgaactttattttatgcacacaaatcgctctagattttgagatttttggcagccgaaatcccattggaagaatattcttgtaatgaaaaaaacataattgagctaacttaaaagagtaattatttttataaaaaattatcaatttactatatattaaaaaaatacggcaattgtatatatactccctccttccctaaatgtttgacgctattgactttttttaaatatgtttgaccattcgtattattcaaaaacttttgtgaaatatgtaaaactatatgtatacataaaagtatatctaacaataaatcaaatgataggaaaagaattaataattacttaaattttttgaataaaacgaacggtcaaacatatttaaaaaagtcaacggcgtcaaatattttgggatgcagggagtactttttatcagaaaactatagctttattttgacaggttctagactctctcatcatatacacatgaaatacttatatcggtgtaagtttaccccacatattgtgcacccgtagtagataaaattataattttgtaaaaaatcaattgttattgttgttgttatgtgaaaatacccatctaaagttgtgacaaatgatttggaaaaataaagttttaacataataattgcacgaaatggttgatgcattgaccattatatcactaagcaagtcatcctcaaaattcaaaacgattgcaatacagcaaagcgagcatagctcaactgatttgattcattacggtgcgtagaacccatacatttgggttgaagtgctaaacttggcacgtgtactcacatttacgattaattactcttttagcaatatgcgatgtactgcttgacataagaacgcttgtggtgactttatcaatcctatgatatatcagcccaatatacaaaggtgtctatatgggtaatatggcaacccaatctatcatagggtacaaggccctgatgtgtgcgcgggtgtatttagagaggcactatatggtgactttataaatcttaagatacgccaacaaaatatatagaggtgtgttcattgtggtgaatgtggtgagtttatcaatatctcatgggatagggtatataggtgtgtacggtgactttatcaatctcaagatgtgcaacccaatatatagatgtactcatagagttagattacgtgtcatctgtttataggagagtgtgtgacttcggtaatactaagatatgcagatatggtctttataggtgctcatagaggtaaaatgcgcatgcatattcatagagctgagtatgtgcatttgtttatatatgtgagtgtgacttcgataatatcaagatgcgtcaatccattcgttgtagttgatcataaagataaagcgtgcgcgtttgtatgtctactcaggagcggagctagagtatatgaggggaacccgataagaatttttttaagctatatatcacctattttcactatgtgtgcactcttctcaatacaaacttagatatctaaatcatcttaaactctatctaaaatagagtaaaataagcaaatgatatattctccatttcgttatagctctaccctgtacctactctgtataccatgttgagaaagaaaaagagatgccaatgtaagcggattaaaactccacattttcagcgaagtggatgtaaaacccagaagatccaaacatgccagaaagggggaacaagtacagtcgtaccataacaaccacgagagcgaaagttgcagtcatccacatggacgtgccccctgttcgtcacccacaagacacaccaccaccaccatcaccttcacgccaaagcctccctctcccatctctccctctctctccctcccctgcgcccatagctcgcagctttgcagcagccaagccaagaagccaactcaacccatcagaacggcagaaaccccagccgcggcgttggttaaaccacagcaaagcgtcgttgatgcccccgcgcggacgcctcgcctcggcgccatgacgacgaccaccaccactcgcctcctcctcgctgccattctcctcgcggtggccgccgccgacgatgacggtgggtggccgcgtgccgttcccttttgctctgctcgcctgcgtgcgttggcgagggagggagggagagggaaggatgatggattatagtggggagggagggggttgggtttgggtggcttcgtgttttggtgtttttttagtgctgcgagtgcgcgccttttggtctttgtttatgtcttgctccctattggccggcgccgcctaagaatggcctaatactagattaatcccagcctcctgttcgtagcatctcttcttctgttcttcttccctatccaggggacagttgctgtactttttttttgttttgttttttaaatgcggctttatttttgaactatttttttttctgttttgtttcgttcatggataaggtttctatattgttcttggagatcaaatgctcatttctgaaatgccgccgctgtttgtggaagtttagggagtgttttttttttgtgtggggtttttggttatcgagttttggatccggaaatggttttaaattattttggaagttattctccgattcctcctccgaaaccagattcctgtttcctcgcgatgtttggtacttcgattctgctgtttatcaatctggtttgctcttgcgtgttttccaggacaaacgctactggagatcaagaagtccttccgcaatgtggacaacgtgctgtacgattgggccggcgatggcgcgccgcggcgctactgctcgtggcgcggcgtgctctgcgacaacgtcaccttcgccgtcgcggcgctgtgagtttcctgccaacctattgcttggcttgcctggctgcagtgcccgtggttactgacgtgttttcttgcggtggaatgcagcaacctctcggggctcaatcttgggggcgaaatctccccggccatcgggaatctgaaaagcgtcgagtcgatgtacggtggcacgttgtctcctggaatgaaatgtttctttcattcagctgcttaattagtgtgctcaactcgttctccctgtttgtttgattacatatatgcagcgacttgaagtcgaatgaactttctgggcagatccctgatgagattggcgattgcacgtcgcttaaaactctgtaagtgagattcagttttggttcgcagtgttgttttgaggatgtagaacagtagaagtaatgcgtgccgcaaccctcccctgttcttttattcaagggacctgtcctctaacaatctaggaggagatataccattttccatatctaagctgaagcaccttgagaacttgtaagatttaccctgctgaaacttggtggaggagaagtattttgcagcatttctttcatcgtaagcactgctgttacttgaatatataggatcttgaagaacaaccagctggtggggatgatcccgtcgacactctctcagctaccaaatttgaagattttgtaagttgcggctgaactgttctgagggcttaatttggatcaattctaatgtgatatatgccccagggacttggctcaaaacaagctaaatggtgagattccgaggttaatctactggaatgaggttcttcagtacttgtgagtactaagtagtcgatgattctgttccctactttaaaaaacttcttttttttgtttcagtacttaaactgcagacaatatgtaggagctattagtgctaatcagatttagtttgtgtaaattataggcggttgaacatatgtaatgtagggcaaatagttcggtaagatcatattgtcatatccaattgtgctaatctgattttcatatgacaggggattacggagcaataatttagaaggaagcctctctcctgagatgtgccagttgactggcctgtggtacttgtgagtgtattgcttccttttgtttattattagctctacatgtttgttttctttgttcctttcacaaacttgattttgtttgacttagtgatgtgaagaacaatagcttaacgggtataataccagatactattgggaactgtacgagctttcaggtcttgtatgtacataccttctactccttctgaattatgtgtccccctttctttgacatgtcaatcattcctgaccttatggtatttttagggatctgtcttacaaccggctcacgggagaaatcccattcaacattggcttcctacaagtggctacattgtatgtggtagtcattttactaacaaaaagagtatccaacctgtcgtaattaatgaaaccaactacttgaactgctatgcactattttgtaccaggtctttgcaagggaacaatttctctggccctattccatcagtaattggccttatgcaggcgctcgcagtgctgtaagtccaatgataattgatgtgcttgtcttaatttatgggctgagagtgagaggtattaccatagcccttgaatgcaagttttcacctgtaccttctatttgttgatacagtgatctgagtttcaaccaattgtctgggccaataccatcaatacttggcaacttaacatacactgagaaactgtaagcctgcccttgtgtgtgtgttttcctagcctttgagaaatataatattcttaattatgtcaagaagttaacatcatagtatcttgttttcttaggtacctccaaggcaataggctaactggatcaataccacccgagcttggtaatatgtcgacacttcattacttgtaagcctctacctttaaaattttgttgcttcttgattgttaattgattagcgcactaccctcttttgagacaatatctggtttcagagaactgaatgacaatcagctgaccgggttcattccgcctgagcttggaaagttgacgggcttatttgatctgtataactctactcatcctttatcaattgatgcttacctggaatgctaaatcagtcagtggaccatatcatttgtttttcacaggaacctggcaaacaacaaccttgaaggaccaatccctgataatataagctcatgcatgaatctcattagcttgtaagtttcatttgttctcctgaagttctatatcctctccgatggcagggcacttaactttagctttgtaacagcaatgcttatggcaataaattaaatgggaccgttccacgttcattgcacaaacttgagagtataacttatttgtaagtgttattggttttaggtgatttttcttcaagcctgctataaatttagttctgttcatagtgtctaatgatttttgttttcatcctaacttctaggaatctatcatcaaactatcttagtggagccattcccattgaactagcaaaaatgaaaaacttggacacattgtaagtaccagaagttaatctgcaattgcttttgaataagtgattctcatgatatgacgtgtttgctggatatatttgaagggacttatcctgtaacatggttgctggtccaattccctcggcaattgggagcttagagcatcttttgagactgtaagttctataatattactccttgttataaaaaaataaaataaaatacttgtatcatgtcatgacagcattctcttattcctaaagaaattttagcaataataatttggttggatacatccctgctgagtttggaaacttgaggagtatcatggagatgtaagtaccttctcacctaaatgcgttgtctgctctgtacctttgggagtaatgcagattcctcttcctctgttttagtgatttgtctagtaatcaccttggtggtttgattccacaagaggttggcatgctgcaaaacctgatattgctgtaagtctatgttttaccctctatcctataaagtagtattgcatggtttcaaaaggctgtttgcattggactgcatattaatttgagtattctgtttctcattactgcatattgatttacgtgaatttttttttgtcttttttcagaaaactggaaagtaataatataactggggatgtttcttcacttattaactgcttcagtctcaatgtcttgtaagttatacacttgaaaagcaatatgaaatgatttcacacaattttttttggccatgaacctgtaagcttcatactgatagtgtgttactgcagaaacgtatcatacaacaacctggctggcattgtaccaacagacaataatttttcacgattttcaccggacaggtattttccttggggattaatcgatcgcttgaaaaagaactcgtaatacttaggcatctcaggcctcatcaataatctgatctttaattcagcttcttgggtaatcctggactctgtggctattggcttggttcttcgtgctactccaccagtcatgtgcagagatgtcagtaaaatgttacagctgttgcgttgctccgaagtgtaacttcacactgataaactttctaattttatatcctggatttttatgcagcctctgtctcaaggtctgcaattcttgggattgctgtagctgggcttgttatcctgctgatgatcctagctgctgcttgctggccacactgggcacaagttcccaaagatgtgtctttatgtaaaccaggtgatgcatctgcagaggtcccagtccattgattttacccatcaatttcggtagctgtttggcaagtgtcctctcgtcacactcaaccttgcaaatgatctattacatgtctcagactattgcatatgttcgccctctacttgatagatgcatttggttgttaacagagtgatattattattttcctgtgatagatatccatgcactaccatcaagtaatgttcctccaaagcttgtaatccttcacatgaacatggcattccttgtgtacgaagatataatgaggatgactgaaaatttgagcgagaagtacattatcgggtatggggcatcaagcacagtgtacaaatgtgtactgaagaactgcaagccggttgcaataaaaaaattgtatgctcactacccacagagcctgaaggaattcgagactgagcttgagactgttggaagtatcaagcaccggaatcttgtcagccttcaagggtattccctatcacctgctgggaatcttctcttctacgactacttggaaaatggcagtctctgggatgttttacatggtaagtgaattttacatggcaaacaaatacataggaactgtaagcagaatagttggtatttagaacgattgttcttctggtttgtatagccgttgcctgttcatctgtcaacaagcaccacctgatcactttcatatcaacttgtttgatggtttaatattatttggattaggatattttcatggaacataaacagctgataagatttctgcaactatagcctaattagcaatttctttattattttagcaggctcatccaagaagcaaaaactagattgggaggctaggctccggattgctcttggtgcggcacaaggtctggcttatcttcatcatgactgcaacccacggataattcatagggatgtgaagtcgaagaatatccttctagacaaggactatgaagcacatcttgccgactttggtattgccaagagcttgtgcacctcaaagacacacacatcaacctatgtgatgggtactataggctacattgaccctgagtacgcatgcacatcccgcctcaacgagaaatcggatgtctacagctatggcattgtcctcctggagctacttacaggcaaaaagccagtcgataatgagtgcaatctccatcacttggtaactatttttccattcgcttgctactgtttatttgaaaacttgttcctttccttcaccatatactcttgcatttgaggttcaataagtgcacaatcatgggcattatcaggtctgtgttccttcaaggggaccacgcatgaatcctaccatgtgagtagatctatatacactgtggcggacctggtagtgtgtgattcattgtatggctggtgaaagctctatcataacttgccagtgtcccataaagcctgccatatttgtcccccgccttcaatcatgtgggtgaacatttacaggcaacacacacctgtcaaaaactgtagctaactatgactgtactagttattttgatcactgacatgctggtaacttatcggaagaatttaccctgtcaatcctgaacatctctttttgaaagaaaacggcaaaaggtgaattaaaatttgtatttctaccagcccacaggtccagtacggaatagtgcaactgtaaacagtcgattttagcgatgaacttcctggtttgcatgaatgctgtttatgctcattggttgcttctctgcagatcctatccaaagccgcagacaacacggtcatggagatggtcgacccagacatcgccgatacgtgcaaagatcttggcgaggtcaagaaggtgttccagttggcgctcctttgcagcaagaggcagccttctgatcgaccgacgatgcacgaggtcgtgcgtgtcctggactgcctcgtctaccccgacccgccctcaaagccggcactgccaccggcattgccacagtcgtccacggttccgagctatgtcaacgagtacgtgagcctacgaggcggcagcacgctctcctgtgaaaattcgtcgagcgcgtcagatgcggagctcttcctgaagttcggcgaggtgatatcacagaacacagagtagagtgactatctgaatatcctgatggctttgtgctttgtggcgttggcgttctagctaagttaccagcttttgtgtccttcctggaataagaagggacaccgacgaagggctggctattcgctgctgtaaatatgctgtcttctggtttgttaggccttcggaaagctatttggccttcctgttttgatcagtttttcttcttatcattattagttagtggggtttggatgaggtgaactgtattaaggcctcctgggagtatgaattttgtaagcacgggtcagttaaaaatatcgcagtgatcgggaaaaatccgcctcttataaaattggttttgttggataatcgcggatttttcagtacagtaaacgatgttaagaaccgctggcttgtaaagctgggagcctgggacatcccagaggcaaaaatgggtgctggtaatgatcatccgtgtggatgcatagtctgctcgatcagaatgctgtttataggtctcaggaatcattctcggtgataggctgtgttgcagagctttgtccagcgctgtcgatgtatggcacagtttatgtcactgtgattcgctggtgactagtactagtaacagtaacagtactagtaagggcctgtttggcacagctccagctccaactctacccctcctggagctggagctcagccaaaaagtttcagctccaccaaaaactgagagtagagttgggtggagctctctcacaaaatatactagagttgtagagctgggtttaggcagctccacaactccactccagactcaactcctggagttatatttaggagttggagctgtaccaaacaggccctaagagtagttagttaatggtcagtgacccactttttttttttgctgtgttcaatactctccctctcatcctgccatttgtttcagtattgaagtgtgtttgagtagaaggagactgaggagattgaaaagatacgcaaaacgaggtgagccattagctcatgattaattaagtattaactattttaaattttaaaaatggattaatatgatttttaaagcaactttcttatagatttttttttacaaaaaacacatcgtttagtagtttaaaaagcgtgcgcaccgaaaaggagactcaatctcccctatcactctgaatgaacgaggccgaatggctacccggccatgtctatcacaattcacaagtagtagggggcatggagtacaaatttactgccctttgtagtacaaatttactgccctttgtagggcccctctccccctgacggatgattgatggtatagcaagcgatgtcattcaagcacggctccatgccatggggccaaaaaaaagccagccaggcgcggcgagctcctcgtgatatgcggggctcgtggagtaatggcgctgcgcgcgcggcgcgaacgcaaatgggatgccctttccgttcccgtccggtttagtacatgctgccgcggccgcgaccgcgacgcaacacgccctgcggtgcggggtcggcgccgcgacgcgctcggatgggatgcggcttttgacagggcccgtggcccttcttcttcgtccgtccccttctcctgggccggaagaaggcccatcacaggacatcagtgtgcctctgctggttgggctgatgcggaacttttgttgggccaggaccgcaggacaccggtaagggtctgttcggcgtccctggttcccgaccgacgcacagaaaacgcagtcttaattaagtattagctaatttttttaaaaaaatagattagtttgtttttttaagcaactttcgtacagaaattttttcacaaaaaacactgtttagccgtttgaaaaatgtgagcatggaaaacaagtgagaggagttgggaaaaaggggtgccaaacaggcaaacacagcctgttgtgttcttaccctatttctcaaacccacctcttttgttttccgcgcgcacgcttttcaaactactaaatgatatgatttatgaaaataaaaagaaaactttatatatgaaagttattttaaaaaatcatactaatctatttttaaaaatataataattaatatttaattaatcatgcaataatatcagctttgttttttcgtccggggaacccatcctcacgaaaacactcaaaacagcctagtagtaacgtggtgtgccgtgtaccattgattggaccggagagtatcggacacgacccatgttacgtactagtatgttcggtgtagaggacgagagatcacctcagcaatttttcctaagccttctggacctctgtgcaaatagtaactcattacgacatcatccttgttcggtgttgaaggccatcatccggctgacggttcgtcggcggcggcggcagtatgtggaggcggggaaggggtctggcggcagggaaggaggagtccggttgcgggcgcgccgtcgacggcgagaacaactgtgggcggtggccttggccgaatcgctgaagggacaatgctgttgaccgacgacgatccttcttgtgcggattggtggtgtgggtttggacaaagaatcgcgggcgaaagctttgccgagccatttggctggctgacaacggcaacgccgtttggcgtcgttcccatccttataggcgttgttttagcatacccctttcctttccctatcatattctccgggtgaaaaccttgcttcggttacgaacgagcggtggcggcgatccacgtcgcatcctccttgggagcaccgctttggagaaacctctttgtgcaaagatattgtcattggtctatgcattggcttcgaacttcagtcttaggccttgacgaggccttctagctccacattttgttttgcttttctcagtttggatcatctcttctcttgtttggtgtgttcaacttgtcttgaagaactatattctcttctggagtggatctttataataattagttatagttctttttatcaaatgtcgggatattatatttcattatctaaaaaattacgacatcatcaatccattcgtccacgcttcacacggtagtatggtactcgtagtcgtaggctcgtagtacgcacatggtttcagaggggaaaaaaataaaggaacaattgctgaaaagaacagtttttgttaccgtggagaggacggttcccagaactccacggaaaatacagggagttacccgcaagtgaagaaaacgaaaggcgtagccagaaaagaaaaggaaggaaaaaaaaaggttttccttggcgtgcacagcttctccaaaaaaaaactgtccctcccctgcacggctgcacattgaacgcaaagctcgcgacaccaatcgcacgtgccacgtggcgggcatcttgaacggtgggacccgatgtcagtggcaggatggcagtctcctcgtcctacgtggcctcgcccgctcgtgggacgaccaaccgtctttaagaaattggtctcaagggcaagacggtaaacttcgtgactggtactggtagtagagaaattaattaactgtcgtatttcgaaaacctcaagagcacactgggcatcgtgacttggagcgaaacccggcgggtttggtgggtccggttcttcctttgaacgcacttgggccgtcggatcaaagtggtcgtgttaggaccgacggttagggacaggggcgtgctgttttcgtgcagaaaaagggtaatcctaggttttataattctggagttttgcagggtttatttgcctggtccatagtttgtgatcttttcatctaggagtatataggatttaattggttttttccgtgtttaattttcatccaaatctattcacgttccatcggactaatttttagcaaagtgtttgtttatgagttgcactattggacttcacctctagctcgagttgaatttacatcctagctacgctgggacgagcccaacctagttgatataacctatagcgaatccacgttaaaagatactactacatccgtttcaaattataagactttctaacattgcacatattcgtatagatgttaatgaatctaggcacacactacaacaaaaacctcgtatagaggcacttttgtagaggcgttttgcaaattgcttccaaaattagaagttttatagcgtagagacactttatagaggcactttaaaaattgcctagaaaacttttactctagagacatttttagatcagtttgttagattttatctcgtagaggcattctttcggcactataaaatacgtctaatatgtaaaggcattttgttgatacattttaaactatgtagagacactttttagaatgataatgtgtactaaaggactaaatataagtaactaaaggaacaagcatataagtaatgacatggagttgagttggttagtgtattgaagattaaaatgatttaacgaagagattatgagttcaagacttgtcaaaagcaaggaaactattttattctcttttttggactggttttatatttttgcggtacaatttaatgtctctagaaaatgcatctaccatcttatagacattttataaaatgtctattcgtttgtagagacaattcaccataagacacttattagacattttttaaaatgcctctacattgttgtaaaggcatttaataagtgactctacagtactagaaaaatgtctctacaaagcatttttcttgtagtgacatatatgtctatattcattaacatatatataaatgtgggcaatactagaaaatcttataatatgaaacggaggaagtacgagctaaattagctactcaagtgtccaaaatagacaattttgatctgacaatattatttgggtaggcttttgaaacaaggtgaaacaatggaaaatttggagttatttatgcaaatttgctttgatacattgtagtgcatgaagctcgttcaaccaggttttcctgttctcgtgtatctaggccatgagggaagcacattttggtagaattatgagaattttgttgtacatatatagctcttgatacgatgctcaattcaacaatatgttttcagttattgtactgatttcgtgaggatttcttatgctatattaagttgttcaagtttagtaatataaaagtgccatttcgttgtataaataaactgggttacaacaataattcatgatgatgtccaactattcctgattctccaataggcggtccctctggcatcctcaaatattagttcaataaaactcaaaatctctctgagggtgcaaagatggtggacttttacaaggagatggagaatgcgataatccgtggttgtttgaatgagccagaggaggccgtaatggtgaggttggtgagatatctcaaaggtttggattattgtatttgaatgcatcgttgaatttaagtctcacaacactgttattagttgctataagaaaatcaccaatggatatagtcgtgccattaaaaaaatggacccttagctactggtactacatgatctggtccaagaagctaaagatattttggttgcgttaaaaacatatttcaagaccaatttaagcacaacaagttatatatttaatagcgaggcaaaactggtagctcgctaagtttgcatggggaatgtcttagttctctgttatttttctgcatgtgattttcgtgccgagcgttctgcatactaagcttcttaatttgaagttcgtgttgatgataaaactcctccgggattagatggaaattgagttgtagggaaattctttgtggtactctgaatgccaaaaactaataagaagaccttatgttacaaactagctctagcttatactcatataaaagggaaaccaccatgtgtccatgttactctaaacatatcaaagtcccttgttgtaaacgatttcttgatgcctctgacctcaactagtgaatatagaacagatcagggacctaagtcagagaaagcagcccatgtggccatgcattcaaagtttcaagttggccagatcggcaaaatttcaacggacccgccaccctcgtccgcgcctgcagcgccccgccgtccccggccaccatagccgtcgccgtctcgtacgcccatcccaccccttctcccgcgcccatcccaccccttcctccgcagccgccgccttcgtccgcgttctccgtggctgccgtcgtcgccgccgccgtctccctcgcccccggccgcagccgtgcgttggctgggacactgccggactgccccgtcctcacatggaagaaaaaaaagctgaaagggaaggatgggagcaagaaagggaatagagggatggtgggcggacaaaataaaaaaatatttatgttgcagtaattataatatgtctattatatcagttggctataatgtttatagagggatggtgggcgcacaaattaaaaaaaatatttatgttgcagtaagtataatatgtctattgtatcagttgactataatgcttactacagatgatgtgtccatctattgtagccgatagctggctatgttattgttattgatctcgctcttaccgatcaaccgatgggtccacgtgatttctcccccacacccagaaaaagacgcctctgccctcctggccccacgcgccccacgccaccttgatactcgcgggcccaccactgccacgcgggcggaaatgacgccttcacccctcgaccgttcaaattccgttgccacgtcggcgtgaggattttgatttttgcaatcaccaccccgcgcggcgcaaacatttcgcccctcgcggccacgttttactttccttttttttttggccattagaaaaagtgcacgtgagaagaagcgccaagccacagccaaaatttcggccatgagtcgacaactccaagcagcggccgccgcctcgctctaaccggagtcccccactctctcggtctgccaccgccgcgcgggccaccggcggcgcgccaacccgccgcgcgcgcgcgtctctcgtgctcggctccgccgccgggggggaacccggcgggggctagggtttcggcgagatgagctaccggaaggggttgaaggtgtgggtggaggagaaaggggaggggtgggtggaggcggaggtggtggaggtgaaggaccgggccgtcttcgtgctcacaagccagcggaagaaggtgcggcaatccccctcattccgtgcggtttaagtttgtgttgtactgtttgggatttttcgtgggggcggggtgtgagcagagacagggcgttccatatgagtttgcttcgagtattattcgagacgattgggacagaggcttgttttgttattagtttgatcatgggttgacatcagtgaactgaggcagttcaaaattctactaatacagtatatattttttgagttgctctggtgtaaactttgcgcgtcagagtacagggagaaacaactgattcgaaatggtggaagttgttgttacagatgtttaatttgaatctatcgctaatttacacaacaaattcgacctggttctggtggggcaccagttcgctaaaggggagtatttgaagtgtaaatggtagcattcctggggtactttaatttggattaaaattttgaaatcctttgccagttggttttagattttgtcagcttgtttgtaattttgcagaaccagtttgaagcttcagtcagagtacttctatatagttgtatgaacctgtaacttcacttgtgctctgcaatttacctggattgtatgagccgtgaaacataaatgcattgacatcaataactgaggacgattatcaacattttttttgtttacttggaaatcgctgtgctattagttaaaatttaactagttttagatgtatctgtattatgctatcctttttggtttgcaatgcactgctttaccaggattagtctcccttcggctgttgattttgtagttgtcctggcattctttataattttgtatggcaggtggaaatttgttttatcaatgaattctgatccactctgtttacacccaatggtctatttgggttctgcacttgatttctggatttcacgccgtcctcggtgaaaacattgaagtaatttcatgttgcaaccaaattatctatacttaataaaagagagtagtgttggtggttctgccaccacccctaccaccaactcccaacttttctttacaaaaatggacgtgtggtgctagagggcccagatgtcaaccactcccaccaagtcctttaccttgtgtgagaaagaaaaaagtacagtgtgggaccaaaaggtccacatgcgagtaacaaatatatacagcaatcaagagatgataataataggttaatgataattttttaattaattaatacaacagtaaaacacatgtcaatattctgcttgctctttgtactttgttaggctgtaggccgtaatctataggaggagaggacattgggatttgggtgagtctgtatgtactttgtgggctggaactcttgaattttccaagcatgtcattttttttctttttgttctttataagacgatagatcctgtttcaaccaattaaaaacaattcttttcaacaaggactttattttgctattttcaatatccgttgcaacacacgggcatttgtctagtgttgatataaccagtatttatttctgtacagaaaaaaatgaatttatagtttttttaaacataattattaacaatttatttgtttttactattaaaatttaatgtagttagtttattcttcctcttctggttttcagattacagttttggcagagaagttgctgcctagggacacagatgaagatctaggtggggggcatgtcgatgacatgaccaaactaacttatcttaatgaaccaggtgttctatacaatttgaagagaagatatgcattgaatgagatatatgtaagttgttcactggctctgttgtttttatttgtcgagtgacttgtctacaatgaaaacatattttgttctgtgaatcatcgactcgttgtcggaatttctttgtaaagatacacttcacttgcaattctctatttatcataatttgtgaccatcaacatactatatgtgccagtgttactttctcataagacaagttcactttggctgtccctatgattagacttattaatgatgattttctttcaacatgtgttgtcttagtaaatacatcttcttttgttttgctgctagcttctctttgtgacagccttttcatttttcttcttgagatagacatacactggaagcatcttgattgctgttaatccattcacgaggcttcctcacctgtacaatgagtacatgatggagcaatacaagggtgtccggctaggggagttgagtccacatgtttttgcagtggctgatgcatcatacaggtttggattacattttgattcagtttaagtgcccttagcctctgtttgcatgtacaatctgttttcatgacatttattgagttaatgtagggctatggtgaatgattcccggagccagtcaatcctggttagtggtgaaagtggtgctggcaagactgagacaacgaagcttatcatgcagtatcttacgtacgttggtggtagagctgccattgacgatcgaactgttgaacagcaggttcttgaagtaagttttacctcctgttttcttccactataataaatggatactaagagttgtgcatattttagtcgtcgaaaatatttctggttggtacttttcaaggcattttctcataactcataagtcttttgtttcttcttactagtctaaccctcttctggaggcatttggcaatgcaaaaacagttagaaatgacaactcaaggtgagtatcactcataaggtgacttgggaaatgttgttacaattatatgcaatagttagggatatattcctcaacagtacacatggttctccctctggcccaaaatatggcaacttctagcgttcaaaacttgtcccagaatatattaacttctacacctactctctcatctcaaccaatcacaaccatttctcattgagtttttccacctatttcctcaattaatcacaaccatcccccatttaattccacctcctttgggacggagggagtataaacgatatttcccagaatatactatggctttaccaattcataggactcaacctttctcaatgttttctttgcatagtcttaatttacaacactttttggttgcagccggtttggcaaatttgttgagatacaatttgatgcaaatggtagaatatctggagctgctattaggacctatcttttggaaaggtcccgtgttgtgcagattaatgatcctgaaagaaattttcattgcttttatcagttatgtgcgtctggaaaggtacctctaccaaccattgctattccatatttggctcactattatgtgcataattgtgtgagttccattactgcacggtttgattatgggctatctgtgaagtcagcattgaatgttgaagaatatgcttagagttaaattatactgataccctgttggcccgttccaatgtagacctcattcatttcgcccatttgagcagttattggttcagctgggatgtgattacgatgacacccatttctgttatataacttataagaatttgggcctgcaatttattactgaaattagttttattgtcaaaatattttgcatatcagagaagaaattgtgaaagatgtattcattgctgcaagacaataatatatccatttgaacttagttttaaagacaagcactaattgtttttaattgctgttaatgagattatcgtaatccacctcattatcaaagccttagttaagcatggagaacatagtattctagaggttgtataatctgtttcaattcagtctattctatctaattgtacagttgattccatgcagttctgagttttttttttttggttttggttttgaattttgcatatgtttgttcatgtaggatgcagaactgtacaagcttggtcacccaaggagtttccattacttgaataaaagtaagacatatgaattggaaggaacaaataatgaagacgagtactggaagacgaaaagggcaatggatattgtcggaattagcagaaatgatcaggtttctacagaatgtgaacatacttagatgttacatggaaaaagaatacctaaagaaaaccagtgcatattatgcatacttttccttttcttatcccagaaatgaatgtgtatattgtactttgttcaggatgctatatttcggatactggcagccattcttcatcttggcaacattgagttttctcctggaaaggaaattgattcttcaaaaattaaggatccaacatcaaattttcaccttcgaatggcagccaaactattcatgtatgaattttatttacatatatgattgtgacccctttttccgctcatcgtcctcatttatccataacaatgactcaaaaattgtatcaagttccaaactcttgattcttgaagcgtttagtttttaatgctccagggcattgaggttatggacgtagatgatttgacctttgatttcttacagacgtgtcacaagaaaagaatacactttccaccctatgttaatgacttactgtaaatgtggattacaacctatggttgataataataaaaaatgacatgtttacgctcctatacatgctatatgcatatgtggatattataattgaatctttttagatattttatttgagtttgtcttgatgaattttgattgcctgattagcaaagtttacaattttgaactgtccgcatttactgttttgacatgcatttctggaaacgggtcatggaataaccaccaaattaagtgagcatgttgataatgtactttaaggataatgcatgcatggataatatcttgttatgcctaaaatgtccttggtcactatgaatcatatattttccatgtagcagaaattatttaatgctctgggaacggaagtagctttccacagctttatttgttccttatcgcttcattttttctatttgaattaggtgtgatccagatctgttgatctcaactctatgtacccgctccattaacactctcgaaggagcaattataaaagcattggactgttctgcagcagcagctaatcgtgatgctctagcaaagactgtatatgcaagactatttgactggtattttcacatgccttcttttttcaaggatactgtgcatttttgtaagttaacattctttaattgtttccaggcttgtcgagaatattaacaaatctattggtcaagatgttgattccaaagtacaaattggtgtcttggatatttatggttttgagagctttaaaaacaacaggtaattaagtattctgtcatttagtttaactcactcactgcaattttatagcattccataatttagtttaactcactcactgcaattttattatatttgatttgtgaatatactattatcaaataaaaggtgtcatgttttatgtcagcatttctgttcacaatgcaccaatttacagtaattttgtgcctttttttcttgcttggttaggctggccttttaaatgtccacaagccgacaagctatttagtatgttgaaattactgtttgtgctgccaactaggcaaaattgtgggaaaagtatgggatgtttaactgctgcattttcgtctgtttcccttttcctgatgaatcatcctttatttattgctgcagttttgagcagttctgcatcaacttcgccaatgaaaagcttcagcaacatttcaatgaggtatagtgcatcatttgctctttaatggaaacacaatattaatttgtacttaaatatttatgtaacttttgtttcttatcattaaatactgcaaatctgtttcttcagcatgtattcaagatggagcaggaggagtacaaaagcgaaaaaatcgattggagctacattgaatttattgataatcaagatgttttggatttgatcgaaaaggttgtcttggcgaacttatttaccaagttcaatatggacaaatcactttatgcttagtaatttgttttaatattgtaatagctaccttcttttttttttctctgtatcaacttgtttcttcgtatgccattttatattggtcagattgccaacttgcatttgcatataatgacacctttacaatttagttacttatgtcttagagctggtattatgtttccctttgtgctagtgttggtggaattagttactgatgacattagctgtagttgttgagtgtttgacacgttcgtccattactagcaccaacctgaccacagtactagcatgccacatcccgctaaagcgttatcacatattgtcatcttttatagtattataccgggttctaagcacacaacaatgatgttaaagcttttgcgatgtattagaagaaacttcagctaggcttgacagatcttatttattcatgccattactcctaacagttcaaacttccataattgaataactagaaacacatagacttgaatgaccagaacaaacattcaagatggcttggattgtagaatgcattaatgcatacaactgttgcacttgcaaaatgtccgcaagcccaaagagccaaaacagcacgttggtgatttcaatataattatgcgatgatactattttgtaaaaatcttgacaaaatatgcttatcgtggcaaacataatttgcttctgcaagctttaatatctactgcatcgaaagtgtccggtgcggtaactataaaatttatggttattagtgttcagattatatctatgttatgtttgggactggtgcatgcttgtgtgagacagtttgctgtgcagtaatttttgattggtgtcgcttttgaaatgctattttgctgttggaccagcacttataacatatttttggcagcccaatgctaattcaattgtatgtacttgcagaaaccgattggaattattgcactgctggatgaagcttggtaaatcgcaatttttatttttgctggaaaacagctgtttttattaacaaatagataaccattctaatatatgttttttattttccagtatgttcccaaaatctactcatgagaccttcgcaacaaagatgttcagaaatttctcttctcatcataggcttgagaagacaaaattctcagagacagattttgttatctcccattatgctgggaaggtatgttaagtaattttaattattttttcctgtatcaggtatcaacaataacaaagtcgaccttttgcaggtgacgtatcaaacagaatcgtttctggagaagaatcgagattatattgttgcagagcactgcaatcttttatcttcatcaagatgccctttagtttctggactttttggttcattaccagaagaatctttgagatcgtcatacaagttctcatcagttgcttccagatttaaggtatcagcaaaaatttctttgcttcttggtctttgaaatttgtctgcttacatggtttatttggtcacatgtgccataagatattatttactctagaaaataatgtggttaaatgcatctacttccaaattatgatctaggtagtgatgaatagtgtggcagatgtaaggaaaggaacaaaaagaaaaatctctctccactatcccacctttgcaagggattttcatgtaaaggggattgaacttgttagaagctatttttgttgtatcatagcaatattttgcatgtgtttttcctccaaatattgctgtttccttaaaaataaaaaaaattacagtacatatgctcattgttgatttatataggctgatcttcacttttggaaattatatgtttccttgaattccatttgcagttgcagcacatgcagaagtttgaaccgtaattgtactagctttgattgttttattcatttcctttcattcctgtataatggttgtaattaaggcactgacttgctatattttcatttctcattgattgccttggattgtattgaaaccataacatataaccttcctaactgcggtattatattcattctctctgaagcaacaacttcaagccctcatggaaaccctcaactcgacagagcctcactacgtacgctgcgtgaagcctaactctgttaatcggcctcagatgtttgaaaatcagagtgtcctgcatcaactgcgctgtggagtaagaacatacgccttaaacattaaacacaaaagcaatagtatctgtttcttctgcataaatctcttgaaaagcacatctgcccatacatcacgtcatcacctcttgagcagcacatctgccttaaacattaaacctcagtttgctgttggcagtatggcactatgaatgtcgaaatgctaatgttcattgtgggtgcttcaagttatacctttgtgcaatagatgagtaaagctttttttggtcctatgccaactttcccaattcattgtgcaacagatgagcaattcctttgttaattgttggcactagcggatgatttgttggccatatgccaacttacccaattcattgtcttggttcatgctgtactgtttggacaggaagctatcatgtgacttgagtaggctatagtcacatgcaatccacgcttttgtgatcatgtatatggagccacattcataaaatcacttaataagatgtttactctttcgtaactgtatattggtattatacatcgtggtatgcttttgctttattgaactatctctagcaatacaccagaaaactccttaaattgtgtgactatttatctcaagctattcatcacttttgaagttttaattccatttgttgcttcatgcatgaactggtcaatgttccttgaagattgtaacttggtcatttgtcagggtgttttagaggctgttcgcatcagtcttgctggctatcctaccagaagaacttacgctgaatttgttgaccggtttggcgttctagttcccgagttgatgcttggaaggtatgcaatttatacttcattaagttaattttgagtttgtgcttcacattgtaagttgcaatggcaactttcttcttttctttttacggttttggcgatcttaattacagctgcaaatcattccatttgttgttggtgcagtctatagctgattcatgttccatctgttttggcctaaacagttagtaggtttgttagatctgatataaatgttctccaacaaacaacacttttttgctcaacatcgtggagctgatatctcttgtttgtacagcaacttgtatgtgtgttaccgataatgatattttagccattcatggtgctactttgatccagcattcccctcatcaattagagtaggccaaaccaaccaatggatttttatggcattttatgtaatcccgttattagttaatgggttcagcgctagcctagcagtttgaattaacatacacaattctggagcaactcaaacacacaatatcttttcaaatggttgccaactttttgcctattcgatgctaaattcctacatttactaccctctttcctatcctggaatggcaatctgactataagctttaaattgttaggttttgcgtgaaagtttggagggaatttatcaagggccattgggaaaaaggagctgcttatttgtttgtttttgattgcattaccttatgtgatgttatgtttaactgtgcagttatgatgagagggcattgacaaagggaattcttgaaaagatgaagcttgaaaattttcaagtaatctactcaacagattttatattactgtcattccctaatatttcttgtttatataaagagtaaatttcacaaaactacatgttttatggttcaagttgtagaaaaccacacacattttgatacttagcacttaagtacatatattttggtagtttagtttcacaaaaccacacta

SEQ ID NO: 72595 - DNA, 6096 bp, Oryza sativa
ttcctgcagcccattaacaccaccttgagagtgttaggtacggttagattcttgtttaacttgactttgcctcttcatggacagcctaatttggtgatttcttttttctcgataatttgcaaagagaacccgaacagcatcttcacactatataaatctgtaaatctgcttcatgaaacaccataattggtagaaggggtaaagaagaccagggtgtggcctctttttagctttgagtgatcaaagctaagcaaagctaattagaggcacttatgaaagctaattaaagtgctttgaatctaatctaatctaatctaagtacggatttcacaagtggaagctggaaacagggagcaaaagagaccctgtccggtccaggtgagccctgcgtgcgtgtcacgtgctgccgctaagctaacggcgttaattggtggcttttccgtccgcccggcatcagaagcttcgctaacggcgccgtcatgggacggcgagccccagtgtggggcccacggtggcaggtctggctagtgtgctatgctcacctcactagggtgatgggtaggctttggctccatcacctttgtcattttcttttatttaccttttgttttacaattcatatattggaaaattctaagctgcccttacatcactatctacagtagttggtgttaaaataataaaaaatatttatatatatagtttttttatgtaaggattgatttgaaaaatgtgtctcagcataaaggttaataggtttagttttgcttttaataggttaggttctattctagtattatgtaaagcaacatcatatctacatgtcattgttttgattttatacataacacagttaggacaataaaacacaaccagaagctaattagatgttacttttcgttttacaattcataatttggaaaattctaaccgccattagaacactgtctacagacgttaggtgttaaaatagtatggttgattatgaggatcgttataaaaaaatgtgtctcaacataaagattaataggtttagtttttcttttaagagtaggttggattcttcattttaatatgtatactaatgtcatatatacactgtcatccttttggttttatccaaaatataatttatatagtagaacagaatgacatgacaaaacattgattgagttgtgtgtcttattatccaatcgaagaagcgtgttctgaagcttaagcaaaccctacatttcttgtacggttgcatgtctaattaaaattctcataattcaagatttaaccccctccagaatccttccgcgcattcaatcaaagtcaaactagaaaccacaaccactccaaacaataccctatctaatctaagctagggtcgtaaaataagacaattcagtacgactattaatacaggttcagtgagcaacccattatgtaccgttgatatcgtcaacattactcgttccccgaccgcataaattccgtcattaccgattaatcgacatcgactcttttcaccccaagagtagaagaaggtgaaaaagaaaaattacagtgctaggtaaaataccaaaaatagtgtaggaccatttataaaaggggggtgagttcaccatgggaggtgaccagaatcactgcagcacactggcaaccgtataagcccaccgcagtctcctcgcttcacacactcctcgctccactgccatttcccgcgtagccccctcggcttctcttacatttacattcaggtcctccccccctcacggttcttcacgcgcgcgagggcccctttgttttctcgtatttacaaacaggtccctcccatggacaagaagcagggcttcttctccgcgctccgggaggaggtcgcccgcggcctctcgccggcgcgcgctcgccgccggtcgcaggcggccgccgcggcagaggtggccgcggcgctgcggtacgcgggaggtggtggtgggggggagatgctggcgccgctcatggagggcccggatccggagtcgggagacggcgggagatcgtcgtcgtcggcggcggcggcgaggagggaagggtgggggcggtgggtgcgcggccagctgtcgcgcgcgccgtcgacggccggcgcggcggtggtcgcggcgggtggtggcggcggcgcggcgaggcggaacgacctgaggctgctgctcggcgtcatgggcgcgccgctcgcgccggtgcacgtcgccgccggcgagccgctcccccacctcagcatcaaggacacccccattgtaagtgctcttgggtgaaatcctctcgagtgaaaatttcggtgaatttttttttgtggattttgagttcttggattaattaatttctaaagtcgccacctattcaattatttcttcttctagaaaaacctgctggttcgttaggaagaaacaatatgaaaaaaaaaagaaaaagaaagaagaagaactggttcttgatgtgatgtttggatgtgatacattttctcatatccactgtacaaacggtttattcctcatgtagtgttctaccatttcactttcagttacccatttactgaaagaaaaaagaaatcagcaactctttgatgtagttgtaaaaagtattttgttgtagctgtaagttttaccattacgatgtgttcttgcaggagacctcgtcggcgcagtacattctgcagcagtatctggctgcctccggggggcagaagctgctgtcatcggtgaggaactcgtacgccatgggcaaggtgaggatggtggcgacggagttcgagaccggcggccgcgtggtgaggaaccgcatggcggcgcgcgccacggagtccggccggttcgtgctgtggcagatggccccggagatgtggtacattgagctcgccgtcggcgggagcaaggtgcacgccggctgcaatggcaagctcgtgtggcgccacacgccgtggctcggcgcgcattccgccaagggccccgtccgccctctccgccgcgcactccaggtagcacaccggggagcctgccatgtcttgtagtttgatgtcgtctgaaatgtgccattgtgtgtatatggtggaagaaggtggtagtctaactgaaattgttgttggttcatattgtatcttcagggcttggatcctctgaccgcggcgagcatgtttgccggtgcgcggtgcattggcgagaggaaggtgaatggggaggattgcttcatcctgaagctgtgcgcggaccctgagacgctaagggcgcgcagcgaggggcttgcggagatcatccggcatgttctctttgggtatttcagccagaagactggcctccttgtgcatcttgaggattctcacctcaccaggattcagtccaccaccggaggggacgcagtttactgggagaccaccatcaattcgttcattgaggactaccgcccggtggagggtataatggttgcgcacgctggtcgctccgctgtgaccctcttccgtttcggagaggttgccatgagccacaccaagactcgcatggaggaggcatggagcatcgaggaggtcgcgttcaatgtccctggcctctccatcgattgcttcatcccgcccaccgacatcaagtctggatccatcagcgagaccgtcgagcttcctcatggcgagaagagcaaggttggtcttctccaatgccatagtgctaaggtggccgcgttggagaaggcagacgacaacgtcgcgtggagcggagcactgcagcgagatttcaagtgatttgctgtctgttcatagttgcttcttgcagtgccagtgctactgactcattttgatggttgtagggtagcaagaaagagccaagggaggatgatttggagctttgcaaattccaaatgtcctgtaaataggaagcttaaggaattcacatggtcttccatatccctgaggaggcctattgtgaagaacccttacctatcttattcagatatatggtagtaggtagttgttagtaacttctggcgtttttttttgtcggtgccttgtggaagaaccaggaggggtgtttctcatcctgcacccaaccacatggtaagggatcatggtggtggtgctgttctttctcttatagcgatactaatttatcggagcccagcgaggaagaagggtttcttctctggcaattgagagtgattttattctgattttagcagtccagtgtgcttttggttggtgatagtctccggtcaaaactaactttaggtgaaagattaagagttctgaattgctgttgctctttgtttagggttatcatgatgggtctctggttgtttttttccctgtccttccttcacatctctctttatttatatagatggtggttgtattctacagaagttgatgtaagccagaacttctaatgaatatcatggaatgaattgtttctttttgtggcttatggactcaatttgcccccacactcctgcatgctaaagcaaatgatgttagcttttgaatggtaatattgttagttgtataatgcaacatcaatgttagcttttgccactgcttgcattcagctttagtatgctgtatatgctggggagtatgattcattaatatgatggcatggtccccatgtgcttcagcctcaggtgctgtgatgaatacatgtatttctcttctttcttatgaggtgtaattagctttgccactatgatactatctttttgtgctccattccctgagaagcgttcagactttcatcagcacaatgggtgccaccactctgatgccattagcattgaatccattgatgatctttgcaacactctctttcctcctgtgagttggaatagttttattcttagggctgtgtgttcttcttgggaagaagagatcaatgtctctagtttaaaaaaaaattatcactgccctgcctcaagtctgaaccttctcagacccttctgacctgtcctctctggtcaaattcttgtagattggagctttgcagaagtttgtagcacttgttggagttttgaaccattcaaggccccttcgatttgtatggaaaacataggaaatttgtagggtatgactcctattgaaaaatttcctatttggttctttgagacaaaaagattgggacttcaacaatcctatgaaattcatgtgaaatggcacaagacaatacaatttcgatttgacatgaggaccaacctcatgaaaacctacattttgttttatctctgctctttttctttttttttgcaggagttttatctctgctctaattcgtatatttttttcggtctattcaaatggcccttcctgtatttttctttcttttaaatatttgttttacacttgcgttctcattaaaatcacatatttttcctattatcccgttttctcattacacatgctggaattgaataccaagaaagccacacattccaaaggaagcctagaaaagttcatacaaccatactagaatggaacaaagcaaactgaacatgccctcaagcatcactaccttagcctagtttgacaatgaagccgcctcctacacacaaaaggctacacaagaaaagcatgcaagaacaagctcaaccctactcagctactatccagcaagagcaaaattattgcaagccgtttaattgatccttcattttcacacatggttccaaaccggaccctacgtctccagaaaccgaagaaaaattgcgcaaaagatctcccaatgcattgctgaaatcaatcaaacacacatgaatccagcgagtttctgcagctttttctccttctgaaaaccgtttgctgcatttgtgtgttttaaaagttcagagatcgatcaggaccacacgcacacacacacactgctgtcactggagcactccaaggttgttaagagcagagagcacttttagacttggactttgaacagcaaaacacacaatcaattatggagagaggagatgtgtgtgtgtgtgtgtgtgtgtgtgtgtgtgtagggcattgcatattgctctctcttttgacttgggtgagctaaaggtgaagtcttgatcaaaaagttcagagggaaaagttgccctcacaagaaaaaaggaaacgttgcc

SEQ ID NO: 72596 - DNA, 2043 bp, Oryza sativa
agaactacaagagagagctgctgttcttctctgtccctctatgcttgtaatgacttgatccactacctcaacctctagtcgtgagtggagagctcccggtgcctcctaggcctacttccatgtgaaccagcactgtttgattccatgcacttatacttactgtatgaaagcttcatgatgcatgtactaattaattaattaatgctgtgatcgatgtttagtttttttcctttcacgttgcatcttgcatgttttcggcgaaaatacaattcactatgctgaactcaccgcacatgtgtattgacaattgcaagggatggccgtcgtcattgtaaacgcttccctaaaactgctcttccatctctttctgtgtctttctttttaagatgttggaacaattgtagatcgcaactcgtttaatttctttttcatctctttaggcatataattccttttaaaagaatagataataataggtttggcactttcaaaagctccttagtgagacggctaacctagacagttaacgttagcactccctggtgtagtcttggatgtgtgggtctcggtggtgggagggcgggggtcctcctactttgtaaatattttgttctttgttttttcttccccttgaaatgaaacgcagttctcctgcattttttagaaaaaaaaaagaataggtaaatgggtgactgtgtgaaagctttacaaagtcgaaaggcacattattttttttgtgctaaagtttgccggcctaagaagaaaaaggtagatcattacaaaatgctccacacactaaatggtgggcaatgccagatttcttccaccaacttgcaaattctttggctatgccataaacttaattaatgtaatttgtccatggaaagatttcagaccaaacttctgccgcatatatacatgcatcgaagctgaaggtccatagctacatgcatgtttggctgactaccaagcttgtgaaaccttcttatgtggtcatcttcctcaacttgattcgttggttggtgtcaacatagaggacaaaaaaattagaagttatccaggagagagctagcctatatctgcatcagcgtagcattatttgtttccagcctatctacaagttggaaggagaacatgatactgaaagttcatgtaacatgacaattctcgatgccttccaaacctagataagtattttggcttttgtgtatgggcatccatatgcatatatggacatgaagtcaccacgattcactatcactctcatgtttcaggcttagagttttctcatctctcatatatatggtccaaaaagatattgtatatatggttaaacattgtcaccttattaattcactacatgcaactatattaaattgggaacctagctagctacagggttgccagctgaaagtgagctgtgtaggttcagagtattctttaacttcaatccttctaatttttggcccaactgtgtttccttttcattaccctccttccattttgtttgaatgcgggaagtcacctgcttagagagaataaacttgctgttgggctgattttgccccaattactagtttggcccagctcaaaacaagaatgtaccccatccgttccatgaaaaacccaatcctacaactataaatctagataaatgtgtatccaggtttgtagctaggattgtttttttttaacagagtagtaaactctgttatgcttatcaatttgatattggagttgttgttttaacatctttctaaaatttgaatactatttattcttgtccaaagtttctaagtataaataaagttttcattcccgatgaacgtttgttagcataaagttatacaatttagaatttttgtggtagaaagttttttattcctttagaaaattgctagttaaactgcttttttactatcgtataaagtttctgaacatatattttttatttttgtagaaagtttatgagtaaaattctatttattatttgaatagactttggattgaaatggaagtttcataatgtagtaaaaaaaggtt

SEQ ID NO: 72597 - DNA, 5797 bp, Oryza sativa
ccattggagttctcttctatatgaccatatgaataatatgagctcgatctctgcctctctgctcttgtgacatctttttgtagggcaatgaagaacagtattatctcttaattgcctgcaaaaagtgtagtccctttgaaaatgatagactgaaagcacggatcatgattcatgaaaaaaatgatcccgggatgcagagtttttattcagcaattagaattttagttggggtttgtcccatcaccttatggcttgattttcatataacaaaaatcattggttctgtgccttatggtggagaccagagatgtaaatcattttcattatctaaaaaaaattcaacaaatgccaaatcaatcacctcaacattaatttttcctgtggaatgcgattatgattattcaaccttttacaataagctaagtgcaggagcattccactggacaactattgactcttgatgtccaacggagactgatgaatgaagatcttgatctttcaacttgagaaccagttttgtaccctatgcctcccaggccaattgttgtccatggcaagaagacaggatctgccaccttgtcttgctcatcctctctatcagatcaatgcctgccatagttctccgatcctcctatctgcacttctttgtggccaaaagagctcaaatgcatgctcccatgatctcacgtacgtactcgacatttgtaccaaattggcatggcaaattcataggatcaaaatttgaggtctacactttgggggtcatgatgttcggtacaatcgaagattcgtagatgtaatagaagagctcatgatgcctcaatcacctgcatgttcttttatggaacaaaaagagaccacaccaccatatgtcaccactaagtgttgaacactcacggccgtcttgttgagccaattaatttagataaaaaaaaggataggcaagaaattagttatgccctcatgtgtcacaaaaaataaaggttcgctgtaggattatagattcatgaatggcgtgatatggcaacatatgtaaaatgttccaacatggtacatggatgacatataaaatgtgggagaatttaggattagttggagaccagtgtgcatcatctctgcagtttacttataacaattcaaggatttccacgatagatgattttatttttcgaaattcctatgaaaatgcttgtgcaaaaattcaaacttctctttggtcccaacactttatatagagtcaaaataataaaatgggatcttggagtcacaactcgcaagcaagttcgaagggttgagcgggaccagggtcagagacacatcaacatgctcgtaaccatgtacttgttcatttacaaactttttatatcattttttagagaattcttctatttagactaaggaagcttgttattgaactcgtatgattttctagagattttttgtatgatatattcatatcacacaaagtggaaaacattaatttgaactacatatgaaaagatcaaggactaacaaaccacatgatttacatgcacatgtcacactgtctggtgcatgccgtttaaaaaaaagaacgaaataagtggaagtcatgtcgatttataagggattcaattaacaataagcagacactgaaatcagctcactctgtcccaaaataaccgcagagagttttactgattggcccaaaatttaatgtgatcagctcaacaatgtgcaaggatatatctcacgtacaggacatggcagttgggatcacctagccattgtagattatgtgcaccaaggagaatgaaatccaacaaaggctagtagtaagcggcggtattgctccatcgcaagagtcaggtttacttggcgatggtaaacctgatgctggattggggggaatggcaactcctttcacctcttgggcagcgccttgcggcatcaccatgtctgtcccgttgtgagcaaacagctcctggtgcatcccaggcctagcatagcaaccgggccactggtctgatccactcttatcatttcactctatcagcttgcagcacttgccacttgggcttttatgtctcatcttatatggagcaaaattggcagcaaggtatttttgtttcgataatggataaaatccagccttttgcttcaacagaagttatatccgcgtagtacaatgtacctggttttaaaatcaaaataaagtatctaaccaaaaataaagagaagacacgttataaagccaccaacataaagggagaaatacaatttattcaacccctgttagtaaatttttgtttaaagttggcgaaaatttagtaaacctttgtgagtatcgatttacgcaggggcggatcctgttgtgcgagatcacccatgtcactgacagatgaattatttgatccctccttgaggacagttactttgcagccaagaagtattctgcacctacctttcatgtaatgttagtatatctctccattgagaggagagatcccagttgatcagcacacgagggtaaaatattaaatctgatgaaaattctgaatatccctaaagaaaaactatgcaggaaagctatcatcacgtcacgtaaaaactgcaccgaatttatcacaccaagttagggatttgatcctaccgaaagtacgtacaccgaccaaatttaataacataagtgtgacaacatatatacacaaaaatcatcaaaaggtgccttcacactgattttggcttctacgcctccaagacggaactgatgaggatatatcttactaaaccttgagttcatgaagcatattgatgttctacattacaccaaattatcttcgaccttccgataaatgtagtttgttgatgctttgtttctaattctgctttttccctttttcttttgggtaataactgattttgtcatttccgcaactcggcattaataagatttgatcgtccaaatccttcaactgacccggcatttttagaacatagttgtgcctcccaagcattcaattgcaggcatgatatgaggctgcaccaaggaaccttctgaatgtgtccaacatttgtattttggcagtgaaatgtctccaattccaatggactaatgtgctcaaacatttcgctgactctaggattttgcaagaactgcaatatgtacgcgtgcaaatttatagttagttactgtaggacggcattcatcaaatcgatctaatttgagcttgtaagctatttttttgactgaaagaaaagagagataatgaggcaagaacttacagtagtgtcacgttgtagggtgagcagggttcactttctcgccggtaaccgcgcggtaaccgcggttaccgggcttaccgtggggggtcggtaacgaaaaccggcggtagggtttgggcaaattttgctcaaattcaaaaatttgaaaaataatcgaaaaaaatcaaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctaccgtttttcccctctctcgcgtagctgcgctcaggaccgaaggggcgacggcgtgcgcccgcgccaaatccgccgccttcgcgccggcgaggccggttcccgcgcggtaagcggcggtaaccgcgcggtacgcgacggtaaccgcctgggtcgacgggcaagaggtaatccctccgttttgaaggttttcgcgcggttaggagcggtaaccatgcggttttgtacggttaccatcggcttcgtaatctatgagacgatatacgtatgtgcggtaatcgtgtgaaaaccgtggtaaccgtccaccctaccgtggttaccatggcttgaaccgtggtatggtattttttactgtgatatgcatggacatatcaatagaacatatttttaccaatatgcatgtgaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagtctcacgacaagacgaaaactttaggagggatgttgaggagcgtggtggcacttatgagcatggcggtgggagtggatccgctcagccggaggcacggaaaggtagaagtaacccaattaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgcgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtagtacgcgaaataggctcggagcatgttgttcaaattatcacttacaatggctctaactacaagaaggcgtgcagactactacggcaagaatacaagacaattgtgtggcaaccttgtgtggcacacacagttaacttgatgcttaaggaggttgggaaaatgccagaccacgaaatggtgattgagagtgctaggaaaatttgcagatggctatacaatcataacaagttgcatgctatgatggtcttagctataggtggtgaactggttaagtggaatgctacaaggttcggaacaaactacagttttccagagtttccttaggaagcgagatcttttcatgcaatggatggcttcctc

SEQ ID NO: 72598 - DNA, 613 bp, Oryza sativa
atccgcatccgcatccgcgaccgcggcgcacaggtgcgcgggcgcctctcttgcgaaacgggcaaaaatcacgggctcacagcacggtaggagtactagggcagacgaccgttcacggcacggcacgggacagcgcgcgcgcgtcgtccacggaacatctcgggatacggtttttctttcgtaggagaagcccgtaggacagtaggacaacatgagtagcgtttctttttttgtcgtggtcaaaccatgtgtcgtcaattggcattggtccgagtgcgagccgatttcatcgatctccgatttttttttttagaactttcctctccgaatcttcgcaacagcaacgcgacaaacccgccccagcgacccccgcggcggccgtgacgattttaccatcagttgattgccgttatcacaggctaggctagcctctttgacactgctcgttccatcagttgagtagaaatgatttggttttgacaaatcactatctattacatatatacaggtaatttttagggcaatgcactggctccggtttttggcacagctacaaaggtgtgaggatgatggggaattcctaaaggctgcatgccgcagggggctgcaggaa

SEQ ID NO: 72599 - DNA, 691 bp, Oryza sativa
cggtgcgcacgccattgattcgcgctggggtgcgcgttcgggtactggtacccgcacaggtggcacaccatgtggttccctcctcctcctcatccgctcgccccctcccctcctcctcctcctcgtgcagcgcgcacaaaccaaacacacaaccaccacgccattagagacaaacagacacatccccagagagagagagagagagagagagagagagagagagagagagagagattgaaccaaaacttcacaatgcggacagcacgggatgctcaccggcggcggcggcgcctctgctcttgtgggcgccgctctccatgggcggcgagagctcgaagcttttctcagtggtcggcaatggcgagagcgaggagagagtgaggagttcgctttggtgaagacgacacgagaggagccccggcactgcgttaactccatccacccccgtgccggagaaagtgacacgtggggcccacggggcccaccataagtgggccccattcgtcagcgggaaagttaccgaggagggggggataaggcccccacggccccaccaccacctcgcttttggtcattttcgtgatgctgcggtctgcgtggagtgagatctgggccgtcggttggttggttgatcgatcgatggacggagatgcgggcgtcaaaaaggcggtaacaaaccaaccaaccaagt

SEQ ID NO: 72600 - DNA, 5890 bp, Oryza sativa
taagctaattaaagaaaaataaagattagctgatgatatcatggccatccaaatctataagagccagcagcaaatttgacaggataagatcctcttcacctgcaactcatcagcaagaacatgttctgcttagcttctacaggtatcagataagcaaccaatgtgtatgtcggcatggcctgcaaaattactaatctcacatataaagtcagagcagtcactgcagatgagaattttctttactctgaatttgagtggttgcaagagaattcagatgcagttgagtgcactgcagtgcagctgcgaggttcacccgtttgcagaggtcatttcagaacatgtagctcagcatatgcctgtaacaagctgttgggctgtgacctgacgactccagtccagtggtgaaggagagatactacaaaagttgcaattccttttcaatttttttctgccggctggatgatcgtgtcggcagctaagcttgaacaagctagcttaactgtaatcataaacttttgacaattccctctgaattttttacttctcctccctctattcttaaaatataaaaaagatattaggttcgtctgagtcaaactattctaagcgcaactaaatttttattagaaaaaataacatatatctcatcaaagaaatagactgtaaatatatatttcatagtggaccaaatgataacaattgatatcgtaaatattattgtttttttataaatttaatttaatttaaaataatttggcttacgacaaacatacgatctgtaggacggataataatgcagccaattgtttactgtatagatatttatagcctatctctcagctcactcatataatggttaactctttaatataatagtccacatgtctgtttcacatgtctgtttcacagattttcttggtttctatgtctaaaccggttctaaacttacagcctgcttctcatctctatcctctcctctctcatccatctcagcattttgccttctcatagattatacttgctctaaacagtaactttcttcaccctggctttttagcaaaaagatattattactagtagctgatactgcaactttttttttactactgttgtaacgttgagactgtgacaagtgtcccaaatctagcagtaaaggctgcatgcatattggattctcctgacttttgaagaccctcatgatactgtattttgaatactttgaaagctcaaagtgagaaaaagaaaaggtgaaattaaggagtgaagagtagggaaaaatcatgagtctttctttacattgatgtattgtgatggtggcacttattgacatttgcatgacactatgacagtaaaagttttgtactgaagtagtactagaagtagcttgaagctgaaaaaatgaagtggagtactcaaagatgtgactgaagctgaaaatgcagggactgtcggcatcatgcatgtcatgccggcgtgatagttccttcaaagcttatgcttatatttataaattaacttttgaattgtaaaatttaattttggaattggttttataggttttcattgtagtttatttaaaaacttttgaatcgctaaagatatatttcctgcattccaaattgatttacatatttcataagtacatcaagaccaagaaaaaataataactctctcctactatatttactctagcaacaaactcgatgtatgcaccatactcattatttcctagcaaatagcaaataaatatattgcatgtgggttataaatacttgtgtgcatagatacatgcatcaatgtctatttactccaatgcacagataacgaatagacttaatgtatgcaccatccccattatttcctagccaatagcaaataaagatattgcatatgggttataaatacttgtgtgcatggatgcatgcatcaatgtccatttactccaagcacagataacgaatagacttaatgaatgaacacaaatatgtatatcgtttaggaataaccttaaaaatatatatgtagatcaatttgaaatggagggagtagtatacagtataaaatttctactcataagttatttaaaaactgttgataagcgattcacataagtataaacaaaagcttaacaataaggtcgtagtcaaacaacctaagctgtcataattatatttctggtttagcaactctgtgtagattaactccctccgtatatgatgtgaccatggctactatggatacaaccattgctcacatcatggatcaacaagaagacatcaagatcaagtcctccaaaagctggaattcgattcggccacctgctacattgctgacttcaaacggccgccaaattttcatacgagctccgttttgggtccatgagtacttgatggaaagccctccaagtcctcttttcaacggatccagtcttgttctcagattccatcttagtcgacggcaatcgcagaaacaagatgttgcgtcacctgtaatgggcctatgggcttgtaacttcgtctgggaccccggcccaagtggggcccatgtggggtgcgccccaacctggtggagaacgaccctacggcaccattggtcatcctcccacatccttaaatagctaggtaccccttcagggtttctcgggttttgatgatagagatagctacttgctaccggctcgcagcgcgcgtgttggctaaaccgctcgtcttcctgtaatcagaacccccaccatattgtgttttgatagtgaaattttcatctttatctagcaatttcagtgcttgttctacttgttcttgcttgttcttcgattgcttgcaggacgagtgccctcgtggccgggttgacgcgcaccacaagttcgcggcgaccattggagacagtgtatcggttgctaaggcgcagcgtctttggacggttgtagtcgggccgtgaacgtcgtctttatccaatcgagttatcccctacctctcatcgaaagatcgggccacaaaccctagcgggttcgcatcaggtggtatcagagctttcgttgctcggtgagtttttatctacccataaccagaaaatagcccgacaaaaagaaattgtatcatttacctagccatattgtgccattgcatagttcttttcagtttttgctttgttgaattttgtgttgcatcgtcacgtcatcttgctggtcttaacgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttattgtgttgcatctagagtttgccgatccttgtgtgtgtttgtttttgccgtgcatgtgcgcgtgaggaagaaggaaggagaagatgcgcatgaggaagatggaaggagaagattagactagattagattgctttcgtttctatttgggggccacgcagaaaaggaataggtttccttctttcagaaattctcaccgagtcccaccaccttccatgcggcattccccccttgagtccgactcccctctcctttcggttcaatctacaccgtgccatcccttacaccttggtgaatttttgtttggtgtccgtttcaagatccgttcagaaaaacagaatcagtataaattcagcattccatttttgtataatttttaattttggtttgaacttttacatttgagtccctataaattttatatttacgtttgagtccctgtaaccttacattaaggtccttgagtcagtttttgttaaaaaaaatcaagaaaaaagtgagagaaaaaaaaggcagaaaggtgcataaaaaaaagaaaagaaaaaaaagatgcaccaaaaaaacagaaaagaaaaggaaagaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacctagagctccacagatttgattgcagccgtacagcaagtatttgccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttatttgctactaaccatggcaggattgcgcatggggaaacgagatggtcatgctcaacgtcaacatcttcaccatcaacgagatatagcgacttcttcacgcatcacatatgaggtacatgatagtgatcttgcaagggtagaatctaaattgcctggttttgatggtaagtatgattccgccgcttatgttaattgggagctagcagtagaaaaacaatttgatgagtatgatttttctaatgctcaaatgattaaggctgctagtaataagtgtaccggttctgcatctttttggtggcatactgtgggaaataagcttgaaacttgggatgaatgcaaaatactgatgagaaaaatatttgtgttttcatactatagacgtgctttccttgagaaatttgaacatctaaaacaaggtgacaaaactgttagggagtactttcatgattttaaaatttgtattacttatagtgatttacaagaatctaatgagaacacaatgactagatttttcagagggcttaattccaatattcaggctgggcttattaacgtgacatataatcatataggcaacttgttcatgcttgcttgcagtgttgagagcaatattttaataaacccaagggagaaacaatctatgcttgtgcctcctattactgacattttgcagggagctcagaacattcaccatgaggagaagagcaatatgctcgagatgtcatctccatcactcacgaaggaagaagagaagactgatgcacctacattatctgaagagggcataaaaggtaaattaaatggtgctgatattactcaaggtgagtgtgcttctaatgagtcacatttgtccactatccatgctaatctagaacaaattttggtggaaactacttctgatttgcctttgtcacaagttgatttacttactattccttgtgataaagaagagttgtgtgataatgcttcacttatatccctaacacaactagtgaatgaacatgctatttctagtgtttctttgtgtgccaattttaagcatgttgttcacattgctaatgaagtacaggaacgtgaattgctatcttctttaaatattttgggctatgttcagtttgatgatttttgtgagctcaataatttgaagaagaaattatttgctaagtttgatttgccttgtccaactagtgctatttttcatatatttggcgaatctgatgatagaggactatatttggtgcatagagtttacatatgttcagatttagaatctcctatacatgtggataaaacatgcaagctagagagaaatgttattgctaacaaaattatttcgagtttgccttgttttgatttgatgaaacaggttattttgaatggactgtgtgaagagcaccatatggaaaaaccgaggacggttttcagtgaagaaggggagaatgatgtgaacatggctactatggatacagggctgcaggaat

SEQ ID NO: 72601 - DNA, 24541 bp, Oryza sativa
  unsure (1)..(24541): unsure at all n locations
tagacaccataggtcatggcactcatacttcttccactacagtcatgctgtcccgaatgccaacctctttggtttggccaatgggattgccaagggcacggccccaggtgtgcgtatagccatgtacaaggtatgttgggaatattacatacccgaatgcattaccactgacatccttgcggccttagatgagacgattgctgatggcgttgatgtcatctccatctcacttggtaggcccggctaaattttatctctatatttatttaacaaacgtgatgattaggagagacgatatatccgaagatattgagaaattttcacctgataataatgcagccactaggctcaagtaatcactgctagtgtactactcacggtcacatacatgggcaataacacacgacaactcgtctctttggccagttcatgtcgttgtttcttcgcgtcaggggagcaaaaagtcattagctgttcacgttcaaaatactcgaacaagcgagtgccatggatttttcgttggttcgttgtcagttcgaaaggattacaacgagtagaggcgcgcacattcgtgccttcatttttcgttggcttttactgtagcaacagagatagattgacaagcacgtaaaattaattctgatgcgcgagtccatttcaattctaacttagggcgactcgttttcacacgagtaattaacttagggccagatatcctcgtccctgcgagtcaatttcatcgtatcgcgcactgtagattgtaccgaggattgcaaccacagcgaccaatggagggctgcgtagcattttccatctgcaattgacacgcatgaaaaatcccactatcagatcatcaatccgacgggtccagtaataccaacctgcctgtcagctagctatgaatgattattattccaagcacgtgtttatttgcgtcatatcgcatcaaataatattagtgaatgattgaatttggcgatgcggatgggggaatatcaaaaagaaaaaaaaatgctaaatatctgctacctccgtaccataaaaaacgaatctaaaatcggatgtgacatatcctagtactataaatctaaacatatgtatgtccagattcgtattattaagatatgtcacattcaatactatgttggttttttatgggacggagggaatagctgtagaattttcccattaagagtttgtaacatgacgacctataaatctacatgctccctggttaatctacaatgagattgtgaacaatgacatactcccatgtcgtatttctcggtgatctgggaagcaaaggcacgtctcccccacctcatcagcgcggctcgcctgcctcgccaccgccgacaacgctgccccctgcggtggtggccggcggctgcatcgtcccctccttcctcccctttcctccctctctcttcctttccccttcttccttccctatctttctcatttcctctttttctccagatttgaggtgactcatgtggacgtcggtcctgagcttggctctcctccccacgtccgacgccaacggcctcccatcccgggctagcggctgcgttgaagatggtgggggggacggtcagatctggccaccctaggtctagatctggcgtctctctgatgggatctaggtttctctctggtgcgagaggccagatcccctgttgcgatgatggccagcggtgctagtgatggcagtgagggggacagttcgatctggtccctctccaggtctggcacgtcccagggtcgggtgaggccgtctgtttagccatgtatttgtaatataatagattgtaacgtgtactaaccacgaagataacgagttgtgtgcaatgtaccatgtttgattggaacactaatgtggccttctgccatcatcgtgcataggagcggatctaataagacataacatgtgggactgaacaaacttgaaaaactttagcccggtccttttctatggatgtatgacaaaaggaagatagggcttatatggaggctcttatagtcccaacgtcaaaagtaagggctcgagcccctctgtccctatgatagatccgtccctgttgtgcacctcaagcgtcggaatgccatcgatggtgaattctagtcatcctttggagtaaaggatttttacgggaattgactgatttgtatgagaataatacaaaattgatgtgttgcaaagaagccctccacctttgaagacggacgtgattgatggctagatcaaatttcacaatgttttttaatagtataacaaaagcagataatataaggtcaagggaatacctaagcctttagcatcaagtcttggaacaaaaaatatttgaacggttctatttgaggcaccaatttagaatgtataatagaagatattgccatccaaattaaaagaaagtctaaatacacccgtgaattgcaggtaatgtcctgctttttgtcaattctgctttagggcattcccaacccaatgactaggatgatgtccatagcattaaataagttaccacctaggataaaaaataatgtggcaagtgaataaatgaggaaagagaaggaaatcatgtcttgcatgagacatggtttctacacaatatccaagacatcatgtgagataaatagcattaaattgaagtatggaatagtggtgtttgcattggaagagtagtgtctagtactagtttcttgatgatgtggagtttatgaaaaccatgtctagtgttatgggttgggattgcccttagccttactccctcctttccaaaagataagctgcccacaattttagaaaaaataacatttgtaactattaactaatagtaagctaataatatgtatatgtagaaacatgcatatcatatctttagattcatattttaaaatagtttcatataatgttaatattaattatcgataatatattgtgaaagaaattaacgtttaaaatataatataaaaaatacgcatgtcttgtagtttggaacgaaggtgaagggagtacaaacaactctgtggactaagcacattacacacaccaccgtcattacttgtcttactagccagaggccttccaaggccggtaagatgtataaatttgcttggccctcgcctcccactgatctccacacacaagaactcactaaaccgcttaattactaccaacatttgcatcactgcatgatcaccccaatggccaaaccaccagcaacaacaacgctcgtcctatgctgccatctcgccgtggctgccgcagcagcagcgacatggataggacatgacgatcagcaagacgacgacgtgtccacctacatcgtgcacgtcatgcccgcgcacgcgccacgcctcgccacgcaccgcatcgcccgcgaccactacgcccccttcctccgcgagctcctcctccccccgcacgtcgcccgcccgccgccgcgcctcctctactcctacgcgcacgccgcgacggggttcgcggcgcggctgacggcgcggcaggccgcgcacctcgaggcgcacccctgcgtcgccgccgtggtccgcgacgaggcctacgagctccacaccaccctctcctcctcgttcctccgcctctcgccgtcttccgggctacaggcggagtcgaacagtgccaccgatgcggtgatcgctgtcatcaacagtaccatgcgtccttcgtatcagacccgtctttgtccccaacaccgcctcctacctttcgtggcgaatgtgtgtcgactccagagtttgatgctagcatctactgtaacaacaagcttgtgggtgcaaagatgttctacgaggggtacgagcgtgcgagtgggaaaccgatcaacgagacggaggattccaagtcgccactagacacgacgggtcatggcacccacagcgctgccattgcagctggctctcctgtgtcggatgccaacctctttggccttgccaatggcgttgccaagggcacggctcccggtgcacgcatcgccgtctacaaagtgtgctggaaaatggggtgcttcggctccgacgtcgtcgccggcatggacgaggcgatcgccgacggcgtcgacgtcatctccctctcgctggctgtcaaccgcaaaagaacttttgctcaagatcccacggccattagcggcttcaatgctgtccgtaagggcatagttgttgttgcatccgctggtagcggcggtccaaaggaatcaaccgtcaccaacacggcgccatggttgttgacagtcggtgcatcgagcatgaaccgccaattccagacgatcgttgtgctcggcgatggccagacattttctggcacatcgctctatctcggcgatacagatggctccatgaaatcgcttgtctttggtggtttcgccggctcagccgcttgtgaaatcgggaaacttgatgctaccaaagtcgctggcaagattgtcctgtgcgaggcggacaggtcttggatgcggagaaaggagtcgccgttgctcaggctggtggattcggtgtcatcgtgtctagtcgtagtagttaggtgagtatgctaaggccactgcccatctcaacccaggcaccacggtgcctaacgctgccgcattggagatcttgcgatacatggccaggacaccatatccagttggtaagatcctcttctttggcacggtgctcagctcgtcgccgaggatcgcgtccttctccgcccgtggcccgagcctcgccgcgccggagatcctcaagcccgaccttgtcgcccccggcgtcagcatcctcgccgcgtggtccggcctcgtctcgccaaccgaactcgacgtcgacacgaggcgcgtcaagttcaacatcttgtccggtacatccgccgcgtgcccgcacgtgagcggcgtcgctgcgctgcgcaagatggcacggccaagctggatccctgcgatgatcatgtcggccctgacgacgacggcgtacgtccaggacagctccggcaatgccatcgctgacatggccacgggcaagccggccgggccgttcgagctcgggccggccatgtcgacccgaacagcggccttgacccggggctcgtctacgacgccggcgtcgacgactacctcgacgtcctgtgcgcgctcggctactccgacgaggatatcgtcggtatcttcttgagggacggaacgatcaccaactgttcgacgcgggcgagcaccaccgtggcggacctgaaccgcgcgtccatctcggtggcggtcaaggcgtacggcgacgatatcacggtgcgacgcaccgtgcgcaacgtcggcggcagcgtcgacgccgtgtacaccgtcggcggggtgccaccgccgggcacgcagctccgcatcaggccgtcgaagctggtgttcgacgcggagcaccagacgaggacgtacgacgtcgtcatccgcacggtgtcctccggcagcttcgacgagtacacgcacggttccatcgtctggagcgacggcgcgcacaaggtgaggagccccatcgccgtcacctggccgccgtctcagagcgccgccgtcgcggccatttgatcgagcagctgctctaaccctctcgatcaatacgcatgcatgatctggctacgatgtccatctagtttacagctttgctttgcagtgtgtaatgtttttttccgaataagcagcttgctgcttcctcgctagtacaataatcccggtgtggtgtaatcctacacttttgtatcgtgcatgcatgataaataaaatcgagaatatatatcaataaatcaatggagtattcagccgaattatactgttcaagtaactattccaacactttgtttgcttagttacgttattacaactttgcaaaaatcaagcatgaaagcaatttttttttaaaaaaaagcgtacgttctgaaaatgcgggtaccagctcaatgtcttgcaagcataaaagagttaaaagacaataaactgaacccaagaaataaatgcatggtaccatatggtccagcctagaagcaacacagataatggcagcctacccaacatttatttgctagtaatacactatttctcccaccgtttcaaattattgcattctagttttatcttgaatcgatcatttgtatatctgtccatcaattgttaataaattgatagtttaccgcgagaataactttcatattatttatattttgcatgttgttgaattcgacaaatttatattgtcaatgataaaaatgtttgtgtcgtgacccaaggtcatggacaagattagggatagacgggaaaacacccttttcccgcctatcctgagaaatgagcccgaatacaaaataaacacacacttttactgacaagatttttagtattccaatatgtcctgtctgctacaggtttttttgtcagccttatatagttcatagatttacatatgagattacaattgtgcccttcgttgggcccacatgaaattacaatcgtgcccatgccatatgagcaaactctaagggcattttggtacattataggggtcattatagtttttggtgccagctagatggagtggttgagtggttcccaggaatattctcttggcatctttattgtccaagttgccttcttcatgaccaagagtcttttccatcaccatgggtcttctccacgaccgagggtcttttccaccaccatgggttttctccacgaccgagggtcttttccaccaccatgggtcttttccatggcatgtagtcttttccatctcgatcatcctttccgatttacctggtagctgacctgttattaacttaggaaatacccaaaacggataatgagacttagtgagaagaactcactcgaacggtattttccgactcgaacagtgttttccaactcgaatggcattttaccgttttccctattcgaatgaccctttgccactaggatacttatgataaaaactcaatcttacccaatctcttcctctatagtgttttgggccgaatatggagggacggtggtgaccccttgctacaacagtttgatttatggtaaaactagaatgacaagtaatttgaaatgaagggaattacatcttattcagtacacctatctgatgaaatgaagtctaataacttctagcatgggaatccaggtaatttagcataaataaaattattcaccactccaatccagtgagttacacatgtgcatagcgatgaacaggcaaccgatcccttccatgaagccatgggagcactaagcttcatggaaggatttggtctcatgcgtggagatctctgtccaagaaggacctatacaagctgtccccattgccaccaaaccagaagacacccaaatttccaacactactctacatggatgctgctcggccgttcgacggccatgtcacggcgatggggctagtgacgtcgtgcacgccgtcgctccaggtgaccgacccgaaggtgtactcggtgtcgacgatcaccgggttacccgacgcggcgatggtgatgtcgtaggacaggctctggtggctctcgtcgaacaccagcttgcttgggctcaccgtgacatccacaccggacgggctgtcgatcttggcttcgtagacggcattggcgttgctgccgacgttgcgcaccaccctgtggtaggtgactgaatctttgtaggaggataggacgacggcgaaggcggggtagttgaggtccccggtgcgggggaatttcgtcgaacagttggcgacggagccgtctgttgtgaagagggagatgatggagggggagtagccgagcgtgcagaggaaggagacgtagtcttcggtcccggcgtcgtacacgaggccagggtcgagcgcgcggttggggtcgacgtggccggcgccacggacgaacggcgtcgactcggtcccggtagccaggtccttgatgaccgcgctggagttgtccacgttgtacgccgtggtcatgagcgccgacttgatcgccgccgggctccagtccggttgcgcctggcggagcagcgcggcgaggccgctgacgtgcgggcacgacatggacgtgccggagatgatgttgaactccacgcgcctcgggtcgatgtcgaggtcggtgggcgcagactcgccggtccacgccgcgaggatgttgacgccgggggcaatgacgtccggcttgaggatctccggcgcgcggtagttggggccccggctcgagaacgccgcgacgcgcggcgcggacggcgacttcccgatgaccgtgccccggaacacgatggtcgccgtcggcgacggatcgctctggacgtagtacttgatcttgtcgccgaatttctgccccaccattgtcgccgggacgaggtgggagtcggcaaccagctcctcgccgctctccgccgtgttcaccagaatcatgccggcaccgccggccaccttcactgccccgcctttcgccacacgggcgttgctcccacgctcacacagaacgatcttgccggaaaccttcgctggatcgagctcgccgattatgcaaagccgagacccgcagtcgccggcgtacaccaccgggagcagtgtggagttcaggggttcgccggagtacagggacacgccgccgtagacctgaccgttgcctagaaccacatcagccgggaattcgcggtcgatggtagatgcgccgacggtcagtatccatggcgcgatgttcgtcgcggtgtactcgccggggccggagttgccggcggacgcggacaccacgatgcccttgctaacggcgtggaaggagccgatggcgatggagtcgcggaagaagctcggggcgtagccgccggcgccgacggagagggatatgacgtcgacgccgtccgcgacggcctcgtccatggcggcgaggatgtcggagtcgtagcaaccggacttccagcagatcttgtacgcggcgatgtgcgccgcgggggacatgcccaccgcctggccacgcgcgtagtcgaagaacccggcgccggtcaccggcgaccctgcggcggtggaggcggtgtgggtcccgtggccctcggtgtccagtggcgacttggactcctccgtctcatcgatggcgtggccgagagcagcctcgtatcccttgtagaagaactttgcgccgatgagcttgttgttgcagtaggcggaggcgttgaaggaggcggtggagacgcatccgccggagaaggacgcgggcggcgggccgagcccgtcggtgggcgcgaaggagccgcggccgatggggtagatcccggtgtcgagcaccccgacgatgggtgacgacgcgccaccggaggcggcggcgggcaggagcccggaagcctgggtaaggtggaggaacgccggggtatgggtggtgtgcagctggcgcgcctggtcggggtggacggcgagcaccccaggctgcgcctcgacgtgcgccgcctgttcgggggtgaggcgcgccgcgacccccgtcgctgcgtgcgcgtaggagtagagcaaccgtggccgcggtgcgcgcagatggcgcgggaggcgaaggaggcggccgaggaacacggcgccgccgccgccgccgacgcgcgtggccctgagcgccgggtgctcgggcgcgaggtggaggatgtacgtcgactgctctctcgcggccgccgccgccggcgacgcggcggcgaagaggatgaggagcacggcggcgagatggcggagggtagccatggcgcaccgggggagcggattggattggtcgatgactcgacgccaatgcggcctggagaactaaataagtggtgggccctttcaccgggtctggatctggattggccaatggcgatgccggcgtgggctcgtgggattctttacccgttcggtcgtcgggttacttttgcggcatcggattggacacgtcgggcctcacaagtctaagtatctcatttttatcgattttttctccggtttatccgtgactgctgctccagtttaggaccagtttcgtgctcgttttcatcaggatgtactctcactccgtccatagaaactccattttcagtctttgatataacgtttgagtttttgttttatttaaacgttttaaaattagtatttttgttattattagataataaaatataaatagtattttgcgcgtgactaatttttctaattttcttataaatttttaaaataaaatagacggtcaaatgttaaactcacaaacctacaagtggggtttttgtgagtagtactccctatgtctcaaaaagaaaatctaggattggatgtgacacaccgtagtactattaatttctaccccctccgttccataatatataaacttagaaccgaatgggacacttcatagtacaacgaatccaaacatgttgtccagattcgttgtgctatgaattttctcatccggtcttaggtttctatattagagcaagtttaatagtatagtccactactacctccaattcatctatagccgatttaatagctatttcatacaataattgcttactatactattaatgtatgaccccacctgtcatacacactctgcttcttggagtccgtgctgcagctagctacatatctatagcccgctgctcttctctctcattttttatctcattaaaatatgtttatagttggctaatagtatgctattgtacctgctcttatgggacggatggagtattaatttagacagatatactttcagatttatagtattgatatgtgccacatttgatattagtttggttttatatgtccgttacatagaaaattacttaaagtgaatgggacaccatacaatgtatctggacatatgtccattttcatgtccactgcaagcaacggcaacaaattcagtggtgacagcggcgacggatttttctccttgtcactatgccaccttgttgtcaccggcaatctaccgcgatctatcatcaatagtccaggcgtagttgggaagaaacaccggatgtcgagttcaggcaatagcgtttctgctcttcccaagcgacatccgtgctgcacgatcttcacacgcagaagcgttgctgcgccacatgcttcgtcgccgtatatcttctccgcaagcgcaccaagttttagaatttttttattaaaatatttacaaaaatagtttttagttttgaaaatttacaaatttaatcgcctgccgccttttgggatttttaaaaatcgcccttccaaaaggcggcaagggatctaaatgtaaatttttcagcacaacttgttagctctatgattttacaatttaaaattatattatataaagtcagatgaaataaaactttatatcaaaattatagatctcaatgagatctacaactttttagttaacaaatttttcatttaagatgttttagatatccaaatattcgttacaaaatataaaacacatttaaaaaaatctcagatctacatttcaaacgacattggatggagataaactttatataaaagttgtagatcttgatgagatctataactttgtaatttatcactttttcatttaaaatcatttagagtatcgaataagcattattagtttttaagcaattaaaaccggtagaaagggtttgaacacaaataaaaattttgcatttaggtcccttgccgccagggcggcaggtgattagatttgtaaattttcgaaaaaaaattatttttgtaaatattttaataaaaaaatgtataaataaaaaaaatcccaagttttatagcatctggcccatcaagctagcccgccgggaggctgatcgatccactcggcccagtaatggaagtatgaaacgccaacaaattgggtcggaacgggatccccgcttacgtagttacgggccgttattagttgggccggccgggaagggattacagcaacgaactttagcaaaagaaatgcgccttgagactaatacgcacgtaaaacggtacgataaattaactcaggaataatttagtattagttaaaaacttaaaagtgaattaatatagtttttaaagtaacttttgtatataatttttttttaaaaaatactccttttaacaatttgagttgagaaaatcaacaaaccaattcagcttgagtgtcttgattacttgtatcacttggcagtcttgggctgatgcttttttcggtggtccaattaacgattttatacgaattgattgtaccacagtatccccgacgtcaaatcaagaaaacactacacgaattcttgatttttgctccataaaacaatacagcatgtgtttcttaattatttatgtgctccaaatataataaaacctgtgattctctggagacgaatggccaatattataagcacaagtgcgaatcgtagtagcatgcaaattgaaaatcttccatgccggctgaggtaagctctgacgcatactttgcctataatttctttatatcaattattttttccgtgctgatagctctaagatgagtcaggacacgagtacaaagcagatggcagcggaatctcatctctcccatatccatcagtaataagctttgacctctgcgtgcttttttttgctcacgtagccgtgcagttacgccattttggaacaattgaatcgactatctaagtattttgctagtagaacttttgcagaaatttaaggagtatgtaaaattaaatgatataaattatgataagtcgaaaagaaaatagataaagaatatctgcattgtacgacggaggaagtaaataggagcccatgtacaattccaaagtactcactcgtacgatatcatttcctaaatttatcaattgtatctattattatcagtatgtggtgatcatgaatggtcggtaaaatataatcaagtatagctgtttgtcactgtcagtatgtcagtccctcaaacggttataggggtggctaggattgaaccaacataaattggcgcccatgcttttttagcgtatagaattttatcatccacaaacccgtcacaatccgtgaacgaacaaacttgaaaaatgaaatgctaaacatattcatcttcccttttccacacggaagaacagcagcacaataagtgaaacagtgatgcatcattgcatctgtgcatttaaagatatactcctgagtagactgaaaattctctcttcttgacgacagtaaaaacttttttagcttaacctccatgacaggttactgattaactaagcaagggtgtctcgtagtagtactgtactgtgtagcttaatatagcacgtcagcttctcagctctaacctctcaccattttcccaagagatatcgccatcacgatctcccgtaatcacttcttatataaaaagcaagcaagatgctacgagctaaacaatttctttagttagtcttcactaatcacgggcttaaacgcatcttgttacattctcatcggcaagcaaagagcaagagagaagagagaggagatggtggatgtgaagcacacggccggccacgccggcgcgaggagagtcaagctgttccgggtgccgcggcggccggccagggcggcggaggaggcgggggcgccgctggtaccggctggcgagaggaggaagaggaagatggcggtggcgaggctcggcggcggcgccggcgggcggaggcggctgttcggtgcgttccggcggctgcgggtgcggtggctggcggcgctgtaccgccgctcgctgcggcggctgcgcgcgtactacgccaaggcggtccaggacctcctcgagggcgcggcggccatgagcacgctgcgctcgcaggccgccgccgactgctcgttcggcactgcgttcgcgccggtggtcgccgtcggctactgatgagcgcgtgcatgtctgcagcaccgttctggcctgtgcatgaagaacatgaagccatggagcagtagcacccctgtgtatagacgtggttaactgtccatgatgaattccagtgctgatcttttttctctcttcattttatggatctcgagttctcgacaatgatcagtgttcatcctgttcgtaattagctagcatgtaagtgacacactttaccgagatactgagaaaaaaataacttatattagtggttaaacgaaagagagcaagattaggtaagaagaaaacaaatatgattcggcgttgagttgcatcagangtcagttcgtgtgtcgaatgaagtaattagtactttatgtaggctggtcttccgaattttactccttgcacatgtcttacagtagagttcagatcaatctgggcatctgtcccaatttgtcatcgaataattagtctgtcgagattctgttccctcctcacgtctcaactctcaactgccgtctgctggaactaagataagcgctaatcgtagttggcttgcatatataataacgagtactccctccgtttcataatgtaagtcattatagcattttccatgtttatattgatattaataaatctagacatatatatctatatatattcattcgtatcaatatgaatatgaaaaatgctagaataagttacattgtaaaacggatgaagtaacagtctgtcacttcccttttcgtagccagcagtaatacgcaatagtaactcactgaagctattgcaaatagtaggcttaaggatggacacaaggacaaaatttcagtctaagatgattcccatcagagcagacatcctaccgtacgttcaggcgttaataaagtccaactgcgcctcaagatttgcatgtgttttgttgcttttgtttatgttctgatctggtatagtggtatactctctggactgatgctaagtaaaatcccgatcaaatcctactggagcctggaggacaacgaagcgagacagccctgagcccaatatatcacaatcaattcatggcgtgtttacggccccgtgaggccgtgactggctcagttacagaaaagggcctgggccgtcgttacaccgccagcccagccaacaattttcgagctgggcctccactgctgcgttccgttgttttggttggatcatccggccaaccagcgtcaacaccgggatcggccggccgcgtgtctgacggaaatggcaaattcaaagtttaagcagatttaaatcagtaattaggtagctggaaggagcatgaacgcacgattcatgcacagctgctcggtgcttcaactacacctgacctcacgagtcacacctgcacagtacgtgctacaccaactgctactagctgacgcgagttctatacttctatcagcatgacacatctcgacgatctcgtagaccaactcatacggagatcacgcttaaatactactcgtaagtcgtcgcagctgcaggtggacacgcggctaggcgaccaagcacaagcagcaaattaacaagcgtttcaacaagctggagatcacgagtccggagcagatggacggccacgtcgctgtggcgccgcggcgagacgctgcgttccgcgcgacgacgcggcggactctgacgattctgcacggaagctgcagggtgaggaggaggaagatggcggtggtgcggctcggcgacggcagcaggaggccgcggcggtttatgggggcgctccggaggctgcggctgcggtgggtggtggcggcgatgtacaggcgggcgctgcggcggctgcgcgcgtgctacgccaaggccatcagggacgtcctcgagggctccgcgctcgtcggcgccgcgcgcgcggacgccggggtttgagttttgcactttcacacatctcctttagggcttgtttggttgattgggaattaatccccaagggatcctaggattgagtgaatccctcccaattcccatctcactcaaaccctgtggggatgattccctttgcctctcctaatccctctcctaaaacctgtgttcggttttggctgggaattaacccatggagaagtccaatcaagcaagaaactactgaagcggctgaatactccaataaatagcgcattaaatttgacttatgcaaaaatcatacacagaagttgttgatgtcatgaaaaatactgctaacactgaagataacagtgtatgcgtctatttcttcaagcaagaagcacatcacaaacatgtcttgtcagcagacaaatggtaataatactgttaagaaactttgggcttggcccatgaaggcctggcccaaatacacttattgggcctatcatcaaaccttccatatattggaatgcactatataaagagaggagggggctactcatttgtacagttgattggatgattgaatagtgaaagagagtctcacccctaaactttgtgtctccacttttatacgattatgggaccctcttagactacttcgtgtagtaggagggttgcgtaataaatacaattattttcactttccaaatatctcacatagcaaactcaaaacaggctgcactagctaagtctaaatacacaacaaaacccaaacttctcccaggatctcccaaaatgagagtttaagtacttcatgaagctgctaccatcacattttaattacataaaatccaacatcagtgattgctccaaatgacgaactatagccttctgtgactgaaaaggataaccaatagttaataagatggcactactagctccatagtaaacaagtattcacagtaaacaagtatgcaaaagcgcagtggataacaaccaaattttcccttctgtacaacatctatgaaagcattgtagcaaaaactagacaggaaagttgtaggtacagattcaacaagcaagtccaagaagagatgcttatatactaatatcaagcagttgtccttatatcaattataaaaacttcaaaaggaacagacacctcaattgccaattgatcatcagaatttaacagtaacaaaaaagagagggcatggaaccagggagatgataagcaatggtgattgcagtgaatgctgtaaattcattgcagtacacaagaagccctaagctccatctctacttctcatcatacacagatgcatatgtctctgcaacaagtctgtcacttcatgttatgcttttcaacaagacagttattttaaattggacaaggatcaccagttggtactttatatgtaccagtgcattacatctagtgagaggaatattatgcttggaacaacaataaagaaattagtgcagtacaacccaacctgtcttcacactctaagaattggcaaattagtccaaattaaccaattttcggatcaaggtaaagcaataagatgttataggcatcacattttaattactgaagcggttctattatgccaaatgtcaagtttagtagtgaagcttggtgtgaaaaattctataggctcagtaattttaaatgaaaatagatattgaaatgaaagtgactctgcttgtaagatgacaaaaactgctcaaatagaagcatcacatgatgtccttcagcatcaactgctgcatatcaggagatccactagattttcacttcagctagctgtaactgcctagctcccgctttgcagcctcaattacaagcatattatatggtattgaatcttttttcacctatcctaaagccaaattgtgaacttgcaatggcagtaccatatgcagtactacttaaaatgcttgcacccaaataatcaaaattttggaatcctaaactaggataaatagatcatcatgcttaacagagaaaagatgcacaaatggatggacggtttccaggagaagcttaacagcggggcaaatttcctggaggagatgaacagcgtagtgagtttagtgaagaagcagcggatcaacgaccccagcatgatgaactggtcgctgcagctcaaggacgctatcgacgaggtggagtttacaagaacagcaagaacaacaagaatagtcaaagaatcgccttgtgctctcctccgcctcttcttctccgagggcgccacggcggtggcgcagtgggcgagggcgatgggcggcggcggcggcagagtggatgcgccgacgctatgctgcgaccgggagcggtgttcgacgggatggcggcgacgacaggaaagggagaagagaaggaaaccctaaccctagatttggaagaggaggggagaggaggaaaggcagcgtgctcaccggaaagaaggtggcggccggatgagagagccgtgctgtcgccgtcgccgtcgccttcgggtcgcgccgcccgccgcgcgccgcgtcttcgttgcgccgccgcctcctctcgaggtttttttccacgcctcgggagtagatgatttattcccgggccggggcgcagggaaaacaccgggatgggccgggttaaaatccagactgggcttaaccgaaaacatatttttctgtgggccggtatcctttccatgccgggattatccgtggggaataagttcatctgagggcgcacaacgggtttccgtcacacaacgggtcactcaactatcaaaaccggtgtagaataggtccctcgacgattttgagggcggttttggctgacgtggcgcctacgtggctaatttgactcagtattcatctgacgtggcgcttacgtagcaattcgatccgaaaaaataataagacccgtgggacccacatgtcagtctcacacagaaaataataaaaaatggtgggacccacatgggccccacatgtcagtccaactcacccctcttcttcatcctctctcccccatctcccctctcttcatctctctctcctctcctctcctctgtcatcaggcgacggagaggcagcagcgatgcgcccggacaacggtgcctatgcggaggagctcgcctgagcgacgccggcgccgatgcggcggggcgcggctgagtggaggctcggcgcgagcgtggccgtgcggtggtgccggccccggtgagggcacagcgcgggtcgcgccctcgggggtgcggccgggcagcggtgccgatgcggaggagctcgaccgagcgacgacagcgccgatgcggtggggcgcggttggaaagaacaacacggaatcaatcgacaccaaatttttatcgtatttcttttacgctgtttttccttctcttcgttttgctcctcccgatctattgcaggcagctgtcatcgtcatcgtcgtccctccggccggctggtggtgacgctgcgtcggagcagctgctggctgctgctgcgtgtgcatctccgcagcagcgttgccgcatgagttagacgcagcagcaggtgaatttttgtgttgctttcctgggataaattttggtggcaacattttcttcttctttcctcggttctcttcttcttcctatggcgccggtcgccgtggagtggcgctcgcggctgctcgggcggcgcggctcctccggccatgcgccccaccgcatcggcgccgccgtcgctcggccgagctcctccacatcggcaccgttgcccttccgcaccattgaggccgcgacccgcgctgtgcccgcgccggggccggcgccgccgcacggccacgctcgcaccaagccgccgctcagccgcgccccgctgcaccggcgccgccgtcgctcgtcggagctcctccgcataggcaccactgtccgaccgcaccgccaccgtgtgccgctgcctctccgtcgcctgaggagaggagaggagaggagatgggaggtggggagtgaggaggaagaagaggaggggtgagttggactgacatgtggggcccactattttttttattattttctgtgtgagactgatatgtgggtcccacgggttttattattttttgggatcgaattgccacgtaagcaccacgtcagtgccacgtcggatgaagaccgagtcaattagccacgtaggcgtcacgtcagccaaaaccgccctcaaaaccgccgagggacccgttgtgtctggttttctggatgagggacggaaatcggattcgttgacaagttaagggacctcatatgaacttattcctatctgtggggattgggccccgatcccggccgttcccggcccaaccgaacaagcacttaatttgcatcaaaaccctcctgcaatccttgcatgcattctgcgtgtcgaaagaatgattctgtgcatggcaaacgtgaacaaattaagcaaacaaatttgacagcaatttcgcttcagagttcagatgctttatttatgagataatctattctaaatcattaagtttgttcgagtacaacgatttgacattgacattgtctctttctataatatatcggtgactttatcaattgttttataatacgctattgggttaggcattcttttcaaaaatacccaaaatatccttatgaacatactaggttaacaattgatttatctcccaaaatatccttatgtggcctccttacgcaacatggaaatttgtacaggagtttcaagttttttacatttctttttttaaaaaatttataacttatcttttatatggtatataaaagtatttattattattattttttaatataaatcatctttcacatactaaattagatatttttatgctatcactcttgtataagcaaattttctctcgtatgccacgaaaaaatattttttttttaaaaaaataaatataccaaaaaaattaaaatttgtatacaaactttcatgttgtataaggaggccacatacaaaaatcatattttttttgaagcttctaataagataaatcaattgtttattttgtatgtctctaaggatatttttgaaaataaggtccagccctggcatatcgtagaacaattgttaaagtcgccggtatattatagaaaaagacaatgtcaatagcaaatcgttgaactcgaacaaattcagtggtatagaatagattatacagcaactacgcttgtgctatatcaggaggaaacatacgtctcgggttccccccgagtgcacccatactgccatccaatagttcggtttacaacagacaagtatacaacgtacgaaccatctgaaaagagggaggtcttctctatttgtggagaacggaaaacatgggattagggtctgaaaatttctgggagctggtttggatatttgttggatccatttttcgcttgagaaaccccaaaatttgaaattggaaatagtataggggaactctgggtgatgcttaggcttggtccttttttaaaccattccgagacatactagaacgtgggaaggtttaggattgcaagatcaaaccttttatatataggggtttggccggtttaattggaaaaaaaaacaaccaacaacataacatccaattaaccattgaatcgtttgttcagttttacatctattttccctcagcttttaccctagttcatccattatcgtcagtattacgatgtaagccgtccatcttcatcgcgagagttttgaatcttcttatagatttatcgcaaaaatcttccgttcatcttataagatggttggtcacttgtctaatccagcccgctagtcggctttgatttggaaattcattctgattgggagcttttcaagatcaatgtggataccgcaatgttttaggtgaatcacgtggtgatgaaaaaaaaacgtgaatgcgttgtattttgttcagacgacgcatgtagcacgccaattcattgccagtggacggcgacggctactcgacatcaatttccatcatggagactaatcaagcaggtgaccgagaatcactaacaagaagcttagaagttgccattgtaattatggatacggtcataagcatccatataaatagatgataccccgcactttgctacgggatatatgttagatattgatgaaatgatttagattaaaatattatgaaaataattttagaatgatgatttagcatatgtatgtttagttatatgtatgtttagttttagaatgaaacaaattatatgtataattactacttgcatgcttacatgttgagctttacatatttagtgtgcattagctctatagtgaagggatatgcagggatcatccattaatcctctgttttctttgttttattctgcttaattatcatataattccagcctttgttggattttttttaaaaaaaacccttgcgtagtgtttaattgcacggacctaatagttgggagttgggaacaaccgagtcaaaagaacaaaaacaaggaagccatagtttggcttattttaagcataagcgaaactgcatatttaaaaaaaataataatttatgaataaaacttttatatacgtgttcttagcgatctaaaagcaaaagctaaaaaaataaattttgataaaaaaacttcaaaattaattttaaatttaaggttgaaaatttaaattttaactgataagtataagcataagcgaaaaagataagtccgcaaaactataacactgccgattgatcggaatatcttcttaaaattgttgcatggcacgcgaacatgttaagcgacaaataaatttcagaacaattcgaccgcttcaaatctatctatctatctatctatctatctatctatctatctatctatctatctatctatctatctattatatactaaaagtccattaaacttcctacaaacgctctcaagccaccacgtgtcacttctacaatcgctcctagaccgccatgtggcaatatataatctcaccgttgattttcacttaaatcggtggacccgataatttagaccattagattagattagttgtattgacaccctaataaatcagaaaaaatccttaaaaactaaactcccatcgcccaacccttctggctggccccacacgtgcctaagtacgtagcaggtacgtttgcctccatgtgcacaatccaattcctcccccccaatctctatttttttttctaaatccacatcataatttctattctattttttctattattattattattattattattattattattattattattattattattattattatataaaagtctattaaacttcctacaaacactctcatgccgtcacgtggtgctctaaaaacactctcaagctgccacatagcactctaataaaataggtaaaatcttagaaattctgaaaaaaacccctcaacctcgattttcatttaagttggtagagtattagtttacaccgttagaatagatccattataaatagtaatatatccctcctaacttaccatgtaatacttactaaaaaatattggcggaaataagccaagaaggcatacgtgcgtacgagttaaccactataaacgataaaagaagaaatgatatacagaataaaagaaaaaaaacatactgcatatatacgtactacgtactactggaaaaaaaacattgctttttaaactggattttcacttcctaaaaacattgctttttatataaactggattttcacttcctctgtattttttatgacggcgttaaatatttagttaaactaccgaaagaaaacaatgatttaaattagattttctattatacttcctttggattttttttaattttagtgaaggtggtagtataagaaaaatatattacttcataaaacatgcacacccaaaaatagatctagaatataatataaaatatcaaataaacgtatcatttcacactacaattgttgagtatagatagattctatttgcatcaatgggcctacatttatagttaaagatgaaataatgagtaattaaaatattactcaggacatttgtcataaacacatataaaaaatgtattgtttaaaaatatatcacatttttctcgcaaaataaagtcaggattttagccgttaatgacccaatctacgctttgatttgtacatattttttaagtgtacaagtaataaatgtaaggttgacttctaaagtacttattagattggctctccctcatttatcttgagtatgttctccgaaccattaaagtgttggtgttttacaaatactttctatacatacatacatacacacacacaaacacacacacatatatatatatatatagagaagttaatgttcatatctaaacatttaaaaaatattcatactcattcaaattgggtatatactcaatttaaatcttggagcccatactccatgtagcaccagttaatttacctatatatgtatatatatgtatgtatgtatgtatgtatgtatatatgtatgtatgttatatgtatgtgtgtgtgtgtgtatatatatatatatgtatatatatatatgtatatatatgtatatgtatgtatatatatgtatgtatatgtatgtatatgtatgtatgtatatgtatgtatatatatgtatgtatatgtatatatatatgtatatatatatatatgtatatatatatatatgtatatatatatatatatgtatatatatatatatatatatatatacatatatgtgtgtgtgcgtgtgtgtatatatgtacctatacagggatgcgctaaaccgcgcctgggtgtgcaataactaaactactcccctcacagcacccca

SEQ ID NO: 72602 - DNA, 1933 bp, Oryza sativa
aagcaactgtgctactcccaatgcttcccatgctgactagctaggcagttcactgtgtgtagagtttccaacagccctacagattacaaacgtgcactcacctgttccattttcagagcctgtctcaactctcttttatggaccagaaaggatatttgtgatgatcctctatggtgtccgggataggtaaatgggaaatagataaaagaagaaccaatttagggataatttgtaatgtagttcaatgtgcaccagcctactattgaatgtttgattaacttttaaaaaattcagatgtaagatggtgaggccttccagttgccttatgggatcaggattattcaattgagcattaaaaaggttgcgatgaaattaggtgagagaacactgattaatatagggatgtttcgtgtcgtcaagaattcgtggatgactatatctgacagaaattcagaagctatgaaaattgctgttaccaataggaacaaaaacatgcgagctcagctctcaaaacatgccagattcaaaatcctatccaaattataaaaacctgtgaaatacgactataattgatcaagatgctgcaatcggttaagaacactggcattccatttgcaaccatgtttaagccaatgcaactattgaatcaagatctccaattcaaaatcgaggtaacatcctgcacaacattgtcaatcaactaccagttctaccactgttcctcataggcaaaatgttggtcattgcaagaacctaaatcagctacctagtaagacataatttgccacatgctcacatgagatcacatactcaacatccgtactcaattgacccagccaattcatcacttcaaatttgaggtcttcaatttagcaaccatgcattttggtagaatcaaagcttgaccaaactagcacaagagttcccgatgcctcctaggcctaccacagacaaaaccacaggagctagcaaactccatgggctaattgtttttttaactttcattgcttgcaggttgcagcagttgtgtgattcttcaccctgcatgcccttttatggaccaaaacagatcatcacgcatatcacacaaggatgaataatgtactatttgattccgtgcagttattcagttgatcaccttttctgtcacatgtgccagcaaaaatatatagttcacccccatgttgaataatatatagttcatcatcgcttcgcttccattgaacttctccatcgtgtgccatcgatgccatggatctgagatcgatcgcgccaacagctagcgttgaactgaaaggaccagccatcacaataatgcctctgctactcgtgcagcgtcgctgcgtacgtaggcgaaagaaaaatctgttgtttttggttagaaggctttgtaaactctggctttcagaaacagagtacagaatgttatgtgcgcagttaagtaaaatccagaaaatcactgatgcagcaattcgttgagaaatttctcagtagttgcctcatacgagttaaacactgcaattcttgaataaactgtctgttttacacatcgagctcatgcgctttcagtttatgacacacaactacacaagtcaactaccagttctctgcataatccagtacatttttgcagtgttcttgtcgagaagatgacctctgacagcaggccagcgccacttagcattctgggcttatattccagccatagctagtatttggttcagtgtatatactccaatcatggagctattgtcattgcaaacacttgaaagtaagtctccatttgatcaaagctatgactaaatgaattatcatgattgagacagggcaagtagaacatagatagatctagagatcaaatctagctagtagcaacgctgaacatatctactagattagccaaacaaatggagtggtcatcacacctcgacaa

SEQ ID NO: 72603 - DNA, 10841 bp, Oryza sativa
gcatggagaatcctcttgtgggtacgtcttcgtgccacatgtgacaatatgccaatagagtggagtaatattaacccactctttctagtgttaatttatacaaggcactacatgatacactagctagtacaaagaatgttaatttctagtgttcaaagaatgttctttcacttctgaggtgtggaacaaaatctgcacttggaaggggttaggtcaaaactacctacctaacaatttggatttaaaaaattggtggagcgctctctcagccattcaaccgaagcccttgcaaaaaagaattttaggttgtctgataacctcctggtggaacatttagttggagcggaataggcgtattttccaaaaaaactcccacaacggttgatagggtggctaccctaattcttcaagacattgatcaaagacttttggctttccaacccccttgatgctgcccttgtttttttcccttttgctccattttttgttattgtgttttttgtgttttcttgtctgtaaataacttttatttcgtctaatatattccggcagtccttctgccgccgtttccctaaaaaaaaagatacactagctagtatgaatatgttatgtattataatttgatatctcatgacagtatgacattggcctccttagggatccgcaggtagcaaacttgatcaatccaccaatcttagggaacagatccttatatatcatgcagccatggtgcaaacttgtatcggggggtgccgatatactgaaattttgaacaaaacttggtcaaatttgaacaaaatattgccaaattcaaaaaaatgaataacaaattaaaaattcctgccgaaataatatcatgggggggggggtccgatagaaccgaaatttcggaaatttctttccaaaattttgaaccatggttatgtggatcagatcaacaatcgccatcgacaataaagccacagctgatcaacaaaatttgtttttgtttttgtttttttttcaccggactgacggtgaagaaaaggcccaaaaaattttattaagattaagaggagatgttgcatctaaatatgtggcatccccaaatgttatcgtgacaacactccaatcttgggcaatacaatggttctgttctctacgatgcagcctcctccatcgagcaaccacacacacttgtcactcataacacttcatccatcatctttggatgaggctgttgttcgattcaacttctgtcgagcactagtttggagggacatcacgtcggcttctccatcattctgcttccgagagggaaaggtgctcaaatatatcgaactattcgctacgacatgcaatagctaggacactgtagtagttcatcaggcaatgtttaatatgttcaggtagctagcgaccatgctccatatgttttgtgaaatcgtaggttgcccaatcaaactcaatgtctcctggtgcctccaaggcctatagcagcctccatgaacagacctagctatctctcattgcttgcactacttgtgcttatccatcaccagctcttttatagagcaaaacgagatcagtacatatatatcacacaaatacacaaggatgtacaccagaggcatgtgctcatgtacagatgttcagttaaccaacttttttccttcttttttttgaaataataaaataacacctacaaggcatgtattgatgtacacactttcagttagcaaactttttttcttcttcttgtcttttttggaaaaaaaatggcaaggatggacttagcattcattattgataaaaaataaatgatggggggaacataacgatcactcttgtcaatagcatactcttaacaactctcttccaaccaacctatgcatccttctcaaccacttttttttctgaagttgcagatcaaatatttcagttgatccaaaaaaagttgagcgatcaaatattttagttgatcaattggtgaaacattaagttatacatggtgaaataaaaaaaatagtaattaaaacatttaaaaattttgtggaatacaacaagaacacacattgaaatatattgctatcacttatgaaacaatgagttttagcgggttgaatcatttgtttttcttcatcaaaatataattatgtgatagcttgttgtaaaaaatgaattacaacaaatacaatgttgcgtttggatcgtagattggataaatagtttaggagaaaaattattttgaagatcattacatgcatgcgtgcatgcatggagtggagagagagtaattagtatggtaggaaaaagaataagagcaggtagttgcctaaattttatgaaatataatgaaaatgcacactgaatcgtatgatatcttatcataaatatttaattacaacgaatacgatggtgtaatcagatattatatcatataagcagtttagaaaaaaatactttaaagattgataaatgtatgtatggatgaagtaatgtagggagagcagtattgcagatactgcaatactatttttcttccatcggtagacccatgtgaagcggtgtccggcccaatcacttgatgtggcagatagatgcaactatttgacaccttacaaatggcaccttgtcaggccaatgtcaaaactctagtttctcccaatgtcctgagattcatacctgacaaatttatttgggaatacgcagaaaacttgttcatcattgtatcaagatggaatgggtctatagtacaaaacacaaaatgaaaagagcaacaacgaaactagaccctggtaaactgaacacgcacaaagtcagaaatgatcggccaaaattgactggttctttctgttcatgaagtgtactttaataagtgaaagaaaatcagtgatctcggatacaaggtttttatatactctgtctttcaggaacagagtacagactgttacgtgtgtgtgcagttaagaaaattcagaaattcacccagatgcattaatccattgaggaaattctcattagttaccagatatacgagttaaacactacaattctttgaaaccggctgtattacacatcgagctggtgtgctttcagttcatgacacaaatcaactgccagctctctgcgtaatccagtacatgcttgcgacaagatgaccttttccagaaggccagcactgctgagcatcctaggcctatattctggcaatatcttgttaggatataatatttgattcgatgtaattaattattcagtatgtatgtgccgatccattgtgcaattgtcactgcttagagttgtatgtagctcaccattcgattaaagctatgatttaataatcagctgatcagttcatttcaatttatggttgaaacaagggaagtaaaatttggctgcaatttcaaatatatatctccaagattaggcaaccaaatggagtgtttgtcacaccaccaggagaaagtcagggaccagtttagtataaatcgccaagattcagacgtaagatgtacatcagagatagtccgtttctttagttttgaagtatatgcaagtttaacgaacgttgtatttagcgattcaaaactatatatccactttggtatttacattcctgtacacacaacaaaatgaaccattaggatgagagcgaaatgctagttcaaatttatgctcgcttagctatgtactaagagaactaccaagctccagttcatgaatatgaatcatgtccatgattacggaaaatcctcttttccaatcaatggctcaacaaggtctcatccttgggcctcatgattatacatcatatcgctttgtcctacagacaattcccatgcatctttatcaggtaagagtatgatgctggtgttctgcccccctcaatgctctaccgaaaacacgacccactgtctcagcatccacacatattaggaaagctcccggtgcctcctaggcctagctaccatgggcaagcgacagttcacaagacactggagccagtttcacttctatgcgaagttgtgaactaacactcattatggacgactctgtcccttttcagctcatagctcttggttcctcttttataagccaaacgaggcctttatgtgcatataaggaccagtgagtgaatggtgaggcctttgtgtacataacccaaaaaaaaattatgtagatttctgcattttggtttctagaaaactgcagtagtgataatcaattaaatcacagcagcacatacataaaaccaaaacgtcattctttctggtagtgacagtaagcttggaacagtggattcatatgtacttggtactccctctgttccataatataaggcacaactacttttctttgatgttccataatataaggcatgcatgcatgcatacaattaactaggacatcttctccattgaattattattttttaaatcccccactctcaagatctctaattctattagatgcatgcattatatttattaggatggtccaaactaggagatgataataattgtttcttggtctttgtgttaagggtggttgtgccttatattttggaatggaggatgtaacacataaacgacgcatccaagaaagagtgtccatgctgctctgaaaatacaaggaattccatctgcgtagctactctcgttactctcatgtgttattttcaatgggtcatggacgatgtagactcagcaaagacagggatagtcgaactcccaatgcatcccatcctgaccatgggaattgtttcaataggatcagtgagcagagtttccaacatccatgcagattatagacatgcactcaccagttttaccgtgtctctctctctctctctctctctcactcatcagttaacagtgctagctctcatgccattcatatatggaggatgagaagtgttctctatatctacacaaggtcacaaaatgcacaattattcaagggagcatcaggtgctacagtatcaccatgctaccatgtggcaccatatatttgatgagtgagggagagacagtaaaactggtgatcatttttgtataaatcgccaaaattcagacgtaacatgtacatcagggatagtacgtatcttcagttttgaagtgtatccaatttcaacaaaatttggagttaggaattgaaatctaaatatctatgttggttttagtattctttgtactcacaagtcacaacagatgaaccattaggaagagcgaaatgctatattcaaatttacagtcgcccaatgtaccgagacaaagcctatgcttcagtaccacaatatgaacaagtccatatatcagtactgaatatcacctagtccatcatcagctcagcaaggcctttgtcctgaagagaattcccatgcatttgtatcctgctgaacatctacaagattcagatgctggtcttctgtccccctcagtgctctattcaaaacttgatccactatatctctgagtccacacatatcaggaaagctcccggtgtctcctaggcctagctaccatggataagcgatagctgacaagtcactggagctactattacactgttacttccattcgagcattagctgacaagtctctgcttctcatctcttgtgatttttcttttataggccaatgaaggtctaacaatttccgttgcattttgaggcgttcatgctttagcttgactagaattttcctgccaatatatatggttttgcattgcatcttgactccacacaactcgcgaccacatggaatgcacttgctcatcaccgcggagctttcttctgttcaccatgtcaccatggctagatgcattcagttttaaattgggagaccggaactgcgtataaatcaaaatattaggcgaaatttatttgaacatttctggccaactcaacctaaccagtagactgtgatctagaggtgcttgtggacattcagttggcagtaaccataccaaatttaattaaatggcatcatatttggacgctttgacacttcatccatcatttttggacaagagctaaatgtgtttcaagtaacatctgtcaagcactggtttgatggcttcatcacatcagctgcgacatcttagagggaactgtttgaactgcatgtaggacacagttaatgctcaagaccttttggtaaattcagggtagcccaatctaacacaagggctcctggtgcctcctagtcctaccacagcaaaagtcagaggagcagcctccatgaacagaactagctatcacccagtgtttgctctacttgtgcttattcatcacaagctattttatagagaggaaagagatcaacatatatatcacacaactacacaaggatgtacttctatttgattacaagttgttagttattcagtgcctatgagaggcatactcatgtatagatgttcagttaagcagttaaccacctttttccttctttttttttcgaaacgaaaatatagcacctacaaggcatgtattcatgtaaattgttcagttagccactttttttcttcaattcttggaatgatgaatcaaaatggactggtcggttgatttgacagttctctgttcatgattcttttttcttttttgcttgaacacatggacatgcaggagtgttcagcttccttggtcacatgaagtgtactctagcaaatgaaataaatcatctgcttgtcttggttccaaggttttacatactctgccttccaaaaaacagagtacagacctcaacgccttgtggcgaacgtcatctcgtcgacgacacataacatgaacacagttcacacataatttatttttaatcactaataaatgttgataaaagggaagtccatattcggtgaataagcagacatatgcagttgtcagagaagacagatggaggcgagatgagatcggactatcctatcatatcaagtcgccactagaccacaaaggagctggttttcccagtacgtactgcactctggggtaactcctcatgatgtttcccttgggttccatggcttataccgagcactccaaaattcgtaaaactctcattgaaaatacagcacttgtgataacgtaactctcgatgcctcccaaccctacatagccacaaaacgaagtaaatgcattttcagtttggtggtatctaaatgattctgaactcactgctatatatcggcatgtttgtcttagcctctaatatctttcatgggccaaaagagattgtatatgatatgcatctgaaatcgaaatgtactacatgtattaactcagcagcagatgcagtcatgtcagattgggcacttcatctgttggggcctatccccactacttcctttgtaagacgttttggggttcaaatagattcatgtatggatccatttgtatgcttcatatatgtgtctaaattcatatggatattaatgtatctagatgacggatggagatgtccaaatgtcttataatgtagaacatagggagtatatatgtttattgaaaaattaccgatctcactataaattaaactgcccatgctgttgtagataaatttcagttcgacccaatgaaattaggtgacagtgttgaacataaccgacaaatttcagtacagttatgaatttaatatcctaggagtcttccggttagattcacaaggtggtggactagctagcctcggttcgaagcatcatcctttctaattttttgatattaggtcgttctctaatatttgtgtttttttagagtgttattttcttagatatgggataacgtaactaaaattccagcttatgcatgatgtgatattttttttatagaaaccgttatacggctaatcaataaaaccacagcagcaacagttattactagcacattacaacagcggagaaactcctggtaacttcaaaatgatccaaagaggatgagtatggtgatgaaaaacaaacttgatctctgtctagcacaaggaacaatacaaagagaggaaacattccacttctgtagtacatgtttgtacattattgcttgcttttcaaagctacattggctcctcctcaatttgacatgctatgagcctgcagtcatcagtgttggcatgttttgctctgtccatgttccattaacttgtctaaaaaattagttgcacattatcagcacaagggctcagaagtcggaactcatgatgtttgaataactcttggacttcttgttaacagattacagctatattgtgcattgttgcaatttacacacggatcatatgagctcttaaaatcaagtattgagcaccttatctttactcatgcttctttgacttctcttttatggaccatgacaccatagtatgtaaggatgtattaatatttgattcaatacagttaactatgaaatgtctacatgttcattgtgcttgtgcatacagcagcaggactagaaatagtatcattcaagaagtagttacaatggcaagagaacaaagaaatgtagtgatgtacgatagttcgaaattcctcagtcgaggatagcatatttttacaaccttgatctttccatgtctgcactctctatagtataagcaggggagttgcactatgacgctgtgggtaggggcctagcttcctgtccaatttcccggaaattgctagagttgctagacaacatttttccaatacctcctaggcctcatggcaaagtgatagaagcagtctccatgacagatgtatatctaactatccatctgttactgctagctagctattcatctcttatagctagctagatatatggaccaagagaggccatgatctatcgattgaaggatgtactatatatttgattccatgtaattatatatgcagcatctataatccagtatcaagttatgtatagttcattgtgcaaccaacatatgcagagtctaccgtatctagcagtaatgctgagcatctcttgaggaatttagctgctaaatgttcatgaaggcattttcctgcaaatatatggcaccttgtcaggccaatgccaaggctgctcaaagcaattaggttcaaagttcagacttcagacttcaaacgtgacaaacttttgattgacgcatcattcattaggaaggagtgtaattttatcatttttgaaaaggtacctagaggtaccatatttctggtgtaaaattcagtacctctaggtactaaatacctcaaggtacaaaaaattttagtgtaaaatttagttacctcaaggtacttttttaaggactataaaattctttcctctaggaaggaaggtgtctggttagtacaaagcacaaaatgaaaaaaaaaattgtgatgacaaactgaataggcatggcattttcatcagtcataagaaataaggttgtttcttcatttcaaggaatgatcaatcaaaattcactggtctgtgttcatgaattgtacttgtgtaagtgaaataaaaacagatttcttggttacacggttttatatactctgtctttcagggacatagtactgtgtgttgtgtgtgcaattaacaaaattcaaaactcaggctggtacatcaatcagtcaacaaaattcacagaagttagctggtacaagactacaagagtaaaatactgcaattccttgaagagaatgaaactaactattttacacatcgatcaagctcgtgggctttcagtttatgacacgagtcaaccacaaattttctacataatccaagctagcatccaattaaccataaagctcatccttgcaatgccatttatcataaaaattcagttgactaccaacaattctctaaataattcaatacatatatcatatccttgcacaccaatgttgtacatggcctttgccagaatgcatatggaatctccaaaaagcacatcctttggacgtgccaatgttccagttcattgatcaaccgccacacgaccgtgtctctaatcaatcgaatctatggctgaataatttgtcaactcgctctattccactaagaagtcccgtgcatgtgtatcctgctgatgatttgaaagaccaaaatgctggtctctagtctcctgcaatgcttcagctcctggtgcaccaaacaaggaagttcctggtgcctcctaggcctaacatagcaatgcactagatctaattttactcttccatctgaaccagcactcaccacagacgactctttatctctcttagcttggagctcctgatttctcttttataagcctaatagagtttgtcggtatggaggtttgggtctttccatgaaatgtactatagcatcgagaaattttaaaaagcggaaaaaatctagaatgtccgatcttgtttcgtattatcgtgtatgcattcaactacattgtagttcaatgcatgtgcacctaccatattgtataaatgagttaagtgtgcctgaatatatgttctgtagagatctgttgtcatgtggacatgagtataagaaacatttttgtttgcatggacatgtatttaaaagataaaaaatgttagtaacagaaaacttgcattaaaaagaactgacactaatcgtattggtgtccaactatagttgctcaaaggtgctggttctatatttttttcatcccgtgaagaagagaaaagaccaataggtactgaatttaaattaaccggcacctatgagctggtacctagctattatgggttttgtagtagtgagtccttccaatgaataactaaacttcgtgctaattgatacaaaaacacagtgaactgttataacaccaatagcccatgagttatttattcatttcacgtcagggtagagaagttatttttttcccttcacatgtgcttctatggac

SEQ ID NO: 72604 - DNA, 694 bp, Oryza sativa
aggagggaggaaaattacacttattctgaggaaaaacacgatgcgccgtcgtgccttcgggccggccgggcatggcccgagtcgtgttgggccatgcctgggccgtgagtgcggcacgtgggttggcaggcacggccggtgcatcggtcgggccgtgctggcccgacaagcctcggcccaggcacggccaggcctaggctgtgccatgccgggcgggcccatatggccatctatatttcggggggtgatatcctacattggtgggaaacctgcaggagaaagctagtaaaggaacatcgaaggatatttgatggtgtcatcatatacacatcatggtgcatttggctgcagcgaaatgataaagagttttcaacaacgtttacaatgagacagtggaagatgtggtcaacatgtttattagcctgttcagaacaagggaagaagtgcttgctcaaatgtagcttcctaaagtttttagcctaaagttgtcttttttttccttactgtgttgctgctcctgtaaaaagggctgtcaaaaattatatttctaccagtggagcaacagaattataggtcagaaaaaagatgatggaaaaattcattatctagcggtatactgatagaaaaaatatttccgacagctattgccttgcacagaaaatataaactggtgtcagatcgatctgtgaaactt

SEQ ID NO: 72605 - DNA, 10387 bp, Oryza sativa
  unsure (1)..(10387): unsure at all n locations
ccctcccccgcgcgcagacagctggcgagcccctcccctgcgggcggacggccggcgagcccctcccccgtgtgcggacggccggcgagcccctccccgcgcgcggacggccggcgagccccaccccgctcgcggacggccggcgagcgcctcccccgtgcgctatcgtcgtcgccgcgccacgacgcctcggcgcatggccgcctcccccgtgagttcctctactgggccgccttctcgttgccatcgtcgtcgaccccccactccctccgcacctactgcctcctcgtccacctcctctcccgcaccgccgccgccggatgccaacgccgctcattctcattgtcccagcacgccaccggccgaaggggaagaaggggagagaaagagagagaagggagagagggaggaggaagaaagtctgacatgtgggccccacatgtcagtaggcccacatttctttttgtgtgaatgactaatgggtcccacgcatatttttatttctaccgccacgtaggtgccacgtcaacgccacgtgtaacaaagactcggtcaatattgccacgtaggcgccacgtggcgccacgccagcaaaaccgcctcccaaaaccgctccgggagtcaaattgtaccggttttaggagtttgggggtcgagatatctggttttgtagtttagggttatggtttagatttcgatcacttttgagggtcatgaagtgaacttattccaaggaaaaatggccttaggatcgaaagcggcacaaggacaaggagagatttatttttaaatttttcattttaattaactctaaatttggtttttgttgttttaaaattatttctggtgctttgaaaattcaagtaaaaaatttagggacccatttaaagcatggaggatttaataaaaatactccaagccacttttgaatttttcttgcacgtattttagtgtttgagatttcttttagacttttaataatttatattactcattttagaaagtgatttttaacttgggatgaatttatcaggatatgaaaatgttacccccgaaggtgaattccctgttgtcatctttattttgactgtttcatgaagtatgaagtatgtacgactatcgttagacgaactctagtccctccgctctaaaattaaatcaacataatacgagatataattagatttgtttattttaagacggatgaagtataatttatcaacagtagtcgcacatacttaataattcgtgaatatcccatactatattagtttattttataacggaagatattatatattagtttattttggtacggacaggaaagggtagatagatagatagatagatagatagatagatagatagatagatagatagatagaaatagttgcgcttgctacatgtgagggagattgaagagtggacgtggactgaccgtttgaaaaggttgattgacaagaaatagtctcttcttgacaagaaatagtctcttcttggctttatatttcgtggtgttaggataatgtcgtatttttatattagattggtttttttttgacagagagagtaggatagatagatagatataattaagtcgcacctgctacagttttttaaacactgtttgaaacaattgagtgaccagcaatagtttatttctgtctttcttcctaaaataaggatgtaatatagcttaacactataaatctagatgaagagatgtccagatttatagtatatgatgtgtcaagtctacaaaggatggattagatatctcttgctcggacgatagagatagatgtctgtcctttttcttttggcaagaacaaactttaagtcgggtgactccgttaggatttattaacagcataaatggcattgcatattttgtatactaaatgatgtcccgtgctttgttgcggccggatatatgttagatattggagaaatgatgaaatgatttggattgaaatattatgaaaatgatttgagaatgatgatttagcgtgtgtatgtttagttttaaaatgaaataaatagtagatataactattatatgcttgtatgttgtgttttgtatactaatgggttgatgtgacatacttgtgcaatatgtaggtttttaggagtgataataaatactatgcttgtatcttgagttttaagtgtttggtgggtattagctttctatagaagaaggaatgacacatttgatatttttaatcagtccgacaattttaagattttttttcaaatagactagataaacatttttttcctttttaccgaattgaacgtagactcgttttatgcatgtcaactataaagtcataaaaaatctttaaaaatggaaatatatattaacttgtgatatttcgatctataaatatataaatttaaatttgatttataaaggtagaaaaaataatatatcttaatttgatttatatttgtaatttgtgtttctattgtgtatatgtcgaatttgaatatgtatataggaagcccattataggcccataactatttaaccctaaattctctcatcttttaatttctccatgctgactggtgttactgtccacctttttagttttaatctacctgtgaatattcgattgaaatatgatgcatgattatattttgcatctgatctgttattctgagctatatctaatctggtctgatcagcaaggtcatgacgctagcttgcagccttcaacacggactcagttattcttcttgtggaacttatggtgattttattatgaaatgaagccaggttaccaagtaaacgtacttcattgttcaaccacagtataattcatgattaaatagtcaatgctttcatattcagatactacttaggcatatttgaaaagtatagaaatgtttggtctttgaaaagtataatctatttttacaatatatatatatatatatatatatatatatatatatatatatatatatacactcgctgtatcgacgtattagtgtttttgaaaatttccgtatcgccgtatccgtatccccgtaccagtatcgcgtatccgtgcaatataggtgttcactagcctaaaaaaaaagaactttggttgtttagaagttcccccctttgtgaatacactacaatcatgacttaacttcaatctgaaccaaagttttaggtatgctcatatgcgcaaaagacagaatcaaatattctattcaataaaaaagttaagaaataaactactgcatgtcactatgcgctttttagcattaccaactgccccaacagataacataaatagatcactattcttgtaattttattgtcattggcatttttttttttccacaacttacgaaatctgtttgcgaagccacaatgaaataaacttacagacaactccagtgtttccatgaaaggagcaatcttcaggatataagcataatcaagggcatcagtctttctgatatttccatggccacagagagctaattccaacctcaaattccgaagataagtaaatttgaaaggcccttctggtacgatagttctctgcaacagaaatgaaaaaaaaaattggtgaatttgatcttatagtgatatatgcacaaaatatggccacaaaggacgacatatcacgaacctcacgttctccacaatgtaaggtcagagtctcgagccttggcaaagtactggggaatccagtaatgatataggaaatagcagattggtaattgatgaatacaatactaatatttgtcagcctggatgttgaagcaaatatcaaaggaaccatggtgccactgtacttaagtgttgttggactacaattcagttctatctcttgcagattagggcagatatccactaccaaatgcttaagccggtccaatggatgaagcattcgtatgctagtaaccatttcgcaatatgaaatctccaaaaactccagaagattgcatttggatagcatacgctgaacatcttcatctgtaatgctcatatctactaagctaagaatcttgaggtccagaaatcctttgaaatcagcaggcagctgcagagacacggtcgtaagctcgagacaccgcaagtatgaaccataattgaggccaagaagctgtggaggcaaattatatggtggttctttgattatccgtatgcaattgctatgtgtcaaatctgtgaaaaatgagcccttatcctgacctgataaatcaacaaccaattcctttgtttttgatgcaattgcaaagttcacccatctatcaatatggtctgcgtgcttactatgcaaccgaaacttaatttccatacgttgaacccccattccactgtgctgacgcaggaccgcatcaacccttgtaataaattcgtagtccctgagccatcgccatcgatatggagtcaaggtcttgacataaggtttcctcattgtacctttattaagagtaagattggtgtggctgcaccaaaaatatttccattttcttgacaatacacttgtccttatagcgtcatttattggcaactgcgacaagatctttgctaaaatatcctacatcaggaaacaacagcattataataatttaagtatttgacataaacagctaaatagataccatcgctgtacaagattcatcatattaatacgtgaaaacacattgtcttacacttaatttctgtatgaactcacataccattgggagattgctaagtgaaattttttgtacttctcttcttttgacaattcccccatgcaggccttgttctgaattcctcatcatgctctggttgtggctgaactcttttcagtaaagaagagccgtcctactgttcagtacatacaagaacatcaagcactagaaaaaaataatttcatggaattgataatcttaaggtaacgactcagatgagtatttcaactttgttacatgataggaaaaaaagagtctgtcagggcatgtacgatgtacccttattactttgtaaaggagaacatagtttgaaagatgttttctcttatataaaagaatttcagtgttttatgtcaactctgtttttttgtatgtttctttttatatgtataaaagcttatcgatacaggaccataaccaacatggctaaactactttttgagcccttattccaatgtgatgaatggactataatgatagttgattggctgcttgaattgtagttagatgatatattgtggatgaattgaagaacagcagcacattattgtgtctcggatgggctagctaaaataagagccccccaacccccattggattggatgggtgcactccattggaagggcatctcaccttatagggtggtgtacatacaagaagtgaagggtaaaaacctagtggatgctcgtcgccggcgaaggtcccgaccaagacgtgcgaaagcggcgccggtcgcgctgtcgtcgtagcccacgccacgagacagagcaggtcaaggagggagaaagaaaagaggaggtgagaagtagagattagtattatgtactccgcttcctccacaacttcgcttccgattctgtttcctctccccgtgcgcgagggagagattctgttcccgattctgttttttttttaacgtcaagaatatagtctctgaatgagactacgagagatcaatgaacgagaaattgaggctacgagagatcaatgagctaggagattggttactcctacatataaatcctccggtacctgatgagattttttttttaaactgtagatggtcattggtgatactttctgacgcatactgcagcttcagggatttcagaaaagaaactgaacttgtaaacagtcagaattccgaaacccagcatgggtgctcttgccattgagctcgcctgtggccaccagaatatttcagggttagggacagtttgctctgtttattcaatccctcaacttgacaagtttcttaagcatagatctagcagagatcttaatgtaggaatttaacaaggatgaatagcggagcatgaattttaccgttgaacacaaccacacagacacaggagcagattaatttacattgttctttgaacaatggcgccacaatttagacgcagatggcctctcgcacaactaaaaaagggcacgactaaaaaaggtcccgcaaattcaaaccatatcaggaaacagataaaagcatgtgatatcaggtttggttagagtctgtacaaatgtggcatatcaggctatcagcagctactttgtcatgtaaggtatccggtggccaccatgagcagctcgggcatcgcaagccattgcaagatacctcaaattgatttaatggcgtatcaagccagccgtgtcgaaccttgtaaaattaacagagccagccatgtcgaaccttataaaattaacagcgccctgtgagctatcagccgatgaataagttgtctcttttgacaataatcatgtcaagtcccgtacagaagcctcacagattttccaagatccatcactctgtctcctcaatatgtactgaacttcatacatactgcaattgtaacagtataaagtatcagtaccgtgttactttagagcacaacaggaaagcgtgataaatagaaacattatcttctgaattacctgtaatagctaggcttcttgggctgggattcatcaacaagctcagccgcttcctcaagaacagcaccaatttctgcaacttcaccagtgccagactcatccaatagtatctccgctcgaacaacagagagatttaacaaaacaaatctccaatagcaggactgatcctttgctgacaatgccaactcttgccactgctcgacaagtaggtcttccattatggacaattcaaatatttaaacatggaagtctatatgtaagtacaccatggataaaaaggaaattaccttcgaaagcattgaaccgtcaagaatttcagggagcatatcaatttgataatcagggccaagagcttcagatttgatgtcttgccactgcttcacaagtgtttctgcttcttgaagagccatactttgcttgcatactgtagcagccactgcattagcaacagaagataggtcgctttcttcgcttcttgaataaagcctattgtttaaccaaagcatcttgggcagtttttcaaaatgtttcctgacgctgctagtaataaaagaaccttccaacgtcgattcttcattcagggactgtgtggcagcagaacccctacttgcggaggcaggtttcatgtgaccaaactgaagtctgagcagttttaatgtaccaaatagggcaaacccaatgagtgcactatatgcaagtttccctacaatatcaccagtaagaccccacgattccaaggttcttgcaggatgcgatacaagattgcgcttcaggggaacagatgttgtggttgaaccatttgctggcctatccattgaagaatggacccccaggttgtttggtgcaagttgctttacagcttcccccaaatggctggtagaatttaatcttggcgtctgctcccctaaagctctgttgcatggtgacacactagaagatggctgagaactcaaacggaccattcttgtggctcctaatttctgcttggaagtgctaaggatgcgcttaggagccccaaagaagttggcctgccgtaagagaataatgatatgaaattagtctgtagaaaaaaatattcatgggtttcattactgaaaatagtaagacacagaccaaagatggtgaacaatctcttgtatccgcaaaacgagaaagtgccatatccttcagccacaattcctgtaaagatacgctatttgccatgagaaaattttaacacaatggagaaatataatattcagtaatctacagtagcacaatttatttgctccaaaacatactacagtgaaatataacataccagagactgacagacagtaaccttgtcattgccgtctttctttttaggtaacccataatttcttgagttggaattcccattactttgaagctgctgaagcttttcaaaaacagtggtgccagattcctgagagcaaacatttagttatgataatgtaaactagtaaaatttttgcagttcaaatcagcttatcacctctccaaggagatacaaacaaaatgattcctcaaatttcaggtctgtgttttcagatgcaactaaacaatcgcaaatggttttggctttactgatctgcataaaggaactgtacgttaaataatgcataaatagcaaaaatgatagtttactactattgagaaggagaaggtaccaggtcagcctgccgggttgaaaaccctaacgcaaagtgagcaagcatcgctacatggaaacaattgaagtcaactactgcccgctggctctgggattccaacgattttttgtttttacgagttgtagccaaagtatcccaagaaagtagatccacaatttcagtggctaacaacttattcattgcttggcccaagaaacaaggccaatcatgaactctacaagaggattcaacgtcaagaccctgtctaagcagttcacagagagctgcaatagcaccctgcctgcgttcagcgttttcaggtgtctgaggtaagcttagaagctccagagtgcaagcaggtgcaagctcttcaagtgattcttcaatctagttcatccaatgaaataagttaagggcataattctacatgtagaagaatctgtagagcgataacaacaaaaattaacctgttcaagaaggggcaacttctccaaagacggttttctcctcaacaggtattgagcacgtgctagagcttcaaagccaagagacactttacttttctcanagctagcttttgcaatagaacactacaagaaaatgcatcaaatcattgcaaaatataccaatttgtagtcagttatttaaaattttgtgtgcttcttacttcagctagtgccattgcaagaagcacatcatgaacatatggcctagaatctgggcgtcgtagagccgcctgaccaatttccaaaactagcttctcttctccaacctgaaatgaatattgtagcatgtaatacaccatttcattatgataatggtacattcaattttaataaattcaagctgctaggtgtcttgtattcatgatcacttagaactcacaaacatcataatggtgactaacctgcatcccctgcattttacgctacccagtcctaagaaagggcaaagtttaaaacctacgcgctcctcaccacattcctaaggataatttaccctgaagttagcataaaagttttctttattagttaaacattattgatcctaaatcttcttgatccctttcaaatcattcagtgaattgagaatagtattctgacaaagaataaggcagacctataaagaaacataccgggcatggtcatggtgacgactatgactatgtcatgtaacataaaaggtgacaaacctaaaccaaacttggtggttttcctttatttgttcacaataataaggatgtctgtgttacacattacctcctgcaagacacaaagtgcagcaggcaaccaactcaaggtatatgaagagaggatctgggtggaagcttttcttttatgcttcctgcgtactcctgttcaaagagaagtttgtctctcacatctaccagcagagcctaccaaacatgaaagaaataagcaaagattaaccacatgaattctgcattccctacattaaacaaagcagtatatccaaatatatttccagaattccttgattcagcgagcaacctgtctgcaggtagacacctctgccatgtacccgtcttcaatttctgcatttttcagctccattgctgctttgacaatctcatctttctcagccttctctgtaacaccaagaatctgcattggccatttgaaacatgtcactccaaaaatcagggaggcgtgtcacgcgtgtgaactaccagtgcaaattacaataggcatcgtggtgcaaacactaaagttgaattatggtcaagaaacgactatctaatctgcaactgtatcattcgaacagagaccagccgagctaaactagatccatcgacgatataagaccacatttccaaaattcggatccataaacagtacgagtggccaaaaaaaaaaaaaacctgatagcaagtgacggggatctccaccatcggcgcggcgggggcctcctgcctgctcccctccgcggccaccggcggcgcctccgccaccctcgcgcgcgcaacccacgcggccgcccctcgccgtccgccagccaggcatccacccccggcgtgtgcggacgcattgccatttcccaccccaacacgccgcgtcgaggacccacatgcgaccccggggacaacc

SEQ ID NO: 72606 - DNA, 6476 bp, Oryza sativa
gtgccggtggggaggcccaggcacggcccggcacaggcccacccaagtcgggccgtgccatgcttgagccaggccaaaatgccgtgccgtgggccgagccttcgggcctcgggccttatggccatctatgccccgaaagcatgggtacccggcaggtgtaatcataggcgcgtaaagagcactctccatacttgcttggcaaaaacacaatccatcagtaggtgccaatcctactgatacaaagctccacagtctggtaatgtccagctcctattatgtgttgtattgtacgtggagtacatttacggtgatctctactagtagtattctactatcagtattattgtagtagaagtgatgtcaaccattgatttatgagttatactaccatttgaaaaacttacaaactctaacaattctactacacgtagtagatgcgtggtagtaatagtataaatggatatgatccattgaattagaaaaaggaaacgttttaaattagttccagtgtaaaacacctcccataacgtatgttagtggtaggtgctgcattgaaacagaaatgtaacattgctatggtcaatggtacctacagctctatatatacatggaagagtagactgtcgatgaaggagctgcagcgatgctcaagctaagagatgatagatggacatttcttgttgctttggtcagaataggatgcatcaggagttgccatgccacaagaatcatgttcagtaagttcctacatagtcactattaattacttttacctagcttgtcgatagttggttcaccgttctacatgcttaaactaaaattgcgcaaataactgttatattgcatcctgcgtacaggatctgcgagcaagaggtagaggacaaatgcttgagcatagcggttcatcagaattatgaacagttctcattcagaaagggaatgttggagctagtattctctctgcggtgcagccatgcaaatcctcttgtttataaaagcagattgactgataaccgatgtcgatgctccatgtagagtggtttatggtccaaggggttgggacagtggcagccatgtgatgaattcacaaagaccactactgttccaccgtacaactcgaagaactcatggtgctgcggtgaagctccttgtgtctgcggaagtgacgaatgcacgaagtagatcattgtggtaaagttcacatgtgaataattgttggaattcagtttaatttggtctagcagataaagggatttgtgcaaaatcaaagtgttttttattattattctatcatgaacaattggcatctgtgattattggttttaatatttgaagattattggcgaagtggttttggagatgataggatttacatgtgatatacaggaactgctgaatatgtggtctggtcagaccgggcatgtgctgccggtcagactggcttgtattgcgcggtctgaccagccgactttgtgtcggtttcggtttcgagttgtttatttggatttcatatttatggcttctagatggatactatgcgtatgtaatactgttgtttgctactaatgagtcaagttggagatagcttggtctcggaatatggtttctttgtttgattcatgtgtaggtgacttgatgcctcgggagagtattgccggtgatggatcgggagtcagcttggtgataagacgatgtccatgatggtcagatatcatgcgggatacttaggctaaagttcaaacgcacatggttggtgaagattccatatggcatacgatggaggtattgtgtgcgtatgggatgcgaagtcaaatttggaaggagtccaaatttggtatgattggagtttgtaaagtttgtttcttgtatgagaaggtttcctaggtggattaggacttctagtatgattttggttcgtggctttaggctgcctacctcatgtataaatagagagggagcgtgaggcttctcggtatcacttttgagagcattgagctgtgagtttagttagggtttcgagtttagtcgagattttcgtgaggagtgttattgttgcactttgtaaacacagagagaagtaataaagttgtcatctactttaagagttcttcgatttgtgtttctcgggttcggcggtctaaccggcgagtcaccggcggcatcgcggcagtcagaccggtggagtgaaggcggttagaccgacggcggtttcaggcgacggcagctgatcaggtggtcagaccggagatacaacctctttcagaccgacggcttccaggcggtcagaccggcgcaacaccttcggtcaggccgtgatccgtcgaatttgagggtaactttttattccgcaaaaagtttggggttttggttagttctggtgtttcgatgatacaatttggttactataccttgacattcttggttacgcctgacttggtgtgatgagtgctgtttttgtgtggctcaaagagaactttcctgcctatttttgtctttagacatgttcgcagatttctcttaattacatctcaacatttgattggatggctgtgaaggttcctaatgcttccactaaatggagagatgcacgtctatgaaaagcagctggacaattcttcaggttctatatacgagtaactgagaggggtcaaacaatacactctcatagtcatatgtgatgttcgaatctctccttgatccatgaataaacagagaagggatctgaacttcagaataattgtaacaaactgaggtatgaacagttcatcaagggccccatccatctggggtttatcgtggcaaaattctaaataaaaagctgaataaactctcagagactctgagaatttgaggctatgcttgggataggaggcaccaggagttctcttgttacttgaagtgatcttgcatgcccgtcaacgagggcatgccaacggagcgtcagcgcagggccccacaaaaatttggggcccccaaatcagagtgaccagcacaaccagccagccttagcatatacaactgacgtcctatgtgtgttcatgtgcatgcatgcgaaaccagcttttgaatccttgatcaacaatgacaccttgagcagctggccgactacctcgtcaaccatattagagtaagactggacaactggtaattaagtcaaatactgaattgttgaattgcatgcatgtatccatgcatggtcaattgaatgtttcagtactcttcttttaaatcaaattaccatgaatataatttactaatttaaatgatcaactcaatcaaaagtaaatttaggatctcaaattatatttcgttccagggcccccaattcctggagacggccctgtcaagttggtactttgatcaccattccacccctgagggaattcaatgacctgaacatgccgccattcggttaaatcttggcccccattaaaacaaatgaaaaatataggaattccaaaggatttgtaccctatgaagccctttcgatatgagcaggtatggtgtaaacaattggaaacttatttgtgcaaatgttgatacaaataagtttatttgcacaaaccaggtatggtgtatcctatggctgctatgcttattgtactatgggtaaaaaagggaacctttaaactaatggcatatacacatatcatgcgtacacattgttctctttgtttagcacattttgtgattaccaaaagccgagaacgacttttcttgaagagatgatgtggatctgccaaccaattgcacacattgtcctttgcatgtggattagaacaaaaggtgatatcatttttctcaaattctaagcatgaaatatatgagaatttgatgttacaaaatatttgtcacttgattactttcagacatgagatatttgaaccattggcatgcataaacaacacgtgggtctagggagatgtagcttacataattgtaaagcttgtcaagtctactttccaaaggatccaatggcacatcattcggagttttctatcaccgacaattgcaaaatgaagacatgttgcgcaaatagattggttgacgcgcgagtagcggcgctgatgatgaacatgggccttgcacgacatgtttggatggggatctatttccaaggcaaatctttggttgggatggactccatccactagttccccatggattgaatccttcgaaaacaaggagtttgaagataagaaagaaaatatttgacttggattcggtttgggccatcctggatatgcttggactaaaacgtttttttctcttcgtccgaagtccattttggacgtgtgagcacttgttggaaagtaaacttcatggcccacatgatggagaggcccacggacacaaattcattctggttccaccacaagagccaaaacaaactgatggtgctaccgagaggtttccatattgtgatgtatctgctcttgttcttttcctaggttttgtgctgtcaggcgccaaactagggatagtgattgggagttctgccatagattgttcttgcttttccttgcagggaattgagggagctagcaagagatccaattttgcatggtcgagtgaatcaacctatcaaagtgtgttgttttgtgagttcatggtgaaaggtgcgttgcacaagttcccccgcatcacctttgaaacaaaggagtgattcctaccgatttatttgaatttcctatggaatgaactattgtggaggaattttggaggaagtaagtatgaggtcttacctcttgttttcttcttcccgtatcttgaattcctacatttttcttgtgtgacaatcaaactttcctatgttttcaaatccttcaggaatccaatgaatatgatgttctattctcatgtttttcctactccaatgttttgataatcctgcatttcaaaggggggcaatatagctactggttcctccatgtccacatgcacctctagataagggtgaaaacggtatggaaatttcccgaccgtaccgataccgtttccgcaaaactaatataataataatatttttaccgatggttatcgttttcaaaatttagttttttttaatttctatcagcatgtcattgaagttgacactaatagatgaattcataaatatggaaattttccgaccattttcgttcgttttcaaaaaaataataaaataatgataccgtttccgaccatttccgaccgttttcatccctgcctctagatcatggtctagcactgatcagcttgagttggctagaactgtttgagaaaaagaaataccaaacttttgaagacctaaccactgatgagctacgttttgaaaggtaagataaaggaatttaaagtagagtagttttcggtagaacaaaatttagaccacatttggaaggtgtaagaatatggtgcggagcaaatacttttaattcacacacacaaacaagaaactaagccctggcacccttgccctacttctagccctgcttgtctgtgcaagcacaaataatgcacgatgaacatgatttcagacattgcctagtgaaatgcattatgtacaaaggacttgctcactttgtcgatcagcgatgagatggaaatacacatccttgctcactgtcaggttacaaagagtatatgggagcagtgtgggcactagataacatgcgaatcgatcaatgggataccatggacaccgtggagaaatggtggactgccctagctcaaacaccctgaatagcaaagagccgactgtgctcgctgatccttctagtcagctaggaagtttgtgcaggaaaataactctctaatgtaaagcaaatgctccccatacctcccaaacctaccaaaacaaagacatcgcatacatcatagtgccgtacaccctatgtatcaactctcattcccatttccagcatttggcacttgcactcactcgtatcatcttttatagagaaaaggtagcatgataatctgttcaattcaggggaaaaatcactgtatgattgagggatttctttcacgtggaacattattcaaagctaattaaaaagttacataaacgactatgggcttgttcagtttgccaccacttttaacctgctaattttttgagttactaaagtttggtaccatagcaagttgaacaagctcttgtcattgttatcatactaacggctctctctggccatctttggtgagctctgatccaagaatttttggagctatatatttcaagctacataaatccacggatctagatatgcgattacgttgataacatttagataaatcattatgttcgcattttaattgaaatttaagattttaaaccactataatttaacatataaattttaaatcaaacgtgaatctaagatctggagctgtgccaaacaagacataaaaattggcatttctggaaatttattctcattaacacatgatcaaaatttggtaagctccaaaccaaatacatcgaacgttgg

SEQ ID NO: 72607 - DNA, 7286 bp, Oryza sativa
gtcaccatcatctcctgctcaaacaggatactcacacggccacatggaattatatgcactgaagcgtattacgatttcagagttcagacatggccttcttgccagggaagttctatgcattcaccaaagcagaagggctccatgttcttgatctcaaaataacaacaatggcgtcggcaatcttccatatgcaaacgctggaatccttctgatggctgagcattatcggtgcaaaggctgcaagctgagcaaaatttagaatccttttcatggctataccttttctttgcaagctatgcaaactagctggtttcctttctttcagtgatcagctcaatagttggtgtggacgaaatggctaggatttgatgtgtactttaattttgtttgattatgtattgtacaggttaacgtatgtcttagggtgaagggaaaatgagtgatctcatcccactgaaatgctgatgattttggacggctcaacaaccctcaaacgatctatatatgtctttacatgtgtctaatattgctttgcttatccttttgctctggaataagataggggcgttatggctgtttcttcctactactattctttccatcagtacaatgaagaaaatcacgagaaagtcatagctagttgtgtgcctgtactttgtcttccctaaattttcttctgaagtattgttcaactggaagagtcatatgcagtatatactgtccagcaggattgcaggaaagacttcaattaggaaccaaaagagaatgcataattaatggttatcatacatataattgttttggcaaccgttaccaccatgttctggagttggggagagcggcatatataaagtctttctgaattttctggtttcttcgaattttccctgccattttcttgttttgattgtttgaaacagtagcaatcccttccaatccactgtccatccaagcaatctaaacaagctaagggatggaaggcgattgggagggaggggattgggtgtggaaatggagatcaacgcggtccccgactccccacatggtttgatttcccccggaaggaatatcccaacgtaccgaaaaaggcctaatagaaaaactctgttcctgttgcttttgttgttgtaggcctaggaggcttcaggagctcttgtggtaccttcatcaagctttgattctggaaaaaggcatgatttacaaatttatgacctcgaatttgaaccaataagttcaatgggtcaattgagtacacatgtgtagtatgtgagatcatggggccatgtcgcatattttgaattccgagaagtgtagaaaggggcaaaactacagaatgggagagactgatagagattatgcaagttagcaggtggcaggtccgtccttcttgttatatgagcgccttagtttgtatcatgtttcgcaaaaaaaattatatggttataaaataccatcaaacgaatgtatgtgaacgtttaaacaagaccagattgtacattcaggagtaggcctaggaggcatcgggagctttccactatcgagcagaagttgacatagtgcgtgaagtcatggacgtggcattgagggacacagaacactagcaactctctcttgcagctcttcataaactgaaagcgcacgagctcgatgtgcgaaacagacagtttaacgaagagttgcagtgtttaacttgtatgaggcaactactgagaattttcttaatggaatgatgcatcagtgtgaatttcgatctggttttttcttaactgcacacataacactctgtactctgtttctgaaaggcagagtttatcaagccttgtgaccaaaggcaactgcttttgtttcagttactcaagtacaggacatgaacagagaatagaccaccgaattttgatttatcattctaacaattaaacaaaacgacctcacgtctgatgactctgatactcatcttgtgcatgttcagtttgtcaggtctatttttgttgttgccttttcgttttgttacatggaagtgtctaccatctatggcgacgatggcaatgccttgccttgtaaacatgcacattcggtagctcttcgagggtatatacgttcctgagttcagcgcggtggactatatttttgccaacaaaatgcgaagtaaaaaggagctgaggtagattaactaacaacatttaggcatggaaaactaacaacctgtaatcaaacagcaatacatccttgagtgatatgtttatctctcttttgtctataaaagagctggttatgaataagcacaattgcttggagcaattagagctagctagttctgttcatggaggctgtgagcttctgtggcttttaccgtacgtgttaagcttaattaggaggcaccggagcccttgtgttaggttgggcaacctatgattttaccaaacagcattgtcgctaaccccagaacgagttaagtattgtttgtgtggtattaattttaatatggcatgcattaaaaatccaaagaaataaatagttaataaaatatcaagaccgtcgagcccttgagctgataatgtagtgtacatcagtatatatatgccatcaattcatagacaaaaattgataaaaaatatagttaacacatcaatacgtacacatgtagaacagtagaagaagagtaatcatgtattatactccgtccattcctttttcttttgttagttcaggcctgtgcgctgtagttccagggaaactctgtctacaacaacaacaaatgaccgcaatgatggccgttccatgcctggagttgttgcaagaactcaacaaatgtaaatatattcctctgcattcaatccacccaaatgagagcggtttttacatattaatacatggggtatacaacaggaaatgacttcggtacccctaggcctatgaggaatctgaggtgctggccaatgggtcagccctgggtctattagtaatctcataggtgacaaggaggaggcgcctattaaggtagcagcgccggttcccgagggagcccgctattacctggataaaggcatcccccgggtaatatcgtgctccgtctggtcatcatcgacagtctcagaggtggttggggcgcaaagtgtgcatttattccaacccactagtcgcctgattcctaacttgagccgttgagggcatattgaggctcgattcgccccgggcagcatctcgagcttcggaggcctccggagctccgaagtccctggccgcctccggagttcttttgctaggctccggaaaccctctgagttccggagctcgagatgcttcctggggctccggagcccacggatgttacggcctcccggagcccttccggcgatctccagatcccttccaggctccggggctctcgccgtccacgggatccgattatctgggatccttggtagcctccggagcggccacctcggtcggggaccgacatggccccgatccacggtcatctccctgggaggatggtctccggagcgcttcaacccttcggaggatggctcctcaatccggagccactcccccaacaccttgcctggttaactcacggagtgaactatattttcattggtaacatgcgataaagaaaaggtgatcaactgaatatctgaacacaagcacatgccatgtggcactgaataactgcatgcatggaatcaaatggtacgtcgttcatccttttgtgatatgcatgatgatatgttttggtccataaaagggcatgcagggtggagaagcacacaaatgctgcaagcaatgagaggaacatacattagcccatgcagtctgctagctcctatggcttttgcagtggtaggcctaggaggcatcaggaactcttgtgctaattttgtcaatctttgattctaccaaaatgcatggtcgctgacattgaactgacgaataggctatgtcaattgagtacagatggtgagtattaatttgatctcatggaatcatgtgaccacaatactagaaaacctattttgccagacgggcgaaaaccgccttcataggcgaactgccaatccacctgtagaaaaaggtctgcgaaaatcaatttttttcacaggcggatatatggtgccaaaaaaacttatccacctggaaaaatggaagggcctcgtccacaaaaatcgttttcctcgtagtcccatttttagcttactaggtggcagattcaatttactagcttagggcgtgtctaatttggatagggtttcaatatattgcatgttttgagagatgagctcccatgtttgtttgttttttttactgaataacattgatttggatataaggacagttcatgtcatcaagaattcgtggatgactattaaatggaaattcacaagctatgaaaatagctgttgccagtaaaaaaacaaacaaacatgggagctcatccctttattttattctcttgaatatataatttcatctccatcttttaatgctcactcgaatgatcctgaatctagaaggcactgaaaaaccatcttacaactgattttttttacaaaaaaaataattaaacactcaatggtaggtgcacattgaattactgttatccctgaaatgtttcttcttttccctattgctcttgtatcttccctattggacaccctagaggatcatcactactatcctttctggtccatgaaagagttgagacaagctctgacaatgagactggtgagtgcacatctgaaatctgtttggacaagagttgagacaagctccactttcttttcggccaaattgggcctccaatgtagcccatgcaaatagtccagcccaacaccctgaccggtgtagtacccagaagcgcgaattttttttatttttaattttttttattaaaagttttacaaaaataatttttcattttgaaaattgacagaagtggtcgcctaccgccctctgggagggcgatttttaaaaatcaccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgaatttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaaatcaccaccataattaaacattgtaatgataagatagataagaagtgccatcgatacacggtacaaatttgtcgatcccgacgaatcaagcatgcggtaacctatcggcaccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccaacgttcgtactccatccaagcatgaatgaactgtatggtcggttcaggttgcgttatcggcccgccacttgaagtaactctgactgtgtcaatccattgtacgaattgacatttccttacatcctcctatgtacatttattttgggatagttaagttaatgatagtactgaggagtgatgaaaagaatagttgtaattaccacgaaatcatcgtcgacaatgtttggacacaagaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccaccttaggtagtccgatcttgtttcactacgtgggtaagcacgggttccgtcgttttgtgggttctccatgtctacccactcgataaagttgcacattggacgatatgtctgcgtaagatgttacaattgtgtacgaagaagttagtttttttatccatttgaacttcgaatagatgaagcatacctgatgaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcagttatatagcgttgttttcactgcaatatatgtgaactcaatgagatacattattcattagatgtgacaagacgatcacgagtgggcgtgattcactttatgtcaacaggcagcgccgaaagttgatagtaacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtag

SEQ ID NO: 72608 - DNA, 2241 bp, Oryza sativa
gtagactaataacaaaacaagttacagattccacctgtaaactgcgagacaaatttattaagcctaattaatttgtcattagcaaatgtttactgtagcatcacattatcaaatcatggcgtaattaggctcaaaagattcgtctcccaatttacatgtaaactgtgcaattgattttttttcgtccatatttaatgctccatatatgtgtcaaacatttaatgtgacggaattttttgaagtttgaagggaactaaaccctgccactgttaaaaaaaacaatattctactagtatttttttttctccaatagaagaactgatatttttttttgacgcacttgaaaaacaccagctgctttgctagctgagcaaccagaggccagagcagcagcagcagcagcagcagaacgagagccgccgcgccgcgtgcgtttcgtttttttgctttcccactcccgagacgccgcagagcgcacctcgctcttcgtgctgctgctgctcgcctcgccgccgccgccgccgccgccggagtagccgagcttgtgtgcgtggttcatctggcaagagctagcgccgaaccccgcggcgccggcgcggcggtcgtgccatgcgtggaggaggaggaggaggaggactctgaagtgaactgccatggcgagcatgaagcagcagcagacgccggcgagctccgcggtgaccgcggcggcggcggcctcctcctccgccaccgccgccgtggccgcatgcgaaggtatactgcttttttttttctcttctcctcgctcgtctggtggcggtggctgacgcggcggctgcggcggtgcaggggagcggaaggcggcggcgatcaactcggagctgtggcacgcgtgcgccggcccgctcgtgtcgctgccgccggtgggcagcctcgtcgtctacttcccgcaaggccacagcgagcaggtcatcatcatctctctctctctctctctcctcttcttccatcatcgacctagtttgatcgaagacttcttcagttcttgctgtttaatctctgctgtattttggatgctctctcctctcctctagtataatgttaatctgatgctgctgctcatggcaaggttgaaaatttgtggtcttttttgtgcgttttgaggtgaaactctcagatttctgtgggttgttcaatgggaattttttttcttttggttaattacagaaaagaacttttctttatttctttctgtatgtactgttgcagtgattgatacagtgcaacgatccttctcagagcaaatgttttacttacaccccaaataaacttttggctttggatatttgatctcctatggaagataatttttttataacaaaagagttgaagagtatttctcacatgatgcattgttcactgctaatgtatgtgaggattttacttgctagcagagacatctctgcttgtatgtagctactaataactgtacttgttcattaccaaagtggttgggagcattgggcctacgaggcttcccttttctgttgccctactagtatggtgagtactgtttcgatgttaatgtggtttggtctccatgaagcatcttatgggatttggatttcttgcatccatgaccctgagatggatcatttctagtccaaccgattgtaataaataaatactcctacttgttttgagaaattttgtcaaatggtaaggtatggtgctctgattgaaaaaataaataattaattattaggtcaatagacagtcttgggaggactaatcctgcaattattcgtgcatttctttttagaaagatgagaaaaaaggtcctttttcatgaatgatatttggttgcgctgcacatgatggtaattgtacttatgcgagtttatctaaaaaaagttcactcatgaaccgcactttctggactggacactacgaaacttcatttttttattgaaattttgttgacaggtgtacaaaagtaacatagtatgtttgaaaggttgtactttcttaaatttttatgagatggttatcgagtgctagtttacagagtagtgcagtagtacttttctttttccacttccatgttcttgagcacaaaaccttttttttcagtttgaaaaaagtggatgttgatccacatatactggctacttggttcagctgactgcatttttcattgtttcagatattaagaaatgctttctccatgctattggaaacagcagaatatctacttaatct

SEQ ID NO: 72609 - DNA, 2329 bp, Oryza sativa
ttcatctccatcttcagaagattcaaataccatcttaggtggtgtttgagccagtttggataatggattaagagaaaaaaaatcacctatcaacatgattctcttttggatattagaggttagtcgatttcttctgccttccattatcatctccctctcactcattttaatattttatcgtaaccctgcactcattttgctaatcacaatcccaaccctcttaacatactataaaaaaaatcatagaacaagtttaataatataataactactagcttaaaaaattaaggcattatatatgaccaacctaatagtttactcatggaatactaagtaatatatagatatagacatattgtatcattaatatctaacacacttatctctctcacacagtatattgaagtttgtgctgtacggttgactataaatttagagctcgtttttcttctctctcctccacataaatacaagtatgatgtgataacttgtacgcctcatttatacttatagtatcagcttattgtacccgctctttttttaaaggttaagcaactgatttctcctttgaaacaacagaattttagaatgtttcttataggactaaatggctaaaactctcgcaaaaatcgtttaaattctgtgcattggtatgatcatgccatgaggctattgagggtgcatgcaaacagggtgactcattagcacacgatcaactaagtattagctataaaaaccttgaaaaatggccggtttaatatgtttttctaaaaataatttctatataaccttttttaatatacaatgcttagatgttcggaaaacgtacgtgcgaaagacgagggagtagaaattaaggagcgtgtactacaaaacacaccatgagcagaccatataaatatgttagtgccaagacggtaagtttggcatgtttgtatggatatactctaagagcaagtttaatagtatagccaactactagctttaatttatctataaccaatctaatagcttatccaagccaactactagctttaatttatctataaccaatctaatagcttatccatacaatagttacatactacactattaatacctggtcccacctgtcatacacacactgcgtcttgaaatctgtgctacagctggctataaatatatagcccgctgctcttttctcttcttatttatcttcttaaattatatttacagctggtttatagcctactattgtacctgctctgaaacgtttatttttatgaaaatactaggatgaacggacgagcacgctacatgctagtatactactagtagtgagcattgtgtttccacgatgcagagctgacaaaatgattagcaaattatcaccaatgtgtcaagtggacgcaacacacacgtactagtagtacaaaacacacaaatggcgtttgatgatgaggacgtcgatcgaacaagctagcttacagaagacatgctccaggatcgatttataattagctggacaaatcgcgggatttccttgaacatcccaactaatcgtaccatatatcctagctactcgatcgtgactaacatcgtccactcgtcttgttgagtctttgcctagggtctttcggaaaaaaaaagtctttgccgagtggtacatcctcattcaaagaatcaactttaggtatgattctagatccaaatttatccttagaaattgattctttttcaaatggagatagtaacatagtaattcctccgttctaaaatataaacatttttagaaaagtaacaagtcaaacattttttattttaaccattaatagggaaaaaaaatcaatcatgtaaaattgatgttactagatttattattgaacaaactattctaatatgcaacttttttatttaaaatatcttacttttatagatattgttgatcaaagtagcatctcggagaccatatgtcaggataaaaaatacttatattttggaacggagggagtagttgtagtatgatggacttccctagatacttaatactattatcagtttcggatatctgtttagtatacagtcgcccgaattaaataatactagattcttaatttttaagagcaatttagaaggatccactattggaaaaacataagaagggtgagattgctttttgtcagctccacaactaagctatttcagacattaaaactctgccaaacacagagatttgaaactctaccaaatatatatgctaactcaagactgtcatactatttccacctatatattcatggttttatgataagagggagagcacggaggaccaacgtatatcttcccgaca

SEQ ID NO: 72610 - DNA, 3216 bp, Oryza sativa
agagtgcagtaacgacctataaatttggcagtaacggcccatatttttcgcagtaacatgtcgtgttactatatcgtgtaactgcagttctgcgataatgttactaccgaatcatagtaacaatgtatgattttctacagtaacataacgggtttgtgttcacaaaatttgaacagatatataagaaagaaaacaataatctcaaatcacaaagtgtcataacgtgaattggttaggaaaatttgttatgaactatgagatcatgggttctagtcttgaattcaccaatttatttttagtttttctaaaaaaaagaaaagaatagaaggaaaaaataagagaaggagggagaagaaaaaaaagaagggacggagagatcgggagagagttatagtcttgaattcaccaatttatttttagtttttctaaaaaaaagaaaagaatagaaggaaaaaataagaggagggagaagaaaaaaaagaagggacggagagatcgggagagagatcgagaggaaggaggcccgccgggagtgggtggggccatgggggatcatgggttctagtcttgaattcaacaatttttttttattttttctaaaaaaaagaaaagaatatgagaaaaaaaataagaggagggagaagaaaaaaaaaaggaaggagagatcaggagagagatcgagaggaaggaggcctaccgggagtgggtggggccgtggagaataggaggaaaaaataagaggagggagaagaaaaaaaaaggagggagggagagagagagagattgagaggaaggaggcccgccgggcgtgggtggggccgtggggtcgccgggaacgggagggagccgggagggggaacgcgcaccaggaagcgaagggagggggcgcgcgtggggactggggagagggaagggagccgggagggggaggacgcgtgtggaggagggagtgggtgggctgggcaagaccgggagttgagggagagggatcgcttccctctcctcctagcgatcacccgtccctcccccctaatattcctttttcatatctcttttctacttttctattacatcataaattttaaaaaaatagtaaaagaaaattagaaaaaaaaatataatactctcattcatgtacatatactttgtaccatacactttgcacgcataaactttatgtataaaaatattttatatataaaatatttgaatccgaatttgaatttaaatcgggtatataaaattttgacttataaacattcgctctataaattttagatggataaattttagatgtgtaaactttagatgtataaacttactaaaaagatgaaaaagatgaaaagaaaaaaaacgaacgctagcagtcgcccgttagccatctcgccatcgagacctacattgctagctaatctggccccacccgtcatagaatcgtcggtctctgtcccctcctgtcatagactcgtcggtcctcgcttctccttgctcgtcagttgtcttcatcctcctcctgccgcctgaccgcctgtcggctgctcttccttcaccccatccccatggcggcagcggcttcggcttcccaccgcgtgttcgtctacgggacgctgatggtggaggaggtggtgcgcgtactcatcggccgcgcgccatcgtcctcccaagcaatcctccccaaccagttcgtccacgagaagggatcggaagggaagatcacctgcgacgcgcccgcgcgcggcggcggagggaggaggaggactgttgacgaaaaaatcaaacacaccggcctgggagatctgcttaactcctgtgcaggtccaaagattgatgagatgcgggcgtgccaatcagtttgattctgcaagtgacaagatatacaaataatagatcaaacagccgatcagctgacaagccgatggagtagttccagtcgatagccgataatagccgatgccggtaccagccgatagcgatagggtttaagcaatcggctatatgtccaatgtagataatgatataaagacaatcggctgatgataatataatatagcaatataacccagtaaaaaccaatcgattaacaatatgatatagtagaacaaatattgatccgaaggttaaagcatacatcggctggaggtccaatgtcataaaatccataagattagattaaacagtgaaacctttgttgccatcggctaaatccaacttatatgtatatgcaatccttacaagccgatgcaacgtccagataacttatcggctagcatcccgataaaacattagcatgaacctatcggcttaacaagacttatattatcaacaacaatctagtaggtcgaatctaaccgatgcagcccgagattgtatatgataatctaatactcgatgagccgatagatctatctaatgtgatggatataacaaatctatttataacgacattgtgattgtagagatatatcggctaagacaggagatcagacctaaccgagacagtcccaactaaactgatgcgtctctaaacacaatgcaattagaggtagaattgagatatcaagtaggcaaatatatcaaccaaaccagagcgatccaagagatcgaatcgatgcagccttgaacaacaccaacgtagccgacagattcaccagggcccgacagagcgtaggacttacccctttgctggagattgaaagccgatgcagcctacgtcaggtgcccaaattcctctggaagataagtaaaaacgttagggaaaagggtggcgatgcaccgagggtagttttattgatcgatagattgatagattacaatgaccccaggtgtaaatatttatacccatatagagatactagtccttgttggacaagaaagaaactaaaaaggaaaagataaagtccttatcggacactaaacacactttcctaaagataaaaggaaacttacaaactatgcctaattaatagataaactgtcatgtcgcatctttttttgaactcggactcttgtagataagctttgtttgattgatccgactccaccaagaatatgacatcgtggcgacttaactcttatcggctgattctagaactttgaagccaatattaactctaagccgatgataactttgggcttaccaaatttcattgttaacaaggacgcacgggatgggacagaaaggcaacggcgaggacacggggcgcgggggggtggtgg

SEQ ID NO: 72611 - DNA, 774 bp, Oryza sativa
catacccgataaggcgataaggcccaaaaggccggaggtttagcggaaaggcccctcctgactcccagggggtcggagaaaaaaaggccgatcctttggatcttttaagaccgtccgatcgtaaatagacggtctagattgggcaataagacacacagcccaatcttttcgcatatagccaaaatagaaaatttttaactttatatttagagttcattttagagtttttttactaaagtttcagtctttgcttttagatcgctaaaaacacatatatcatatataaaagttttattcataaattatttttcatttacgtatatgtcccgaacgatgggggtcacaatttttttcatacatcagatttgcaaaaaggaccattcttttgagtgtaattgagtcattcccagggtgataggagaagacgacaccgagtctccgaccgcctttggctgtctggattggacgagggataagaacgctgtgacggaaattttcagaaaacatcctatcaaataatttaccgtacaaaataatccctcataactccagacgctgagctccgagaacggcgatatcaaacaaacccaaaagggcacgaggaaactttatgtgtctgctggtagcctggtactcttcaaaggagcgaggcatttttcacataagtgttaaaaggacttacaaatggaaaattgcccttgtctacagaaacaggtgatgaacatggctcacaggcattagccatacaactattacatacacatgacagtacaa

SEQ ID NO: 72612 - DNA, 35075 bp, Oryza sativa
cagtttgggaagtgtgctcatgggaaacgagggggcatttcagcccatagcgcagtgccaaacaaacccttaagtgtggactgtctgatccaggattaataacagttatcttccttaggttggtgtgcagaacaagacatccgatgtacattccaggctagtgaacgccgtggttattgatgccaacaagaatcaggtgcctgttattgcattaacattccaacaattttactcttttgctggatattcaattatttgcggaattgtgaatacatgtaaatggatcagcaagtcttgttttttgagtcttatctttttattatgggacctcgtgatgaaaactatatgttccctgctatctattacaaaatttccaatagaaaatcacataataccgtgctatcactggtaaaagaatgatgtgagtcatgcaaccagctatttgctgatacatgtttttatcttgaaatgtagatcaagtctacttctgtcccgcaactcccgcagcagaaggagttgctttctgccctgcgtccataccattccagactagtgggagagagttttctagcaagaaagaggcccgtttatgaatgtacagatgcccaggtattttcttaatttgtttgattcttcatgttatcttgtatctcgtgatctgttcccaacttaggatgcatcctgatattgttgaacttatatttctttctcttttgctgatataattgttatagaatccataaatgtgctccactggtttcatggcacgcttatccttgctgttgcaacatggtctctgttagttgaagtccgatttttttttccgaactgatttttttttcctggttcaatatttttttcactggttaatgaactgtatgagctttcatatttagtcaaagccttgagggatattcaattttctcaaattgcaggtggaagctgccaaaggtttcttggcagtgcttagatcctaccttgattcgctgtgttccaacttgagatctcatacgattactaatgtgcaatccaacaatgacaaggtttgttgttaatatagtgtttgttctggttattctgtgtcccctttctttgtggacaaataaactagctgttatgtggtgcagataccagacaaaatgttctgtcagcatgtttacaagtgtagcatacaagttactaatgattgttttctgtattgcacaggtttccttgcttttaagagagagcttcatcggttctttcccgacccgtgagaggccctttatgaaggtataaactgtagtcttcccttttcttcttgtgttcaatggaatttctgagttttgatagtacagcttatacatgtacggatagtctagttctgtttctttgctactaaagtattgtaataatatacttggacaacactgaataggatacttcacttagcattttaagtcttcctatactgaatactatgtccatcccaaaataattgtaattcttggttgtttagcatatattaaggtttgagaagaaagtctatgatgcccctcattagatggtgtataggtaagagtggaagggtggttgagagtagaatagggagaaatttgaatgagaagtgattgattcgacaatcagtactctattgtgacaactattttgggacagagatagtacgtcttttttggacatgcaccatatcaaactttcaaaactttgcacatcaatcgttttaaatactaaactgtatacatgaaaaatcacattatggatgtctcaaaaatcactttcataccgttataattttgttggattttacaaatagattatagtagaaattagtggtcaaaattgtatttcagagaccatgtcgatacccaaaatgccatgttcttttcatggcctgtatactggtccatggactaatgtatgtggacttttctttttctgttggcagctctttgtggacacgcaattgttctcagtacatacagacctagttctctccttttatcagaaggactaagtctcttttaagaatttaaccatcttcagtgagctgatttgccaaggtacattctctccttttgttatggcaattctggcatggatattttctgaggcaataactgttaatgttactgctatacttagttcctgtgcacaagtctaaagtgatttgtatgtagaatcgaatggaaatcactttctctggcactatgatgcacctgactttgctaccctcctgatcattgtgtgggggaaggaaagtcctaaaagaaaatcatatgttgatgatttgcagagtccagcaaccaattcatgattattaggtgtgcagtgcaattaagtgcagtgcctaggtaccaattttgcctttatgtatcttgtgtgcaactgatctaatagcatggtgtcttatttcggatatctttccctccttgtgaaacagtgaagccgattagcatggtgtcttatttcggacatttttccctccttttgaaacagtgaagctaccaacagttacagcttgaaagttgaaacctaccgcaagttaaaaccgtgctcaaatgtccatgagataacattgcctttgatattaacactttatgaaatactctatccgtcccagaatatagcaacctaagaccggacttgactcaacctagtactatgaatttggacatgtcttctgtccagattcatagtgcataggttgagccccatctgatccaagattgctatattttcggacggagggagtatgtagccaagtatatttcgatccttaggtgtctactgcatgatgatttattctagtgctcattttaactctctctctctctctctctctctctctttgcattacagtgttagatcccgatctcaactgtacatattgatcttgaaaagatgagctgcctttttattacattggcagctcaacgttgggttaccaaactgtatgggtgttcatatgtggttccaaagaaaccatactgaaccagacaaagagtccagttcatggctatgttaaggtactggcacggctcccataaaaatgaatacggctggtttggacgaaaccaccgatgactgttggagaaatggtatattattgagatccagatatggataattagccaaaatgatgttctagtagttatacattaatttggcatggctgttgcacacagcttgccatttaagattttgtaggtagtagttgtcccataggaaaacctcccaggtctctcccttcaacagtgactactaaatatgttaattctgcgttgcaaaatgtctgtaatctgaagtgttcattttgcagctgtaatgtaatctgtatatgagggggaaacaaaaatacgtactgttatttgaagatcgggttctttgaacctcgatctgttgagtgatggcatagtgtagagaagagttcggtatgtccagtagctttggaatcttgacatgaatcttgacggaggatattgttatgctggacgctcatgcatttttccatgtttaatctagtgttaggtggttatattttgggagcgagtgagcgagaccttgtgtttgatggcaggtggcagcagacggtccaatcctggccagtggacatgagcatgataaattcattaaaagcaatgcatattccgatgccgtctcttgttggcggagtttaaattgtctgacagatcgtcgttatagcctttgcatattggactatatcggcgtcatttacccattggctcttagagcagctacaataatagcagactataagccagctgtaaacagataaatgaggagagagaagagcagcgggctatagatttgtagccagctgtagcacggactccaagacacagtgtgtatgataggtgggaccatgtattaatagtgtagtatgtaactattgtatgaatgagctattagattggatatagatgaattggagccagtagttggctatactattaaacttgctcttagccatcccagttacagctccttttttggctcttagccatcagttacagctgtgggacatagttttacctcctttttacttcctggatgaagaacgaagggctggtttagtttgtgacctaaattggtcttactaatttttgtcgatgctaaattttggtaaattttgacatggctaattttggcaaagcaaaagttgtgtttggattgaagctaaaatagcctaagttaactattgaaatggcctattttcttaagcatgtcaaaatttggcttcaaaccaaatagacactaaacactttgaaattgccaaatattggtaaggccaatttagacctcaaaccaaaccggcccgaagagcttcattgaccagcattccactattaacattttttatctgcctatcaaagtgaggaggcatagaaagaagagtttgacgaggaggcagcttggcaaggctaatatacctttgcttcatatcaagagatttgagctgtggatgatatgaggagtacactcaagttttgattactttcgaggcaaaagcccaactgcccaagcaagacctgactgtcgagcgtcaggccttcgcttctaaaaacagtggcttattacagcctaaagcctgttgtttcatcagctaggagcaatgtttcggtgcagtagtactcatcagtaccaagccgaaagcagcggtagacgtggactgtggttgcgaggaatgctacaggggcggtgtgcctgcgtgagtcgctgcgtgcgcagggagtgaaagggctccgctttgcccgtggggcggtagcagcagcagcagcagagcgcagtgaatgtgcctgccacaacgtaccacggaaaaagccttcgaccagtggtcgtcacactgccgccctcctcgccgctactactagctcgctgcatgtgccgccgcctgccgctacctacaacgtcgccccatggtacgacgcgtcgctgcgtcacccccacccccgtgtgtaccagtgtacgtacggtggctggccacgccacggccgtcggaaagacgctgctgccggagtttttaagctttttaggcagatgccgcaggaggaggacgaggaacggagcggagaccaccaggatcttctgtgtttgggatcgcatcagcagagtcgtcatctgttcacttccgtgccaacttggccatgatgcatcatgcatggtccctgcgtgcatgcatgcaggtagcttgggctacatagttaagctggccggcgtgtccaccggattaaacccccatggtgatcgagactattctcgctgccgaatcaaagcgtgatcgctgatcgggtggatgcatgttccctgctcctgggtcgccggcaagctagagagccccgctccactatgcatccacacaattcccgctgcacgatgcctggtccctagccccaagctgctgactgcactaactccaccaccactgggctcagtcactgcttcaatccatccatgcttgctcatgatcgaatccttcgccgataaggctactcttaccttctttccttcctggagactcttgcaacttttccttcccagtaatatgctttcctacctgcagcgtcccaaatagtattctgtagctactcctgctctgagtcccctgatccagtagtgcatattgtcgtattttctccggtgggagcatgaacacaaatacaaacagtagtgcatattgttgtattttggctgtgtttagttcagcgaaagtttggattttggttaaaattggagatgatgtgactgaaaaattatgtgtgtatgacaggttgatgtgatggaaaaggactgaagtttggatgcaaactttggatctccagtgggtgcatgaacacaaatacaacagctcgagagaccccaagcctgaaatagcaaaggtgaacttgcaaattcctatagctacacgtctacacccagtcgccggtgaaactgccgcgctagctacactccacaatatcctcctcccagtacgtacgtacgctgtcgtctctggcgccgctgcacgcgagcacgcatgtgcatgtgggtggggtcaaatcgacgccattttgcagcagcatctccgcatgcagccgcgccaccaccaccaccgccacctaccggggcatctcccatttaacgccgacgccgcagcgaaagctggggaacgctgacgagaagacgccactgtccctccctccctccgcccatccatccatccgcctgcttgcctgcctgcctgcctgcctgtacgcatgacaagcagcacactgcctgcctgctgccgaagcatgcatgcagcggggtgtcctgtccctgcatgctgctgctgcagacgcatcagagatgacacagagagagaaagagagagagaaggcagctgtctactccagcagggagcagcactgcacatatgccatgcatctgtgaatcagatgggaagccttacataagctgtgcaggctgtggcaggccaggcaatctgaccacttctttgactcatcatgtaggggagagaagggaccttcagctgaggtagtagctcgtcttcactgttctgagctctggacggacactcccagcttgcatgccttgggggacaaaacatgtgctatcagtgagtgagttgagtgagtgaggagtttgttttggttattcatttgctgatcaggttttgcaggaatattaatggcaatagaaatgttatttcccctcgtagtaggagtaagtggttgccatgggcttcatgatgcattcaggcatgctcgcatcatgcggtgacaaaagtacaaacgttctacgtaccccgtgtacttctcctacaaagtactaccggctgcatttccaacagaatgtagaagtagatttgttgtaacctacctgtactcccaaacatactgcattttccatgcatgtacttcttaccttttaaaagaacgacaaacgctacacattacccccttcggacatgtttagattatagccaaaataaatcttaccaagtttggtaggatttattatttattgaccaaatctagcaacaaactaaacgtagattttttttggcaactttaatttaaaaagatagtatggttgaaaatggtattaaaagtgaacatgtcttcgtctcaatataatctaatagaatgaatccgactagaaaatattgtattttattttaattttatttattttgggacggatggagtaattgataaattgatgggagtagtaagttcaatttttcagtatgaatgcgtggcacatagtcaaaggacacagggaaagactgaaagaaacctttgtggatccatggggtgatccgaaagagtgctctgcaagtctcaatccatgcatgcagcctgcagagctctgcagtgtcacaggttcacagccgaaagagaggccttcgtcagtcagcagtcaccacctccttagttcccttctcctggtgtggaggtggagccccatctatctgttcccctcactgctgcagaaaagagaaaacaaaaacgagctgcattggagacctccctcttaaaatgtagtagtactactctactagtagtaagggggtgtttgggactttagcccctctctcaaaacaccccctaagcatctcaaatactaggtttaaggagtttttgagatagtaaaagtaaataagagatgggttgaggggaaaatagtgtaaaacttaaatgagagatgattataattagatgaaatatagactgatgataaagttgttctaggataaattttgtatgtttattaaaagcggcatagtcaaaagccctatcattatgggatagaggtagtactatttccgtccaaaatattttaacctgagtaagaatgtgacacaatatagtaaaataaatctaaatgaatatcctctattcaaattcattgtactaaattatatcacatcctcatctagattggaagaattatatcttaagatagggggaggagtactgattactcctacgattgtctggtagaagaaaaactcttagttctactactttcttcgtcccataataattttatttgtagtttcttttatttgtcccaaaataagttagttttaaggtaatcattgcatcgaagtttatgaaaaattgtaatatttttattgggagtagataaagtgctgaatagttgtattgggatttaataaaatagatgtattctttaatcctttttattttgtattgttacatgtgggatgagtgaaaagtaaaattattttggaagagaggaggtaaccttccggtgaatcccagttagtaagagcatgataagaaaagaaaagcaaagccaaaacagagcccaataattctctcttatctctgatgggtcaagcacatcatcataaggaagagagtcgatactccaggactactagtagttgctgctcctctgagtgtgctgtctggtagccattgatcattgagccagtgggttggcttatctgagccccaattgctggcccacatggcaggcaggcccatgggcccattgtgttggtgtcagtgggcatgcctccctttctccctactttgaccaatcaagtaccgttgggggtgcaactgcgtttcatgtctgtactgtaattattgtgtgtgtgcgcctctgcagggatggaagaaagctcgcgtatctctctgctcatgtgcgtcttttgttttgcaaaaacagcaccttttcggcgtcatttccttttgatcattatgcctaagtaagagaataattctctatcattgatgcaaatggtaaagctataatttaatttacttctgcctatgctgaaagtttgctttctttttttgcatatgcataggaagtgaagtgaaacattacagaatctcagatggaagtgaagtgtttcaaatggagatgatgaaaagtttagcctagacgtctagggcgacatggccgccacatctggatgcagagaatgcccatgctggtgtttgttcgtttggccactgccaagatttggtcctcttttttgttacaggaaaaagaaacagcattctcaccatcgagcctatgagccctgagccatcacatcggtgtcggggaggggaaaaatactagtcgtaccactactactgtacgggagtaaaacttgttgcgtctttcacctggaggaacagtttaaaatatgcacaaaatcagagagaaacctgaaaagccagaggtatacagtactgtacgtattcccttctgcggttctgcctgcagtttgctgctttctgccttttctttatcacgcagatgctgctaatctcacaagacaatatgtaaacccattgtgctggtagcatatcatatggcagtatccagcatatgacaattaaaaccttgctagttcaggttcaagccattctgggaagtttccccagcaaaacacatgcctcctcgtaaatgcactggtgatgcccgggttgagaaagcgatcgattcattcattcattcattcattcacacgctctgcctctgcatggaaatgaaatgaaaccacccaaccaaccagcagtttacatggaagagttgaatgatggtcgtctctggttaggtttttcacatggaacaaaatggcatgcatatacatatcaacagtggcgaaaagcctgcagcgcgtgagagagtacactgggtatgtttagttcacgttaaaattgaaagtttagctgaaattagaacgatgtgaagaaagagttagaagtttatgtgtggaggaaagtttcaatgtgatagaaaagttgaacatttaaagaataagtttggagctaagggtttgtttactttgatgaaaaaaaaaaccttactaaattttggcatgatttcttatatgctctaaaatttgatagtaaactaaatatagccactttttgataactttaccaaaatttgataaggttaaaaataacattaaagtaaacatgccctaattaaacttggccattctcctgcaacgcggcaagctgcgcctctcgcgtcggctcgtcatctttacgtctcccacccctttcactctctcaccatcaccaacacctggttggtagctgcatgccgcgcagtacgcacatactcctaccactcaatcttctcgctgtcttcttttacgtttgcgactcgcttttggtcagccttgctgcctttgaatcgaacggacgaaacacacacatgtgtgcacagtggtgtgcgtcgtcgcaggggcagggcagggcaggggcggtgtgggagagaggcttctttgtttatgagtttccgtaaagctggcggtcagagacagcagcaacaaaaggcagaagagcacagcagccacgctgcagacttcacagatgggtgctgtcccccattcccctcctcaccctaccacaccctaacctaagctacctgtagccctagagagagaaacattacagtacagtactcatactctctctctagctctagagagagaaaccaccgtgcgattaggagatcagcagtatccttctttcattccttagagcagttacattagcagactattactacctccgtcccaaaatataataacttttgcttataagcatattttaacgagataaaagttaagagagaaaagtagcaagctatagatctgtagccagctgcaacacggactacatgacgcaatatgtgtatgatatgtgagaccatatattaatagcatagtgttaacaaccgaatttggtaacatcagcatcaggaaagaagattagatcgaagcaaaatcgaaggcggagatcgagttcgaaaacaaagcaggaatcggctggagtccaaatcggctacgattaggatcggctgggtctgagtcagactaggtaagccgatagagccgattccggcaacgcagcttgatgtatgatatcgggtaggattgaggtgcttcaaggtgattgctgcatatggatagagtcctcagaagtcaattatatctattaattaggatgttttatgtaatctccttagagatacgattgagcaaaagtctggagcaaagacttatgttatcttagagtttgttagagatagtagtcgtgtccgttatggacatatcttgtaattctcgggtataaatagacccgagccctatgtaacttttaacacatacgttcaatacaatctcggcgcatcgccacccttttgttttagttttatttcgacgagttcttacttttgggttgagctgcatcgttttcgatcttcaacaaagaggtaaaacttgttatgacgacttgtgttctcgggattagtgctgccatctttacgatgctctgacctcgtttatgtaattcgtcaagttatcatatatcttacaataccgctatctaatctataatcggctaacatctgtctgtagagggcagccgactaggttagatatcgatgttgacttagattatataaggtatctaccactctatgaaacttccaatggcttgattgtctagatattgcccttcttttcatacttatagctccatcagttgagtttgatcttataagtcgtgattagaatctcaatctctagcctgccttctggttgccgattagggtagcatcagagtttcagccgatcttatctgatttaactatatttgctctatatgcttcattgacatgttaaatctgccctttatgtcaagatattgccgtatctaagtatattaggcatttgtttgatatattatacctattttaatatcctgatatagagtagtatcggagtattagccgatacatgctagatctgtctgattggctatgctacaaacatatatagctctgttattaatatatatttcgatctaggtgatttatactgtctcggcatggtgaccgatctatcccaatcacttgatttaagtatatatcgatataagaactatatattggaaatatctacagccgatcgaatagatttaattctttactgtctatttacaactgccgatcgattcacatatgacatcggctcaaagataaatgatatgtcatcggcacctagccgatcggctatcatttatagatttaaccgcggtttctttgcctttatttcttattgattacacgatcaaatcatgtcacacccaaatctggcaccgccgtacaacggcacctgataggagcatgtcgtaggaaaaacggcgcgaaccgcttcctacgaaaccgcgatcacagtaccagtccagcgctggtacccacggtgacaaatatgaatcattgcaatccttaaaaataaaaagaagacttatttaccttaacttaggttgtagctcagaatagcctaagaatacaaccgacgacgcgcacgaggaaacaccaacaacaacagcagcagcggaaccaacggtctaacacccaacaccacaggcgacggctggaaaccaggacgaaaccctattcttcacttcacttcatcttcaacttcacgacgaaggaactatatatatttatatagagcaagggtgagtactttcgtactcagcaaatcacgggaatttaggtgtttgatgcaagcttggaagagaggcaaggttgttttgcaaatcttttgtttgaagtccattttgaaaccactaagtgatttatttctttctaagtttgggccgaaaagtgacttgcgtctcgattcgactttaagagatgtttttcaacaactcaatttgtaatgtaccgacctcccgggtcagatcattacttctcggctcacagagccatttcacttgattaagcggctcctagagccttattcatgttctcgaactcccagagtccagctgcccaacaacacaacgatccgcttccactcgggaagccaagtctatgatgcccgcagacatcctgaatcacacagattcgtttcttgaccactcaggtcatccatctgccacataggctgattctagtaacgattcccaatccacaacaatttttcacaaagcacaggcaaacaaatctacgctacaggaaacacctcgcatccgcccatgaccgtgggcacggctgttcgaacagtttaataacctctgcagagggggtacactttacccacacggcattactaacccggatcacccagcccgttcagaacggccacgtatggagaccttgaggctttcatgacaaggcaattcgaaagccgacacaggtttaccatatgccaacgagaggggtcccagaccaacacccggttaggtcccagaccatactatgccaggaagcccgagggttctccccgataccaccccgttgaatccacatgtctcttggcatcatggctcccctgattagctaccggggtcggcttgacccggtcttggccgagctgcccctttctctcgggccgcgccctagccgcccgagggaagtctgtttcccctccctctttcttttcttttcaaaagggtttaattaaatcctttttcctttagaacaaaaatccaataatcttagaaattcaatatcttctcaaccgtatgtccgtttgactccgttcaacttccaaaactcctcaaatctcgatatctatttaatggcacgtttagaggtcaataatagggctttatttttgccgtttgttgagctgtcccgtttcgcgtgtagtttcggagcccgaagacccgtagtgcgaggatttcgaggatcaagctcaagatttcgagcaaggcaagtcacctttgatcatcttgcacctataatttaaatctaagtatttcttttccgcaaatattgcatgaataagtttaacacaagtatttcggccgcggcttgcgagatagcttgccggccacaatcctaattgctgcaattaccctccttgaattattgaacacttagatctcctttgtcgactgttgtgcttcgatgcatgggccttcgggctcgagcatcggaacacttcccttgaaatttaaaatatccaacgatgggtaaaacttggggttttataaaagacttggaaaaacccgacacctgggtaggtgcttgcgaactaaataaatttccaaaatcgtagatcggggaatgtaccgggagtacggtttcccgctcttgcacttaaggaccgttttctttggaatttcatccaaacataaggcaaatgtgaccacataggtggaatgggacgcccctggctgagtaattagctaatcaggggagccatgatgccaagagacatgtggattcaacggggtggtgccggggagaaccctcgggcttcctggcacagtatggtctgggacctaacctgatgtcggtataggacccctctcgttggcatatggtgaacctgtgtcggctttcgaaatgccttgtcatgaaagtctcaaggtctccagacgttgccgttctacacgggctgggtgatccgggttagtaatatcgtgtgggtaaagtgtatcccctctgcagaggttattaaactgttcgaacagccgtgcccactgtcatgggcagatgtgaggtgattcctagcgtagttttgtttgactactgctggtgaaattactgttgtggaatgggttcgatgtttgaaaaatctgcggctgatgggatcagccaggcccgggtggccgtttgaaagctgttggacgggtgccaaccttgaatcaattcaaaaactgatacattgcacatactccgaccggacgagacacactgtctcatccgtgtcgtttgagaagcactcacttagttgtttcaaaaaggagtttaaataaaaccaattgcaaaaacaacagcctttcttttgaagcctgcattaaacacttaattcccatggcttgctgagtactcctgtactcacccttgctctatgtaaataatcccccccaagttgctgaagaggatgatgtggatcctgctgatgaggagttcttccaggagcaagtcggctacgatgagttttagggtttcggcctagttcccaagtcgcgcctgtgatgaatggtccaagtcttggcttccgctttcccttttgtaatgcagttgtgacctcgggatctgtccacagcccaacttgactgtactcctactctataataaagagacctctgttgctatgatattctgtcttcctgtgataccagcactgtttcctgagactggtatcgattaacaggttaatttggagcgtcacaggctagttccgttcggggctagttcggggcgtgacaaatcaactggcacgctagtacacccaaaggcgagctttggacctgcactggagttaagcaaatctcccaggcctcgtgttttctgtcactacatagtaagcaactattgtataaattaaccattagattggctatagataaattggagctagtagtgggctatactattaagctttctcagatattataagccaactataaatacatattgaggagataaaagaagagagagagtagcagcgggctacagatctgtaaccagctgcagtacggaatctaaaacacaacatgtgtataatagggaccatatattaatagtgtagtatatgtgatatgtttatagataactatcgtataaattgattattaaagtgatcgtaaatgatttaaagcaattagttaattagttagctacaccactagtacattaaacttgctctaatactagtagtagtgcaactaggactgtagtaggagtatgtaatcatgatgttgtacttgctatcctgattaggagttgtgactgacgcattcataggacgagacagtatgattaaacggaacaatgactgttcacttctaatgacacattaattcgaccaaaagggtgtgcatgctctcacctggagtggtagtagtacagcgaagagggatcctgattttttatacggtgggtatcgcccaactggtgaccaacagtacatatttctggtgtactctacacaaagaaattgcacagttttttttctgagtatatatatatatatatatatatatatagagagagagagagagagagatgagtgtgaggtgggtgtggggtgggtggctgcaggctatctgcgtggggtgtcagagtctgcctgtctccctctcactgctgctgccatctgcaacctgcaccgttgcagtcaataataataataaacaataacattcaagtggggcctctcgctactgcgcatggtggcaccgtggcagcatccacccgcagggctcctctgacaccgaccagcattgcccattaactatagaaacccatagtgccttctactgctacatgcaccaactaccattcgacgcccgaaagattttactactaccctagaaatactgttcttgcggtaatattcagaagaaagcccccaaaaaataataatataacttatctgaaaactaaattgtgctcaaaattatttgaaatgtataaaaataaaccacaaacatcagcgctaagcctggtaatgtcaaagtccaaaaacaccatatattttgacaccaccatgttgtcgttgcgtcctaaacgagttgttcaccgagactaggccagaagtttaagatatcaacgaggctgtggtggcgctacgttttatcctccgtcaccattttgtgctaggtgagttgtccgcaatattagctaggaatttcgaagcttgacgagaccacaccaacactgtatttgatagagctcgatgagggatagcaatggcaagctctaggtgtatcgtccttgcaaggttcctttgcactaaccacttatcaggtggatgagtagttctatgctaagatcatggtttattttttatatcaatgtctgatgtggttcatcgttgaaactaaatttttccacaaagatcgaaccgtcaaaaatttggatagaagaacaagctatacgccatgcaaagggccttattgtttggcttttttcatagtaagccaaaacggcttattagagaataaaaataatttgtagataaaagttttatatatgtgttctcggtgatttaaaagccaatgccgtaaaagaaactacgttaaaaatatctcaaaatcaatgtcaaaattaagtttaaaaattcaaattttgtttttttttctttagttgaataggctatccgatgggagccaaagtttcccggtgacagtctagactatagagacgacgaccaaagcgcttacgactacagtaaatacggcatcaagcggcggtggccagttgctcgcgtcgtcgccggggagaggggagacgcgaggaacctgtggagtttttgcgggtgagattcctacggctgcgcgcgcccacgaggggggcgcacagcagattctgcagcgcactctctgctctgcctctgcatcttgactgaatgacctatcttctgtacccgggacataaattatcggagttaaatatccggaaactattcaaacaggccatcgttcgcacgcctacgtttttcttttaagaaaaaaaaaatatgtcctctgcttcgctcacacgcacgtactactacgtgggctgcttggttgcaagcatccttttatgacaaatctgtactgtgcggtagggttattttccattcttcctactcctacggtttgttcttgacattttttttcacaaagaaaaggacggaaggagtataaagcatgtcgcttgtccaagcaaaagaacagtagccagtggcaaacaaagccctgtttaattcaccccaaacttcccccaactcctaactttctatcacatcacatcacatttaaaactttcctacacacacgtaaactcccaactttttttccaaactaccaactttccccaaacttctccccaatttcagaaactaaatacaaccatagtaccactggacaaacgagtcctgagaatgaaagtgattgactaaaaactattatggccgagtttagtttcaaagttttcttcaaacttccaactttttcatcacatcaaaacttttctacacacaaactttcaacttttccgtcacattgttacaatttcaactaaggctgtgtttagttcacaccaaaattagaagtttggttgaaatatgaacaatgtgatggaaaagttggaagttcgtgtgtaggaaagttttgatatgatggaaaagtcaaaagtttgaacaattattttcgaactaaacacggagtaaacttccaattttatcatgaactaaacacaccctatgtgtaaatgtctcactgttaatgagaagtgaaagatctataaatttctatccggcctagaaacagttgaagtaataacatcactaccttaactaaagatgttgggtttttttttaaaaaaaaacacattataaacgtacacccacctgtaaacatatacactcactttgcatattcggttatattccgacaatataaatggcaaaacttgaaaggtgccatgcatagggaaaaaaactgtcatgctaaacaggaaaatacatacttggtgtcaactacttcgtgggttattatattttgacgaacgcattagtgttaattcacactataatatatttgttgaaatacttttcactaaaaacaccctaatcgctgaagcggtaaaaaaagattagatcttatttggactatagggctcgtataatatgtttgatatgtcattttaaagtttaattaattagataattaccttctagtttacaaatgtctagaacttcaataacatatctggttcatatgatgtcacaataaaatgccagtccgagtgattttctttctaaccgtcgtctaagccgtacatacgtaaaatactccatttgtttctaaatatttgacaccgttgactttttagcacatatttgaccgtttgtctttttcaaaaacttttgtgaaatatgtaaaactatatgtatacatataagtatatttaacaataaatcaaatgatagaaaaagaattaataattacttaaattttttaaataatactaatggttaaacgtatttaaaaaaatcgatggcgtcaaatatttagaaacggagggagtatatataagttagactcatgataatccaactctatacgttaatattgcaattttaaaaggtaaaatatactttttatgcaggactaattgactgtattgaaagatagttgatgcatttacgtagtagtacagtaacgttttatagaattcacattcgtttaattaaaacccaccgtttattaattagaaaatgtattaataaatggccgaaacctgatatttttggcaggcaggagcgcatttcgcagtattaccctcgggttttcttctggatccggaaacagcctccggctcgcaagtcttaaatgcgcacggacgtcgcttcccaccctcaccccacccttccccgcccattacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagagatgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcacgtacgttacacacatcctcctccacgtacgtacgtacgcgttgttgccgatgctaacaaagtccatattgtgattggtgttttctttggaatgcagtggggtggggttgctttggcatggggtttgggcggaaggcggaggacccggagccagggcgatgccggcgtacggacggcaagaagtggcggtgctccaaggaggcgtacccggactccaagtactgcgagaagcacatgcaccgtggcaagaaccgttcaagaaagcctgtggaaatgtccttggccacgccgccgccgccgtcctcctccgccacctccgccgcgtcgaacacctccgccggcgtcgcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatggtgcgtagagtactaaccttcgtctccactgatcagaaccgtttcttgattcttatggcgagccgtgctgacgatgatccaacttgcttcctgtttggtcttgtgcaatctgcagatgattaatctcttgaagaagccaagaagtgatcaacacgcggaagaaatcaacagcttctttcacggcgtgcgagctgcatgctgatgctccaggatcgatcgatcgatcattgcatctccaaactaatcacgcttcgatctttcaggacttcatcaatgacaggccgaaacctcctacgagttctctgatgatattcttatttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagacaagcgtgttcgcttttgtgaacgccctttttcttctttccgattcctctgcctgtgatagtactcgctccgaaaaaaaaaaaaaaagcaaaccgtggattcttgggtcaacgtgtccgttttatattgtccgttttatatgaaatttttttataattaaaatttctattgttgttagatgataaaacatgattaatatgtgacttattttttttatatattttttttaaataagacggacggtcgacacggttttttttttttttaagaaggagggagtaagtcacatctctggattctgctgaaaagctcactagcgccatcctgcttcagagaatactttatgctttctgacaagtcggtgtaggagtagtagtattgctaggtgtactccactcccctccttaagtacattaccagtgcaacgtaaaacagctttgctcctgagcaacggaaatgcttaataccgtactcttgcacttcgtcagttggttgagtacactgtgcaagtaccaaattggtcttcttaagtgttactactaggttgatcacttgttgaaccgtttaggctgtcgatcattagcattcagggttatcactgcaaagtcccaaacaaaaagattctcccagggtctattctcccctgaaccgttttcccattgaccggccaatgctgcaagaagctggatgcagagctaggagtagctgcagtgcccccactcctgcaccttcctgcagacactcagagagagggagagatggaggactgtgatgactgaccagcacccctgctttggtctccatggattcaatgccaactgcactgcaattgctgccggccccctgagacaatgtcaggcgctgtcagctctcgcgtccatgcgattgaatgatccattgctggcgtttggaccgtcgcctctcctcccctgcctcgcacacagtctgcagcgcatgcatgcatccatcatgtacagtgcagcattggacacaagcctctcctccttgcagctgcagccttcaaagcctgcacttgctgtctgccgcgagacggtgtctgccggccagcaccgtgacagtctccggctcaagtaccggtagctgtgccactgacgcgcgggggccacctgacttcgtccaaagcgtccacagcactactactggcactgcaccacagggattgccttccctgacacaagcctccacatggagtaattgttactgaagaaattcccagaaattacatgtcccgcgttacagctttcggttcatccaacagcagaaattaacctgagagagtgtttgggaattagtactaaactttagtttctcttctagagacttatgttttttagaaagaggctactcccagacaccccctcagttttcgtagtactggcacctgcctatatgtgctggttttcgacgcgtactctactaatctggagtttactccaaaacgaggaaaaactcagctgtcactgtatcatcttcatcaccgaatccagcggagcacgtactgtatgacgtatctgttctgacagcgaagttgaacaaatccacggcgcccagtattcccacgacagagcccacatgagcccgtctccagcacgtacgcgtacaataaaaaggctgtactactactctgtatacacatctgcggctctgcacccatctcgtcagcaaaacgaaacgcatgcatagagaggagaacgttcaaaaccattcattcatcaaccggaggatcagctgcacaagcaagccacagtgcagcatgcggtgaatcgcacgtggagaggctcaggtgaccccacgacttgcacggttttggctcgcaatatcgcgacgagacgaggccgtgacggcatgttattctgctcacactgtcttcgcctcccccactaccacgaccactcgcgtgttaagcccgcatgtgcttgcacctgatcccgtggcacgtactccctcggtcaaaaaaaaaaaaaagagaaagacaaacccagaccgtccgtcttatttaaaaaaattataaaaagaattaaaaagacaagtcacacataaaatattaatcatgttttatcatctaacaacaataaaaatacgaattataaaaaattttatataagacggatagtcaaagttggatacggaaaactaggatttgtcttttttttaggtggagggagtaatggagattttttttcccgttttggacgggttgttcagtcagtcatggctgggagaaaaggctgtggagatgagatttttagcagcggtgcacacatgcgtgcacgggcaacctagacagttgggattttactactgacaggaagaggttgaattaaactagtgtcgtcattcgcggcaactctgagttaggacagactgattgcccagattattcggtttttagtgtatcggcgagggcatctgacgccctcgggatatgaggccctgcaacgtggtggtcgcgggcgccggagttctctcccggttagtttacggagcaggaggaggtcggcgactacttctactacgctctcgttcagtttcagattcttaccgctgtatcgtggcgtttagtttaaaatccctcgcgcgtttggggtgaagggatccgatgtgttttttgcagggatgtggcctggttttccgtgtgtaggggagggagatgtcacggcgcgcgacagcatttctcgtgacagccgcttaactaaacgcctcaatctgagagctggtcgtcagggatcagcatctgtcaggaggccgcaaccagtggttcagctgcaagtgttaagaacagtaaatgatcagctggtggtggtagtagtgctgctgctgctacttgcagtccctgcagtgtcagctgaacgtcaggggacccttcaattcgctggaattgtactgcggtgacatcatacaaaccctggaccaaacgaaacaaaactaggaccttgatcacttgatgcggctcggcttggttggctactggatttaacccactctttgctttcgtccaccctcgatggccggtttccagttgagtaaacaatgtacagcttgtgttgttcacaccaaaattagaagtttggttgaaattggaacgatgtgatggaaaagttagaagtttgtgtgtgtagaaaagttttggcatgtttagttcacactaaacttcccccaaactctcaactttctatcacatcacatccaaaactttcctacttacataatcttctaactttttttccaaactaccaactttctccaaacttctccccaatttcagaaactaaacacagcctttgatgtaatgggaatgttgaaagttcgaagaattattttggaactaaacacggccacagtttcttcatagatttgttgttactactccaggagtactatcttttataccggtcaacgcacagcttacagcaaaatgcaatcccccccccctgctagtgaacagtgtctcatatcccatccaatgacccaaaacctgcacctgattgaactactcaatgaggctgtatttagtttctgaaattaggaaaaagtttagggaaagttggtagtttggaaaaaaaaaatagaagtttatgtgagtaggaaagttttggatgtgacgtgatgtgatgaaaagttggaagtttgggggaaatttgatgtgaactaaacatggccgcacaatgatagaagtgcaatgtgcaaaatggtaagcaatcagccaatcaccacaatactggaccgcgttatcactcatcggtgtcaaccgctgcggcaacgtgggccgaggcttcgaattcgccgcgccgcgtgacggcccatcagaatacgagatgggccggcccacccgcagcgaactcatccctgcccaggccagcccatccactctgggatattgtggccgtccgatgcgatcatgccaaatctatccaacggctggtgtatctgaagcgtgtcgatgtcttcctccgaaaggagcagcctccacatcaaccgcctctctcattaattagcggaccatttctaattcacccctcgcatcttttcgaattttcgagagctcaaagcctcgaaccattcccttcttcctcgtcccaatccaagttccaaccatccagggcgggggttttcccgttaatccgcgcctctccgtgtcggattgaattgaagcggagagggggaggaggaggtggaggtggaggtggaggagggcggcgggtggcgatggcgatggcgaggctgacgccgaacggcgtggcggcggcgctggcgggggacacgaacctgaagccggtgctgcagatcgtcgagctgcggggcgtccaggtcaacggcgcgggcgtcacgcgcggggagaggttccgggcggtggtctccgacggcaccgccgcgtcctccgcgctcttcgccgcgcagctcagcgaccacgcccgatccggcgccctccgacgcggcagcattgtgcagctcagcgagtacgtcatcaacgaagtcggccccagaaggttttgttgcctcctcctccactttcccccccattcccctgcctctgatcgatgtgtgattgcgtgcgatttttggcccgtttcgttttagggttcatgcttgcccctggttttatgtgtgtcagtctgcgtgtggtttagattcccgctttcagctagtttgcaatttaaattaatacttagtacttgccattctgttggtaaattgtcgatgagcttcatgtttcctactagatactagtagaggtgcatcaaaatttttctgacaatggttttgtttatgacatcatttgatcggtgcttgttaaccatttgtccaattgattttaattctgatttgaattattattgtcagaaagaggcctcggtattgcagtactaatcagtggtaactaaggctgtcctgtgacacaaattggtgtttgtcgatactcagtagttaattggctggcattagtattaacgattacaaaatagtgtgatatatgtgcttgggtagcctttggtgttcgccatttctggcaggtagcatgtcaaacgatgaaggtaatatggtcagtttgactactacacactttacagtgttgtctgatttagttcactaatttagttgtgtgcctttttttctctagccaacaaatcgccatgtttgggtgcatcgatttggccaatgtagttagatattgatcagcattaatgctgcaactgtctggtgctgtgaacagtttgggtctaagtactaagtattttttatcttttagctgtagccattcagttcaacacaacaccgtactaaatgcatttcttttgtatctggttcataagtaattggaagcatagttgtgtccattcaaatcatgttggcaaggcgacaaatgcaaaagtgaagataagtttctgaccaaaaggtgttgtaattaaacatagtattcatgtagcagtgtgaatcatcatattctgagccttttgcattcttattttcaactgatctactggttgatagagcagaatcaagaattgttttttgttggttgagctgacttgttgcaatacctgtaggattattgtcattctgaacctggaagttcttgtttcggagtgtgagataattgggaatcctacagcgctttcagaaactggatctcctatcccaaatccgacaagagtagagcaatttaacggagcacctcaatatggtttgatggcagggaactcatcaaatacaaccacaaagcctagtgacaatgttccattgttccaaaattcgatggcaggaaactcctctaactttgccactaggcccagtgacaaagttccggtcttccaaccaacagtccagccatcttatcgccctgcacctaattacaaaaaccatggagcaatcatgaaaaatgaagcccctgctagaataatccccatatctgctttaaatccttatcaaggccgctgggctatcaaggctagagttactgccaagggagatatccgccgataccataatgctaaaggtgatgggaaagtattctcttttgacttgcttgattctgatgggggagagatacgggtgacatgcttcaatgctcttcttgatcgattctatgaagttgtggaagttggtaaggtctatgtggtatcaagaggaaacttgagacctgcacagaagaactataaccatcttaacaatgagtgggagattttattggagaatggatcaactgtggatctttgtcctgatgagaacagttccattcccacccagcggtttgacttcagaccgatcaatgaaattgaggatgcccagaacaatgctatccttgacatcataggtgttgttacatcggtcaatccttgcaccacaatacagaggaaaaatggcatggaaactcagaaaagaactatgaacctgaaggatatgtctggtcgaagtgttgaggtaaccatgtggggtgacttttgcaacagagaaggctcacagcttcaaggaatggttgaacgtgggatctttcctgtgctggctgtcaaagcaggaaaagtgagtgatttcagtggcaagtctgtcggcacaatttcttcaactcagctcttcatcaaccctgattctgctgaagctcatagtctcaggcaatggtttgatagtggaggaagagatgcttctactcagtccatatccagagatatcacgcctggagcatcaaggaatgagatccgaaagacagtagcacagatcaaggatgaaggtcttggaatgggggacaaacctgactggattacggtgaaagccaccgttatattcttcaagaatgagtccttcttctacacagcttgccctaacatgattggcgacaggcagtgcaataagaaggtgacaaagagtactaatggcaattggacctgtgacaaatgcgatagggagtttgaagagtgcgactacaggtatctcctgcagtttcagattcaagatcactcgggaacagcttgggtgacagcattccaggaggctgggcaggagttgcttggctgctcggcaacagagctcaacgcacttaaggagcgcgaggaccctcggtttgcagacaccatgctcaattgcttgtttcaggaatatctgctcaggctgaaggtcaaagaagaatcatacggcgatgagcgcaaagtgaagaacaccgcggtcaaagtggagaaggttgatccttcgggtgaaagtaaatttctgctggatttgatctccaagtcctcggcgctacattagcagactgtgctactctatcagctgctcgctcgtgcgtggtgaggtgagcgaggtgaggtgttgcagtgcccatagccctcgccctcctgctcgatttttgtgccggtactttaatattaacgccacttaatagtttatatccagattagtgctttaatagtttatatccagattagtgctgatatttccatttttgtgccggtactttaatattaacgccacttaatgtatcagcttttatacctttttctcgatcaaatgattgccttctagctgcagtgcaatttctcccttagttttggtttgtacatgcctgcaaagccttactctgtcgcgactaagaaatctcttgtgctcttccatgcaatcgaacatctgttttacattcgcaaggctattaggacttgggttagatgcaaacaagcggatccagagaagaagttaatatccgtgcaaacgaaaaaggagcatttattctttcaataacaaggtgtttaaggtgactatgtcaatctcaaggtacgttagtcaaatctctcggagaacataggaagtgttcgtgtgtagaaaaaggagcaaacaatacatacgtcgactctttcttttgcacgagaacgcgagtcgcgatcacaactttgctatacaagtgtggtattcacagacgtccaaaagcgtacatcaatctcagtggtttccccctctatttgcatgcaacacgtggatcacaagaaacccgaaactttcccctgtacaaccgtagtgctctgccctgaaaacttgatcggcactctcacgtcgccagcttgagactgcatctcagccagtttttttactcgtagcagaatcgacactggtatcggtatggcagaaggattgctcttccgtggacaaacaccctgttcagtggcaaagagaaagttgggtaaataaatcaagatgcaaagcaaaggggaaaaaatgccagaacgtgagaaagtaggtcgaacagaacagcctgttcatcatacatcgttttcagtggaaagttgtgtctggctggccctgatcagattccgccatttgtcctgaataagcatcatgattcattagaagaaataaaatgcacgaacaaacctaggagttgaaaaggcaattgcaccttaagatccaccgaggtgcggtacgaatatgatgagaaggctagtcttctaatctcggaccatttgccagccccatatcgggccacaccatcgaccagcttcacaacctcacacaatgtccatgctcgatgatgcttccgcttcccaccccgctttgttttgggattgtcatcagagtcgcaaaaatccttgtcctgcagaccctgaacatccttttcacaagatgtttctacatgtactcctttcttcccagtgttcttctgctagcaagttgaagaaaaatattatataacacataatacagaagtagattacacagcattaagccattgaggtactatgtgtttcaaatatatttctagtcagtacttcattctgaagttggattttcactatattgtccaacatgaagaaacatcatactagtggaacttctatggctttgcttacatggttcttccgttcaccttccttttccaaattcactacatctgcagcaggggcctcagtacattccacagaaggctcaggatcctgatgcaataaaaaaaggattcaggtagctacattgagataattataccaaatctaatagcgtatgacacatgaaaatatggttttgtcctaaattattctgaattggtatatggtgcaatatggtacatcagatcaaatggaatattggcacaatgatgaggaaactatcaaataaagactacaatggcaaaatcagttaacaaaaagttcagagatttcccacatttaatttatgaaatatagcacacggtgtttgtaggaagtaccatgggcaaagagtgaaattgtgaaaaagaaaattaataatctgcttgattgaaaatgggcatgagtctttagttagttggcttccaagaacattttcccttagataagtttcttaggtcagatgcattctgagcaggaagcaatttacaggccaaaatgcgttaacataatgctttatggaaatccatattattttgataaatagagaaggtacttgcaatctcatatcaaaagaagaaattctaaaaaggagcagaaaaaggaagcatctaacataaaaagaggacatccctaaaatagttccaaaaatggagtaaccaaatatattgttggtcctgtatacttgtatagtaatcgaatatttgcgcaaatgtcacaatgataataaatggtagtcaaattgtccagagctggaagattatataatgcataggtagacaattaccaaaaatggaatgaagttactcctagggcgcccccttctcatccttgaaacataaggcacatgcacactacaccctccaagagtatcttctctagtaggataggctgtgctcaacgaatcaacctcatgcaaaggcgctatccgtggtctcaataacacctcatcatatacatgcctttttccaggtgaagaaagtctcccagtggattcatgagtgtcaatatctgagagctcctcaatgtatctttttgttggctttctaattctcttagtagttccttgttcggcaaaaatagttacttgtggttcatcattatctgttggtactcttttgagtctcttggacgatctctgttgctcctcactatgataggaaagacttgatggtaaatctctctcatgtccaggattcattacttggtccctaaccaaattagcctcaagttccatctttggtattgcttcaaccactggtatttcttgtttggcacccatggcaataactttataatccctaacaacacaacctgaacttggaacatcacatgaattgatcaaccccattgcaatccgtcttttgagccatagcttgtccttgacagtagtttgacgcccaaatgtggctctaaatgcttcctgaagttctctcattgtaagatcatccaagcagacttctccctttaaaatggaaaaatcaggaactgaactagtaaccccagaaacagattgtcctgcagatgcctcatttacaggtttcgagcaggcatcagccttttctttatcagaagaaaggtcatttaatactgttgattttgtagtctcagtcgaagcattgtcctgttgggcaatgatatttgccccttgttctgtatttagtttatccagctgctggtcatgaacagctgaacaatttgaaggaagaactatcgaatcattcaatgtacataacctgtcttcctgtgaaatgatatgcatctatttagtgttacatcaacttgaatatgtagattgaaagaagatgtatacaggtgcatgtttagtggatggttttaagggaagtgctcaaataaaaatagattgccctgggattgtatttcacacagatcaatctcttattaccacatctttcaatgatctacagtcagtcagatatgtctcaccgcatatcctgtgttcacttaaagaactcagcatcttctcattacattgaagctcatcccatagttttgatccatccatccatctctatgtcagttcttgatgacgataaaaatatgttcctaactagtactaaacaaagttgttacatacaaaagtggaatttgttgagaccgcatacaattgaactttgaactgctaattagacaaaaaagaactaatccatatttttaccatgccagaattagcttgaaaaaaatgaccacagaggtacctaagaacaaactaaacctattatctaatagaattaacatactatctggtcataaaatgcttatactcaatcgaagatacttcacttcgattagtgagggtattgaatgaaacagaaaataggtttagtgaatcatgttcatgatgcacaatggataagcaatatacctcataggtttagtgaatcatgttcatgatgcacaatggataagcaatatacctctaagccagcatctaacttttgtgtctgtacatctgcagtgtctaatttggaaggcccctctgtgaaaatatagtaataagtcaacatctcaagtaatcaaaccaatcgaatcaattcattaatcatgctagcttgcaaactacaatttatcctcacatggcatgatattcagttatcgatctaaggaagtatgatcacccaaacagaaatgacaataaagtagaaattgagatagaataatatttctgagggcaccttcaaactcaggcttcttcactatgcaatcattagtaaaatattcctccacatgtgttacatcgtcaatagaaggcagatcatcatcaaccttctcatcatgaaggaaagtttcaaactgtaagacctcatcctccgtagcaggaataagtgttccatcaccttcaacctgaacattttattttaaagaaaatgtgtttctcaaagaactgactaaacaattggaaccaattatgtatattagtgtatagccaatagaccctatgatgagaacttacccgaactaactggtaaacaacaggatcagaattgtcattcttatcaaagtcattatcatcacttctgttgtccagagcatcttgtggaccacccacctccatagatcagtacaagcttcatccaatacccttactaatcgaagtctaccaaggtgaaattctacagtcagctaataagtttaggattaagattaagtcaattaagtaattcagcaatcctggagagtagagagaacaaatataaagaacatttgcaaggatttatgactaaacaaaaggattcaggtaattgttggacagactattgcgatatgatccacgctatctttaggcaccactctttttcccctattacaaaatgagcaaatccatgtgtggtgggaatgacaaaagcgatcacacaccatagtgagatcctcaaaatcccaccaaaaactactgaactggcagacaggggcggatccaacttgggacatgggggaacaaacaaactgtttcttgtattaaggttaaggctctgaaatcaatagaagaagcttcttccagatctagaagagaaactagggttaacgcaagcaaattccagacaaaagtactcccggtgggagagagatgaaccagaaagaggatgtggatgctcaccaggatcccctccccctgctctgcgcgccagacggagatcggcgcccctcccctgttcagccgcgagatggcgcaaggagcggaggagacgagacgggggattttcttttacgcgaagggaagggggagatacggagatactcgagctgctccactctatctcagtttttttactttaaaactgcacttaaagtttgagatggataatcttgtgctacttcataatatgatatttcgaaatttttgttcaattttgaacactttttgttccatggataattgcgtgagttaattaaaaaaattatacagtgataatggagtctaactagagggcgatggtatattatactccctccgtcctaaattataggcgtcctccttttaagaaaaatcaagctcagtaacttttaactaacaatcatactaaatatatatacgctaagtattatacatgttacttcctccgtttcacaatgtaagtcattctatcattgcccacattcatatagatattaatgaatctaggcacatatatatgtctagattcattaacatcaatatgaatgtgggaaatgctagaatgacttacattgtaaaacggatgaagtatatcactagatttatattttaaagtagtttcatgtgatgctaattttatattcgttggcaacaaaatatagagtaaattaatggttagagtatgtcagtaaagaccatgtaagaaaaatacatgccttataatttgagacggatggaatagaagttaagcaaaatacgatatcatattatataacgagtcaaaatcagtgacacaatgaattctctttgaaaaataatatagtcgaatcgttttttttattttagtcataatagaacttttttttacctaaacatgattgggggactttgagagaagataggaagaggggataatgtcactagccaaaacacatggggggaggggaagttgcttacatccatggtatgttttgataatatactattattattaattttgttcttcactgtaatacgatgtaaaactaaaaaattaacatatattactatttcattattcacttttcttcttattttctcgatcttttttattttcaatgacaatattgctagaggtccgcggagccgataaccatgtgggggtatttcaatgaagctaattttgcatagtagatattgctaactattatctataaacttagtcaaatttgttt

SEQ ID NO: 72613 - DNA, 48176 bp, Oryza sativa
  unsure (1)..(48176): unsure at all n locations
acatatggtaatgcatcgatcaatctgatggttttgcaaagatcacacaaccttaccactgacaattccaaattaacatgtgacagttcatttaacgacaagcccattagggagacagtagctgggccactgggtaaagaactgtttgagaaagaacaagaagacctgctctccgacctgaatgacattccaaagaaagcctgtgaccgtcgagtgagaagctcatcatcatcatcatcagaaacaccttttcttgcaagattacatatatatgctcactcatgctaaccattcattctgtcactgaaaaactgtttggtgttttcagatcaacgaattcgtgaagcgttcgaggtcagccaaggtccatgctcacataatcagccacctgaagaaggagatgccggcgctgatgggcaaggccaaggcgcagcagcggctgctcgacaccctcgacgagcagttcgccaaggttcagaaggagctgcacttgccggccggcgacttccccagcgtggatgagtacagggagacactgagcgcctacaacttcgacaagttcgagaggctgaagcccaagctggtgcagggcgtcgacgacatgctcgcctacgacatccccgatctcctcaagagcttcaggaacccctacgaatgaatgagcaagcagcagcagtcagagaaggcgtgttcgaccacaatacaagcatggatctttcttgttcacaaaaaaagaatgtgatccgtgaatcgtcaatccatctcttttgtgctccacgaaggcgcgatatatggctttttgttggcgattttcttcagtcttctgcagtgatctctgaagaaggcagtgtgacaggaatgtgcaaagtgaagccgattggaaagtttggaacagcgttaaactgggcttgggcttgcgagatcagaatttgcaatgtgctcggcccatgagaccaggtgtgtgtggggtacagcagcacgagtcgcatatgtaatgtacgggcgtgttgcgatgcgacacggttgctcggggaagaccgagaagagccgtgaggaggaccgtttacgtggtcgtaggtcgtagcatggactcgcgttcgccgtcgcgaccgatacggcgccacacacgcgcggtcgcaccgcacccaacccccgattggaccggagggaggagagagcaagtgcacgactgcaagagattcccgtacaccacccgtcagattcccccgtctcctcggctaaagagttcgcacccaccaaaccaaacaccacacgacgcgctcctccctctcgctgctgctgctgcggagaacgaaggagagaggaggacgagctgcgcgggcgccatccagcagcggctgcgaacagcaacgtcgtagccgacgggagcccgccacctacccgcaccaacccgtccccgaggttggcttttggtcgagcagttggtgggcacctaacccggcgaactccggctgaagtaagtgcgagtgagtagtagtagttgggggtgaggaggatgaagaagttgtaccaggggaagggacggagggtgcacccggcgccggcgcagcaggcgcaggcggatgctgctgcggcggcagcggttgtgctgccggccgctgtgctggccctggcgtcggcgctcacggcggaggagcaggaggtgctcgcctacctgctgtctggaggtggggcggccgggggacgccgccgccgccgcggggctcacccgccggagatggggtgcgggtgcttcggctgctacaagagcttctgggcgcgttgggacgcgtcccccaaccgccacgtcatccaccgcatcatcgacgccgtggaggaggcagcggcggcggcggagctggcccgccgcgccgccctccccgccgccgccgcggcggcaaacgcggaggcggcgactgcgaggaggatgcaagtgccaccaaggaggcggatgccagcgtggaacaccaccaccacgcctgtggcttcgatggcgaggaggacggcgactacgagggcgatggcgacgacgaggaggaggaggaagagggcgacagcatggacggcgatgcggacgacgagacgacgttgagcgagggcgattgcagcagcagcagcagcagcaacgccgagaagagcacggtggggaggctggtgcgcttcatcggggagaaggtgtggggagcttggaactgagctcctcctcctcctgcagctgctgctccccatgttcttgtagattaggagaaggaagaagacgaccaagaaggtcaggtcaaggtcagtatcagtagttgttttgatcaagagcacctcagctctatgctccttttgctgttctttcttttgatttcttgcactctgatgagcactgaggtttggagggaaaatcaagatggtgtagtgtaatccaatccaaattacagttcttcccttcaatcaacctcactgtaccatatttttgctcctttggttcaacaatgaacttcttttgcaagagaacaatatcatttccatttcttctccttgtaatttaggagtagctgtttttgcattgacttcatggtactagcatagcatctggttctgatggctgcatcatgtgtatggatggaactgttgagtgattcctactgcaatggagaggaatgtttttagttaattaaacttttgtaaagcttgagtgggcaagaaatcctcttttatgggatatctgcaaatggaggcagtatcaagttatgcttgcctggttgtacattcctcctctattaaggaaaagcatatgtgcaaagccaattgttttttccatgatcgttaagcgtgttccatgcactagttggggttcatctccctgaataatggaatcacagcagcatccttgatgtagtcaattctaacagttccacaggcagtgtaatagtatctgctaagcaacatgttttcaccatctttttgaagcaaggcttgatcacaatcttgaatgtggtaaaagaacagcaaatttgaccaacatgtcttcagcatctttttgaaagaaggcaatgttgttgtcacaattgtaaatgtggtaaaggaacatcaaatttggttcagactccttcatggataagtaatcaagtactgcagtggtgttagtccctccttcccaaacaccacctgggtttttttccagccaaaaaaaggcatgttttttcatgttaaattttttacttctcctttttgaattttagtacatttgtaccctttttcttttcagctaccctgttggacggctcgaaaaagaagcattagagctttcctcttgcactgcactggtactcttgaaaagaatgtgaatagaaattagtgctacttgcaatgtgcaaattgcaaaacgaaagttagccgtgaacgagctatagttttcacccaaggacgtgtactccacaaaatttgttagtatttcctttagtacaatcagtgcaaagctttattgaactttaatactccttgccaccactgctgagattttacgacttctttagttcttcctccatctcatcagtgacacattgatgtgctactattaagcacaagctgagtaccaaatgcaaagggagcccgtgtttagatccaaagtttggatccaaacttcagtccttttctatcacatcaacctgtcatacacacataatttttcagtcacaatcatctctaattttaactaaaatccaaactttgcgctgaataaacacagcctgactgtcactgttatcgtagtactacagtacgagatgaaggacaggaagcaggttgctgacaatttatgggctctgcactgcacctctctctgtagagagatcaacaagctgcagcacggagaggcagaggcagaggccggttggaaaaagaaacgagacgtacaagaagaaatgctgcatttgatggctactactgatgttttcgatcggcagtttggcaggcgggcgctgctctgcgaagatgcaaaggcaaaaagaaaacgagagccatgacgacgccgcagtgcggatgcagaggcaggggacccttgtatgacggaggcatcagtatacctcctccattattgggctccatttgctcctgcgagatttgatctcaaattcgatttcgattttggaggatggttatcatagctcattcaattttggagtagcttgaattgaattctcccgtcctaaatgtcattcaattttgggggagtacgtctgcactgcaagtgtgtgtgggccaaactcgggttaaatnttgatcggtcgctctcactctcgttcagcacagtcgccagcgacagggacagtgcgctccgtggagaggccaatggtcagcggcgccggagccctgaattgcagtcagcagcatatgcgtccatcattttcaaacgcactgtttcctatgaatttcttacgaaaatcttctcaaattaggccccgtgagttgtatgcagtgtttgaaatttcggaaatttcgcccccaccgaaatgctaacatctcgcccgaaaatttcggttttttgtaattttttggtgaatttgatcaaattttattcagatttatacaaaatccgtcaaaattcaaaaaatttcgtacgattttttttctgaaatttcggttctattgctcagctgcggcagaaatgctgatttcaaaatttaaaaccctggttgtatgaaaaacacaaaaattttagaggattttagttctaaaaaaatcctacaaagatatttgaaataaaagattgaattcttattttccttaaaaaaattttatgaaatggacaatgctatacaaatttcgaagaaaagttaacgagagcttaaaactttctgaaaagttgagtttatctctctcagccaattcatatctttttcttgctatctaactaaacaatcatgttttacagtactccgtaatttttctatcaacatttcatgtttttttttctattcatgtggtttatttaatcttttttttgcggggatggtttatttaatcttatgttttaaacaaagaagactaaagtacatctaaacctccaaaaatgttcgtcttgttggattgcagcaggaagcatttttgcctaggatacgaaggtggtctcgacgacgaggatgcgttcttggctgtacctgactagcactacatacatactccaaaattatggagtatcatacagtttgtagagtaaagtagaggcggtgaagatgagacaaaggggagcggtggggaggcgaggtgagatggtggcggtgagcacaaggagcgggaatggcgacttgggcttttgtacgcgttggtattgtcgaaaggggaggcttgctgaccggttgggagaacgcgtcgccgtcgtggtggtcgcgtttttctactgcaacatatagcgtcctccccgtcgcctgttccccgtgctgccgttgccgttctcgtcctccgatgcttcttctcgtttaagattttcttccctaaatcgcaataggttgggggtacaaaaatatcgttagctggtggaacggttggcctaattgggcgtcagcttggatctcgagagacatttgatacatgctgttctggaaggaaggattgatctagagacgaacacccatcgtttcgtttattcgcggaataagacaaacgacatatttacaaataaaaagtaatttgtgaaaattttttttatatacatgcttttagtgatctaaaagtaaaggctgaaaaataaacatcgatgaaaaaaatctcaaaatcaactttaagtttaaagttgaaaatttaaaatttagctgataagtataggcataagcgaaaagataaggcccgaagtgtgcttagctcaatttatcgggtctcttgcagtaaaacttgaattattctagtatttatatgtactacatgttaattttgcaagttgtgtatacgtatttctaatgcaacttgggcagaattgcattttattccaaacaaactgggggcccgaaatacattttattccaaacggtaatgacttaagttattccgaaattctttaagtagacatctacgatcaggccaaataggtcaagcggagtagactacgaattttcatgtacgtataacatcctctgttttgaaagctaaagttcgaaaaaggcactattcgttcaccactcttcacaaaatcattggcagcagcagcaaagtcaagtgtctcgcgatcacacatcgctgaaatggtcagtggtctgcacacggaaacgatcaacttgacattggggtttaaaagtgatgacaagtttaaaacctccgaaaggaacacgacagttcagtcacttaagtttgaatttgtgcattaaaactttgaaattgacatcgttgaggaacataacacatgacagaccaaatgcttgcttgccaaccaaacaacagtcctgtagtcatcctcctatgcatccaccgccagcctatgagtctcttccactcaaagtcaaaggacagtagtgcatatcttttttccttgcatttggccctgtttagattccaacttttttcttcaacttttaacttttccgtcacatcgttctaatttcttcaaactttcaattttggcgtggtactaaacacaggccgagtttagttctaaaatttttcttcaaacttccaacttttccatcacatcaaaactttcccacacacacaaatttccaacttttccgtcacatcgttccaatttcaaccaaacttccaattttagcatgaactaaagacacccacagcctatgtcctgtctcacaaagtgtggcaatgcattcaatttgagagtttagaattgaactaaatagggaaggcaaaagggatgttctgtctcacaaagtgtggcaacgtattcaatttgagagtttagaattgaactataggaaaagcaaaagggaccggaatgttggacacttggacagttaactggaacacggggtatttattcaatactttgtcactatatagtaaattctaaggtgcagttggtcatgccaggaacatacaaactccagcgattgtacatgtgcggctatggccgttacgagtcaaatatctgttgacacattgatcaatcccaaataaaaacttccaaatgagtgtccgtaaaggtcaacatattctcaccaaattttatgtaccacagagtgacggcaggccaaagcaatgttaattttccttctcctgagaggcctttagatgattcttgatccaagactcaagagaatatagctcttccttggaaatcgagtgaccaagacctggatatgcctgattaaacaaacacagatgataacttgatacaattagaaccagcttgtaaatcaaaggtcctcttatgtgcaagaaaaaaagaagatacataattaccttaaattcacaactgaaaccagcattttgcaaaaaaggtggaccagcttgaccagcttcaaacaatactacattgtcagctattccatgtgaccacagaattggagtctgaaaagttgaaaacagacccaaaaaaagaatctaagcttaataaatcatacatataaatagttaatttcacatcaaatttctatccatacagagaagggttgacctaacatttatgaaagtcaaagttatcattcacacatttatggaagttcaattacaatggaataaacactactaaatttgcagcggcattctggtctgcaatcaggattcaaccctcagtcacctccgccctacttatggggcagctacaacctccggcgatcattctggtcgtcgagtatcgagccttcaacctgctttgcttctggcgcctttggaaccatcgtcacgatgtggtcttccgaggggaagcgccgtcaattcaacaactcctacgctgatgcgtagaggatgcaactttgagggcggaaataatgaactatagagaacaccctgtagcgacacagtggaaacactgcttctcttctgctctctccctgatgtaatgctggatcctttttatcaccctttacctcccactttgtccatctaaatgaaaatttaggtggggaaaatcccccccccccccccgggtgaacattaaaaaaaaaaagatccagcgttggttcatttcatcctaccctaccaccgaagcactaaggtgaaggtaagctcttatttctagtgaatttgattatactgacacccaactgacatacaattgatatgcaagtttgggccacagtagatctttacattcatttgatatcattcaggtaagtcagatctttacattcaaccagtttgacagaattgctaccgtttagtacatccatatttcttaagtttgctcaatgacaactgaacagtgttgatcagtaactgctgcgatagacagcacatggatttttccaaatgaatctgcaacccaacttgtgtttatgagatatatttaattcagagacaaatcctgggtatgaatttatgatcatatcaatgcaggcatatattccagaagcgattgaactaaactgctcgcttgcaccttatgaaacttcattaaactaaacttgatgaataaagcgattgattgcataccttccttgcttcaggtgaaatcctctcagtaactgacgaaccaaaaggcagccacccactgaacactgcgccaccacctagagtcttgggataaagcaaaacacttgctaatgtgagagcacctgccaacgaacatgcactccaatacttagttcacagtacaaaatttcttaccacttcagaaacttacaatgcaaagcactagtcctacctccttgactgaatccacaaacaaatatgttctctggagggatgccatcagctacctccttatcaatcatggcgtgcacattttcaacagccttaagaaccccactgtcatcttgtggagaaccctactcgttgaagatttgaacaagatcaatacctactggtacagtaaattatcagcttagataagtggaatcagtgaactcacagagctcatgggtagctcgtggatgtcgaaccatgaaggcatcacagcgccatctgcaaggaggaagaaaatctcgttactgaatcaggagcaaatccgaagcagagaagacgagatggcgcgggggggcaacgaggcgtacggttgcaggagacgggggagttcggggcggaggggaacgcccacttggtgaggcggaactccggcgcggagaagaagttgcggatgggctcgttggccgggccggagtcgccgagtccgtgcagccacagcacgaagctccggttgcgggccgccgccgccgccatgggcgcggggacgaggcgggcggcgaggccggagggcggcgcgcggcggcggagggcggcggcgaggagggaggctgcggcgatggcggcggcgagggagaagaggaagcggaggcggctactcattgggtcatgggccgaagtcaactgggccgtgacgcgtcactcagcttggtcggtgcgacaggctatgagccggtatggtagttgaccaaactgcaattggtgggattaaaaaggtttgaactgtttttgggggtttgattttgtaagttttgccaaattgtatgtgttgattgaaggatcgaatgaatcgcaatgcaaattctaagatggaatggcagaaattgcaaggatcataaacctttatcagatcataattccacaacataaaaaggcatttcgcagtacatcaaatgtagcaccaatgtaccaacaatgaatggtagccataaattggactagaatatccacatcaagaacaagaaggagctataaaaattggggcctaggattcctgccctttggttctaaaaaaacaagcagctactggagatccatcttgtcagataaggatggcactggaactccagttccttgagataaacgatccttgatccattgtcgaaaatactggagctcttcatccaccaatgtatgcccaagtgcaggataagcctggtcatttttattagtgaaagaaaaacagaacattgtagtcagcaaacagacagattcttcagaaaaactgttattttgtcaaatatgcttcattaccaccttgaattcgcagtgcatgccaatttcttgtaaaaatgcacacccagcatgcccagcttcaaacagtaccaccccgtcagccatgccatgaaaccacaaaactggtgtctgcaaattttgaagattcagtatgaagacaaacaaatcaacccatttgcaggaggatgtgatcaccaaatgctcgttgcaaatatatctgcagctctgttacctttctagcttcagatggtatactctcagcaaatgttttgcttagaggaagtgatccactgaacacaacacagccacctaaagtcattgggtagagtagaacacttgctatggctagagcacctgtgaaaaggcaattaaaatcatagtcttgtgagtcctaactaatgccattaccagaagcatgcagattactacctccttggcttaacccacaaacgaatatatttgaaggactcgtcccagcagctacttctccgtctaacatttcgtgcacacgctccacagctttgagcacttccttttcatctctggcagttctctaagaaggacaaaagaatgttgttacttttgaaccaataaacgatgccatgctagcaagagaagtcagtattcaccaagcacaagtattttctttttgaatgaagttgaacagcattttggaattttaatagttaggagtacgaattacagcagtaataggaacttccgggatggcgaaccaagccgtgatcacctcgccacctacagcaatggtggaaacagacattcagatatgttcctgtttctctctgaaattttttatgcgccttggatttggaacagattttgtgtatatataaaagtttggttttgggtaccgtagcaagggatggaggaggtgggcgcggtggggaaggagaagcggacggaggcgagctccggcgcggcgaagtatggggcgacctgggcgcggctctcctcgcccgtctggccggagccgtgcagccacagcacgcgcccgtacccgcccgccgccgccatgcccatgcggccggcggggttcagcgtcagcgatcgatcggggcagcgaaggagctaggccgcggggggaatcgcctcgtgggcaacggagacgcgaaacggaggccggtcaggtcggatcacaccttgggcgtgcgctttgcgccgtccgcctccatcctcatcctgccgtgcccgtgccgtgtagcgtccgaactgtcgcctccgtcctaggcgagctgcgctgctgccgatgcgacgagagagcgcgcggcgtgggtggccccgtccccgcctgtcgccgtccgcccaggcctaggcctagcgcttcgtccgctcgtgcgggccttctacgaattcaccagttttgggcctgggccccttttgcacgcaagcgggatgtcctagaccgaaagtattactccctccgtcccaaaatatggcagtctcatatccagattcgtatttctaaatgggtctcatcctactacattttgaaacgtaggtagtaatagtgtgaaagtttttagattttaaattggaagttttaaagctacagttaaaaattccacatgatttgaactgaaagtctcgtatagaagttttattagaaggaaaatagtgtgatcaaacaacgcacgtgtacccatctcctgagaaagaatacatttaggacttttttgtaagcttaggtttttaagttagtttttttttctttatataatttataagccagtaaatttaaagttctaaatttaaatttaaattcactagcttataaatcacacatgccctaaaaaaacttcttttaacctagtttttaacttaacggtgtaagagtgtcttatagctttagaaaagtcaaacgaagaaacttatttgtttaggtttagatttttcgacgcttataagtctaaacaaacggagccgtagaaacaaacgggttgctcgaggccttgagttgtgttttgaagctgcaattcgtacttcagtactttgatgtacttgtgtcttgtggtttctcttcttaggaactgttgaagaggttactgcacaagaagatgttccttgagactctacggatcaggccttctcttccactcctgtgcaaaattttctcaacccaccgctgacagtaatccaattcgtagtattccaaagaatgcccaagcctgtcgtatacctacgcacatacacggcaacaagtgagagaaacgtttatatcgaattctgaaatgttaaatcagcaagctactagtagcggagcacataacgaacagttgcaaatgtgtatgattaccttgaactcgcaactcatgccaagtcctcgcagaaatttaattccatctctgccttccttgattgggattagagagcctgcttgcccatggatccacaaaacgggtgtctgcaagccacattgtagctgtagcatgattatttaccattgcagtcatgcatgagctggtcattagctctagctcttcttttccgttaaaatactacgagcattattggttgccctaataaatcaaaattaaagccaaatttaaatttttgaactttattttaaaattattttttaacgtagtttttttttcagcattagcttttaaaccgctaagaaacacatacatatataagctttatctataaattagttttttattctttaataagtcattttggcttattaagcaatatgagcaacgatgtgatcctaccattaccttctttgcttgtgcagtaactctgacagcaaaagaggaattgaagggaaggaagccactgaagaccgcacatccgcctaatgttttcgggtgaagcagcacgcttgctatgcccaatgcacctaaaatgtgcagatgtttagttatcaaactttcttcagatgaacatatattaatcgtcgtatgacaatgttagttctacctccttggctaagtccaaaaacgaatacgtcttgtggattcgtcccggctgcgatctctctgtcgatcatcgcgtgcacgctttggacagctctcagtacatcctcctcgtcccttacagatacctgcacacatccagactcaagtgaacatcacaattgttccttttctggcttctgcaagcatggcataaacaggggaattttcgttgtggcagagatatctaacggaagtgatgggcgcgtcgtggatgtcgaaccacgagggcatgagcatgccgcctgagaagaaacggagatggagagagtgcatcagtccagcgacgaacacataacaaaaattaccaagatccgatatatataattatctaattattaactaatatacttattaatatgtttattagttagaatcgaataatcgaacgtagaatcgccaatgaatcaagaggaccaattgattggtggaggggttgcgattcacgtacggttgcaagtgaccggagcggtgggcgcggtggggaaggcccagcgggcgtcggcgaaggcggccgtggtggggaagctgtcggcgaggaactcgttggcgcggccggtgtcgccgaggccgtgcagccacaccacgaagcggctgcgcggcgcccggctcgtcgcgggctccatccgaccatccgagattccggaggaggagaagagcgcgaggcgatcggtcgattattgtggctgatgagttgacatccattcttccatcggtttctgacttcccgtggctgttgactgatgatgagacatgagagcggcttgactttgatggcctgtacaatttcatatatcaagcttccccatccaactcgcaaattgtgccaacaaaacaactcctgcggtcctgcctggtttatgttaagatggaaaagaagagtgaaaaggtacagctgaaattactgaacctccaaccataacttgtacaagctgtaagtaatcaggtctaagggtgtgtttgagaaggaggggattgaagagatacgtaaaacgaggtgagccattaacacatgattaattgagtattaattattttaaacttcaaaaatggattaatatgattatttaaagcaactttcatatagaaattttttgcaaaaaaacacatcgtttagtagttcgggaagcatgcacgcggaaaacaaaactatctttctctctttctcctgcgcttgaacgcagcctaagtgatgaaaaggaacaaaagggggactacatctctttgaaataaaacaacaacaatctatttgccgaaaactatcaactttatttgtaataacacactcgtccatatccatggacaaacgtttgtgctgaacttccattattcagctcataaactaagaagcccggaagctggtggaaggcttagccaagtggtgaaaaaaaacatcgatcttgcagagtgcacacacttttcatgatccaaagtactaaaagcacaaataactggccaattctgctttgtaataggcacagataatcgcttatggtaaacagatgaaaacttttgtctcctcaatcagaaaggtcgtgtagatggttggcattatcagtcccgatcaaacgattgtacatgcacaatcacttgcccgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcttgaggatcatgcacaaggcatcggaatacagataaaaaatttgaaaatggtgtttaaatgtgattttaagttctttacacttagcttctcacaacataatatcctgaattgcctcaattcaaccatttatgacggttttcagtcatactttatgcttgtcaaaggtggtcttctggaacatctcttttaggacaccacatactgacatacatttatgaaaaagaagtgctgcatcaaaattgacatcggaaacctctacttttggcctaaattagcgtgcctttgagttccttacagttaaaaagggcaggtctagtatatcttcatagtctagacgtaaataagattcaacaaattaacttagtagtatagactatataattgtactgtttaatattagagtatatggtagttagagtcatattaggatatgattgatttatgtggattttttccatatctgtaatccttccttatctcatgtatctatatactggcccctgaggctctaataccatgttaaatataatacttccttatctctaccctatttatttcctatatatgcgggctcctaaggctcaatagaatgtgtccaatattcgcagtaatctcctcttcctatactattcaacatttatttacctgatcatttttgctgaaccaaatccaagactgtcatgaaataggcttgtcatgtacttcttctgtgcaaggcacaaaagctctgagctgttgtatatagggggcaggtatgcttccccattcccatctttgtgtttattccataattcgacaaacttcttgtggaacaaattccatgaatcttcaattgtcttcaagatccatttcttgtaagcctgaaaaatatgtacagtcatataacttattttatgccccgtgatacatcatgaaaataccttctaaaatctagatgctgccattgcactttgccatataacttgtcatttctgcagttcccattactcagggacattcaagtgatgagtaaggcaagttattcaacttattgtctgccgagcaccctcctccctctgttacatacggcatatctcaacaatatcaattgctaattattctataggatacaagtacacaggaagacatgtggttgccattatcttagcaaacgcaaaacaacttaaccacccaaaaagaaaaactatctttttgtcacataaaaaaaaaagaggacatttgtggaccaggtaaaagtacacactttcatttactattattagccaataaatccatacataccttacgatcatttgcttgatcagcgtgtccatcttgtgaaaaatatgccaaaatcaagttccccaggaaggccccaatgtcgtaacccattgggccatagaaagcaaattctggatcaatcacttgagtagaatctggtgtcaccatgatggaaccagtgtggagatctccatgaagaagagcctgtgctctctcaataaacctgcatatgcaaatcatgtccatcatctccaatatgaaaagaaaagaaaagcgctggtttaatctggaaagatagttacattgatttcaattcagcaatctccaatttaagctcagcatcctctcgaaccgctgcagcatcattatctaggaagggtgatgtgcaacgattgtatttggcgagcatgtatgggtctgagaacacgacttgctctgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagttgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtacatgtgtggcggcggcggcgcgtggaggagatagggacctgcttgatgacgacggagccggcgtcggagaggacgatgtagacgaagttgaggttgccgtcgccgacctccttgatggtgagggcgtcgaggctgccgccgaggcgcgcggcgagggcgggcgtggccttgatgtaggccaccagggacgcctcgtcgagcgggcggaagccctgctgctgctgctgctgctgctgctccgccgccgcggccatggccggtgcgtgtgtggccgtggcgtcgagttgaccgatgcgagcgccggcggcgaagtggccgcgacccgcgagaggagtggggaatcgagtgcgcgtgtgtgggaggctgcgctgcgcggaggtgtgtgggttttgtaacagctgctgctttcgcggaagggggcggttctctgaacctggacttgttattggtacaaggcggattcttcagttgagtcgtgtcatcagtgtgagctaatcttgaggagttcatgctatctttgagttttcaatccaggccgtgtttagattcaaaattttttaaattttttttaactttttcatcacatcaaatatttagacacatatatagaggattaaatatgatgaaaaaaaacaattgcacagtttgtatgtaaatcgcgagacgaatcttttgagcctaattacaccatgatttgacaatgggatgctacagtaaatatttgctaataacggattaattaggcttaataaatttgtctcgcagtttacaggcggaatctgtaatttgttttgttattagtctacgtttaatacttcaaatatgtgtctgtatccttaaaaaaattggcacacaaactaaacacatcctagtatactgctaattttgaactgaatgtggcttctggtcattggatttggtgaattttcctctctgttccaaaatataccatcatttatgttatctctatattaccactccatctgtttcatattgtaaaaattttctacaattgaccattgttaatgaatctagacataacatccatataaatatgggtaatgctagaaaattttataatatgaaacggagaaagtattaaagttgagtcatcctccgttcatctccttctcccaccgctcgtgcagtctatttgtccgctccttctcaaatcatgtacacaacctccgtatgatacggtactttatcctcaattaccttcctagccctttcttactcgtctcaattgtatgttcgatctgttataatgcatgaatatatgttgctaataaatctgaataagtgtttgttcacttatagcagtattttaggacggatgaaataaataaaattgttttctcgaaaaaataaaaaaaaactaatgaatctttcactcatgcttcaggctaccaatggtggtgtgccttcggttgaagttggaattttctagcaaatcaaccataatcgaaatgttctcatatagatatatagaaacatgccatgcctacataatttttctgaaaaaaacagctctaagataaggaccatatattcatttgatagaatgaaacggttactatgttcgtttgtgtgtttattagaaaaagaaatttattgtgatattttagaggattacaattcacaattattgtgtcccttcaatgaactctgcgagttgataaggtagcatccgaacgattaatcagttggtacgcatgttccacgctgttcttttcaacaaacagggagaatatatcgactgtgtttggccccatacttcggcttgatgtcgccgtcaatgctagcatcatgtatcttcaaaatgacatcatatccaaataaaagcagcatgaaagtgccagtcctccatattaaacggcatgaaactagctcacaagacaaaaatcattatagtattctcatgaccaagcgaaccatagtgagaaagttgacaaactctattatattcaccggatgaactagaatgttcaaagtatagataggtcttttggagaacttctagcatgtacagtttcttccaaaatctccaattccctaaataatcatattatgagattttatagctatagaatccagaaaaaaatgtgtaaagtacacgggcggtccttaaacttatagcggtgtgtcatctaggtcattaaactctcaaaatgcatatccaagtcacagaacttgtcatagtgtgtcatctaggtcccagatcaccacaaatccttcaggatcctacgtggtgcggatgtggcatgtcacacgaacatgatgtggcataattttgactgacaaataggacccatttaaaaattttatttctttcttttttttcttctcttgcattttcctttcttctcctttgtctgtgacccgagcaaaagagaggggaaaaaaacaagaataagaagaaaacagaaaagaaaaagaaaagaagaaaaaaaaggacatgtcacgtccatgtggcaggtcacatcagcgccacgtaggatccaagaggggatgtgtcgatttgggacctagatgatacactttgataagttctagggcctggatatgcattttgagagtttgggggatctagatgacataccgctacaagtttaagtaccgctcgtacactttactcgaaaaaaaatctacgaggaagctaaggaaaacctactttgtagattaaattctgagaaatggaaatctagttgtgagagcataaaaaagcagggaaaaccagttttttagcttttattaagattcttttgaatctagataaaaagttaaattgtttggggaagcttttgccattcaaccgactgattcttacaaacttagccaagtggtgaaaaaaaaacatcaatcttgcagagcgtccacacttgagcatgcataatgtatagtagaactagtccataaagaatacaatatttcattcagccacctaacaacattgtagaactagtccatatcaagcaaatagcaaaagtcacccataaacatatgagttgcctatatagaataaaatatattatttatctctgctttctctctccttctaatactactaactacctatatatattacatccttcgtttcacaatgtaagtcattctagcatttcccacattcatattgatgtccatgaatctagatagatatatatgtctagattcattgacatcaatatgaatgtggaaaatgctagaatgacttacattgtgaaacggagggagtatgaaggttacaataggtaaatcccacatatgtgggtccatctgtatggactactttggctatatacattgttgttgcccagcccacatataaccggccaattctgctttataataggcacagataatcgctgatggtaaacagatgaaaacttttgtctcctcaatcagaaaggttgtgtagatggttagccttatcagtcccgatcaaacgattgtacatgcacaatcacttgctcgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcgtgaggatcatgcacaaggcatcggaacacagataaaaaatttgaaaatggcgtttaaatgtgattttaagttctttacacttagcttctcacaacataatatcctgaatagcctccaatttaaccatttatgacggttttcagtcatacttataatcgtcaaaggtggtcttctggaacatctcttttaggatagcacatactgatatacatttatgaaaaagaagtgctgcatcaaaattggcatcggaaacctctactttggactaacttactgtgcctttgagcttcttacatttaaaaagggcaggtctagtatatcttcatagtctagacgtaaataagattcagcaaattgacttagtagtacagactctacataattgtactgtttaattacctgatcatttttgctgaaccaaatccaagactgtcatgaaataggcttgtcatgtacttcttctgtacaaggctcaaaagctctgagctgttgtatatagggggcaggtatgcttccccattcccatctttgtgtttattccataattcgacaaacttcttgtggaaaaaattccatgaatcttcaattgtcttcaagatccatttcttgtaagcctgcaaaatatgtacagacatagaacttattttatgcctggcgaaacatcatgaaaataccttctagaatctagatgttgcaattgcactttgccatatcataacttgtcatttctgcagttcccattaagtactccctccatttcatattataagtcgtttgacttttttcttagtcaaagttctttaggtttgaccagatttatagaaaaaaattagcaacatttacaacagcaaattagtttaattaaatttaacatagaatatattttgataatatgtttgttttgtattgaaaatgttattctatttttctacagatttggttaaacttaaaaaaaattgactaagaaaaaaatcaaacaacttataatatgaaacggagggagtaatactcagggacattcatcgtctgctgagcaccctcctccctctgttacatacggcatatatcaacaatatcaattgctagttattctataggatacaagtatcatgttccaaacttctatcctatcgaaattagtacacaggaagacatgtggttgccattatcttagcaaacgcaaaacaacttaaccacccaggtaagattacgcactttcatttactattattagccaataaatccatacacaccttacgatcatttgcttgatcagcatgtccatcttgtgaaaaatatgccaaaatcaagttccccaggaaggccccaatatcgtaacccattgggccatagaaagcaaattctggatcaatcacttgagtagaatctggtgtcaccatgatggaactagtgtggagatctccatgaagaaaagcttgtgctctctcaataaacctgcatatgcaaatcatgtccatcatctccaatgaaaaggaaagagaaacgctggtttaatcaggagagctagttacattgattttaattcagcaatctccaacttaagctcagcatcctctcgaaccgctgcagcatcattatcaaggaagggtgatgtgcagcgattgtatttggcgaccctgtatggatctgagaatacaacttgttctgtgagcctgctcatctccacattatcgcaatactgagcaactgcaattcacataacacaacatgccatcaattcggttctcatttttctcccttctcaattttcacaggcaaaccaaacctgtaataaatcaaccaacctcctttcttgtgatcagtggtggagttgtagagaagtgaagtgaagaagagcgtcttggccatgtaatccgccatgtgctcggcgagcagcgggtactcgacgccggcgacgaggcccttgcggaggatgatgtgcggcggctcgatgtagcgcatcccgatgagcgacatggcacggtcgaagtggtagacctcggggacatggtccgggcagagggcgcggtgcttctgcagcgcggaggcctcgaaataggcgcgctccctcgacatcggccatgaatcccccactaagcggatgtacggcagcgcctggattgcagcgtcgtcagcgaaagaacggagacagaagatgcgtactacatgtgtggcagcggcgacggtggcggcgcgtggaggagatagggacctgcttgatgacgagggagccggcgtcggagaggacgatgtagacgaagttgaggttgccgtcgccgacctccttgatggtgagggcgtcgaggcggccgccgaggcgcgcggcgagggcgggcgtggccttgatgtaggccaccagggacgcctcgtcgagcgggcggaagccctgctgctgctgctccgccgccgccgcggccatggccggtgcgtgtgtgggcgtcgagttgacttgaccgatgcgagcgccggcggcgaagcggggaatcgggtgagcgtgtgtgttggaagtggctgctgctcgggtgggatttgtaacagctgccgtttccgcggaagggggcggttctctgaacctggacttgtttttggtacaaggccaggattcttcagttgagtcatgtcatcatcgtgtgagctaatcttgaggagttcaggctatttttgagttttgaatatattgcttcaaatcttgaactgaatgcggcttctagctattggatttggtgcttttcgtgccataccttctccattttaaaatgtaatagcatttctgatataattttggataagtgtttgttcacttaaagtatgatgagataagagttaaaaagatcagaaaaattaaaaattaaaaattggatcacttcaggctagctgccaatggcggtgtactggcgtaccgtcagttggagttggaattttctaggatatccaccagactcaatatggtgtactgaacaaaatgttcttctatagataaaagacgatatttggattccaaacacatttttaaaaaaaattgtaagcgcgttagatattgaacacggggtctcaaaattgaaatcacacattccattctataagtgcatcttgttcttctatatatagatacatgccatgactatatagttttgctgaaaaaacaggtctcaggtaaggaccgtatattcatttaatatgaaacggttactgttcaggttcgtttgtgtgtttattataaaaatagaaatttactgtgatattttagaggatcacaattattgtctcccttccacgaactatgtgagttggtatgggctgtgtttggatccaaacttcaatcattttccatcacatccacctccacctgttatacacacgtaacttttcagtcacatcatcttcaatttcagccaaaatccaaactttgcgctgaactaaacacagccaaggtagcatcggaccgattactcggttggcgttggaacgggtactcatgttccacgctgttgttttcaacaaataggaagaatatgtccatgtttggacccataattcggcttgatttaaacatgtcgtcgtcaaatgctagcatccactaatctgttggtttggatacttgttttcttcgaaatgacatcgtatctaaacaaagcagcatgaaagtgccagtcctccaaattgaacggcatgaaactagtagcttgcatgaccaaacgtatttatggccatgatatatttaagagaaaaaaatcattctaaacagtatatatttactgaatgtactagaaggtccaagcacataattactccatcaattttaaaatataaggattgttacaataaataatttatttttttcacttcagttgttagcatttgaatttcgaattacttgtatttcttttgggaaattttgtaaaaatacactcgttatgatcaaaattacacaaaactacaaggattttgacacatagcacatgacccataggtactatggatataaagttccacaaaaccacattgtaaccaatttgacatactcatatatcaaatttttaaaaggccatggatgtaacatttatatgatggataaataactcataaattcgagatgcgattgtataacttaaaattatggtaattcaaagttagaatgataaatattgtgttttttgaaatgaccataatacatatgtttatgtgctaaaaaatcgtatgtttttttaatttactcaatttgttctaaaatttagtactagataggacacatcatagtactataaatctcgacagaaattcgttgggtattatatgctctatgttcaaattcgtagtactataatgtatcccatctagttataggttattattatttgtgattaagaggtagatcataatacgggtggttaaatgaaatttacttattctctctttccaagcatttgattagctttaaaattattgaaatgatgggaatcacaaaaatcagtgaaaaataagaatattatggtgtaaaatttaaatcttaaaagtatagaaatggaaggagttattccaacaccatcgggcatcacttgcccgcaaaattgcaataactcaccataatatttcaaaataattcgacggaattcattcgctcgcgccgtctccgaaaccgaatccatttcctgatccagcaaaggacacagagagagatcccatctcgtcctcgtcgcctccgcctcgtgagctccactcacctaccccacttcctctcctcgcttcggccgcggccccaaaccctaaccctccccgcggcgatcccgatggccaccacctcccgccgatccctccacgccctcctcggcggcggcgcaggtacgcacgcgcattcccggcgctctccgatccgggtcgagaatttgggttcggttttctcctcactcgtgttctctcgtctcgcagtcgccgacttggtgctgtggcggcggaggaacgtgtccgcggcggccgtggcgggcgccacggcggtgtggttcctcttcgagcgcgcggggtacagcttcccgtcagtcatggccaacgccctgctcctcctcgtcgccatcctcttcttctgggccaagtccgcctcgctgctcaacaggtgggtttttgccctggctctacagcaccgcgtgtttctgatctcatgtagagtcgcgccgcgccctgcggccctgattcgctgtagttgtaactgcggtgttcactgtaatgtgtatgaggttttgctgaataatgtggactttcttttccccaaccgtttggttgttgcatctttttggcttcaagaagctcactgccaaactgtttcatacactaacttgcttagcatttttgaattacgggttgcagtaagaaactaaacttcaggccagagcagtttgtaattggaagtgatccgatgatctcctaagattagagattgttcaaaggtttgaactctgcatatgtcggggtttcctaattatcccttttcctgaaacctgcatatttcgtttttattacattaccaataatgcatctatccgatcccttatctacaaagtaaagaggctgctttactttaaagctaagccgcgatagcagttcgataagttaattctgctagcatgtgtcattttctctagagcttgtaactgtgctatatggtctcttctgcaagcaatccacaaggtttttttcctagatttacattacatggtcaatcaccgcgcttgccattccttatcggctcatttatgagtttgtgttccccatctgacttgattgttgcctagaattgatatgcatttatgcagtgtctctgcgattgtatcgctaaaccgaaaaagaaagagctgtttttggcactttggttgttttatgttgttctctgtgactggcattgtacttccattgcccatatcatctatccaagtttgacacaaagttgtgatttttgcaggcctcttccaccactccctaaactagaggtctcagatgtggttgttgagaaagctgcagatcgggctcttgtatggatcaacaaggtgttggctgttggccatgatattgccatcaagagagataggagtgtttttataaaggtctctctcttatacacacacatccatgcccactagtacacacacaactgtacgtctatatggctgtacctgcctttgtatgctttcttcttatgccccttattttgtttggtcatataggttatattgattttatgggtggtttcatacattggaatgctcttcaacttccttacgctcatttacattggtgagtactactgaatttgtttctctttaacttcctggacctattcatgtatggatcaatcgttcttttatgatagctcatatgtaataattgtatcattctggcttttctctaggtgtaatgttttctctgttagttccaccattgtatgagaagtaccaggaccaagtcgatgaaaagattggtatggcgcacagtgtactatcaaggcacttagataccatcattagcaagactggagaatcaaccaagcaaaagaagactgagtaaccggtgtttttgctacattgggtgagcttctaagacggtttgaatcttttttactagttcatggtatactctaaatccaacaaaccactaatagcttttgtgtttcacatatttagtatgctacacatttcgttaacatgatagcatggacaacatttttgtttaactcttgcaatctcaagtttacataatgttgcaatagttcaaaaaacctttaagatgctataacggcaatgccagtggatctttgttactcgaaaagtcccacaaaaacctaagggctaagggcagcaaagatgagataaattctcgttgaacaaatggatagagttacttctcaccgtattctgtatttctgttgtatttttctaaggcaaaaatggtctttcttagaaaggcgaggcagtgatgtcctccctttgttaataaaaagagaaaccaccagcccaggaatggcattcaaggcactctaaatacaaccaagtaatcactttcagaagtttgtttttctggagttgaactgttaccacacatgaaatttacaaatgttctgagaccatcttctgttgttcctgagaaatgatacttctctataatgatcatcttttgtcttatcaggaacctcttttgtcatatgtggttggtcatgaacctcgtcagttactctccatacctgtgaaccaccactggaaatattcttggatatcgaagatgtcatgtttgactgctgatgtagtttacatgcactctgttcaatttgagaaatggaatgctttgtatattttttcaagtaacatgacacatgctgaggtttatcatgggcacatatcttgtggataatgatatatacttttcccctgaaatcattttctgtagccggcatatacaaatatgttggttgctggtgcactaaaccgtttttttagtgttcttgattctcattgttaaatagttccctaataaactttagtgagctcattcgatgccaaactgcacacatgcatacctgaatctttggtaatcgtctagggccagccatttttctctactacttatgaaccgttgtgttcagtttttactattctggtgtattaatttgctgcaaaacttatgtatcatgtaagtattttgtgttggtgtaaaatcgctatgctagaaattaagaaaaattaacaagacaagtcagagcaaccacatgcatatttggaaattctgtgcagttcattgtagaaacaaattatgcatgagccagccttgataacatattttcaaacttaagttgtctgctcaggctccagtatgcaacacctctctttagaggggctaaggccattacgggcaccagtggacaaattggcttaggcatatccgaaaggggacgcctattggcaattcaatatgtgtgagcattatggtacaagactaccagtgcagagcctttttgggacactaacataaaaacttgggtgggtatccaaattgtagggtcactactcactgggtcaagcagataagttctccatcttccaacattctttttctatactccacagtacacatatctgcacacttatttgtgatatggaatatagtaagcattattctggcaaagagaagacacctttttttttctggtttgctattatgaatcagacggcaaatattgcttccggccgagtcatgtcatgctgacttcatgtttagcaaacgctaatatgctatatgaacatatctttgctcctggcccagaagatgatgatgttccacttgctacatacacacattgtgccttttgtcatgccccagtgccccaatcatatactaccggtatgtacagactacagagcactgagcccggtcgtgaggcagcctctgccctcctgccgaggaaagccgacgctattgccttccccgcactgacccatcatcaacaactcaactcaaaatcacaaaacgccttgaccgcacactgccatactattatgtgtgtattcacttcgcgagctaggcacgtagccacttcgccctggaatcaagtgcacgccccgctcggctcggccagtggtcgcgagctgcacgccgccgctgcctgcacgcacgagcgctgcttcatttcttcttcttcttcactcctaccgtcgatgacgactaattaaccgccaaccccactaccgcctctctctttgctggctgccattgcctcctctcttccccggcaaaacaacttctctcctattcccacctcttttcacccataaagcggaagtggatttttgtcgggacatcctctcgttttgtgcgtatcgtttaaaaagttatcaaaattttttttaaaaaaattatcaagatatatattgtgatcaatatatgatatatcttttcgcaaacatgcaagttaaaattcgacatatgtaatttgaaacaaaaataacaaacaaatttaaccgtaaattacgtgttcttttcacagttaaatttgctatttttgtttttacttgtataagttgaatttgaatatgcatgtttgaagtgacatatcacatatagggtgtgtttagttccacgctaaagttgaaagtttgattgaaattgaaatgatgtaacggaaaagttgaaagtttgtgtgtgtagaaaagttcgatgtgacgtttttgggattcaaagtttggaactaaaccgagccataatctgctacactaaattttttaccacctccgtcccaaaataagtgcaaccatagatatccgtgtccagcgttttgactgtccgtcttatttgaaaaaattataaaaaaaataaaaatattagtcacgcataaagtactattcatgtattatcatctaataacaataaaaatactagtcataattgtttttcaaataagacgaacggtcaaacgttgagcatgaacggtgttaaaactgcacttattttgggagtgacatgtaaaaacgagatgatatccccttaaaaaatgaatatagtttttcccataaagcacgctccacttgtgctgatccattccatgtcaatggagttcatggagccatggacccatctcctcctcctcctccttaaaactcgtcttcccccccacgtctcaccaccatctaacgtgcgtccatggcggcggcttcaggccataatgcgcgcctgcttgcgctcgcgctcgcgctcctgctcgccgcgctgcacctgcacggcgtggtgtgtgaccccagccatactcacttcgccatggtgtcgcgcaatgcgccgtcgtggaggcccgatcgcggtggacaagggaaggtatcggcgccgtcccggaggacttcctgaacgagaacctgcaggcgctgtacccggtgatccaggcgttcaaggcgaccatcaccagcgacccgcgcggcgtgacggcgtcgtgggtcggccccaacctctgcgacagctacttcggcggcgacatgtacaagggcttctactgcgagcacccgccggcgccgccgggtgcaacgacgccgaaggacaacaccacgctcaccatcgcgtccatcgacttcaacggctacggcctcggcgcgcccagcctctccggcttcgtcgacgcgttcccggacctagcgctcttccacgccaactccaacaacttctccggcgaggtccccgacctcaccggcctcccgtacttctacgagctcgacctctccaacaacaacttctccggcgcgttcccggccaccgtcgtcccgctcggccgcctcctcttcctcgacctccgcttcaaccgcttcgtcggcacggtgccgccgccggtgttcgacctcaccgtcgtcgcgctcttcctcaacaacaacggcttctacggcaacatcccggacaacttcgggagcaccacggcggagtacctggtggtggccaacaaccagttcaccggcccgatcccgcgctccatctacaacacgtcggcgaacctctccgaggtgctcttcctcaacaaccacctctcgggatgcctcccctacgagatcggattggtggaggggctcaccgtgttcgacgccggcggcaacgacatcaccggacccatcccgctctccctcggctgcctggggctcgtcgaggagctcaacctcgccgggaaccagctgtacggccacatccccgacgtgctctgcgcgctggccaagaccgggaagctgcagaacctctccctctccgacaactacttccactccgtcggccgccgccattgcctcgagctcgtccggagcaaggtgctcgacgtgcgcctcaactgcatccccaacttcccccaccagcggccggcgctcgagtgcgcccgcttctacgccgacccgccgcagcactgccccttcgtgccgcacatcccctgcgacctgccgggcttcaggccgccggcggcggcgttgccttcggctgtggcagctgaagaaggcggcggcggcggaggtggtggcaactgaactgatcagcgatcaccaactttgtcagcgttttgtcgttcagatcgcatgattccaaactttgtaactgttggtcaataaacggaaaacggcctaccaatttgtgccgcaaatctcagcctgacgcattgctgacaacaatctgatatcacatcgcaataagagggaaggatgcaaacacgaacattcttgcatccttccattgtatccttacaagtaatcagtgttctgaaattcactgatcagatgtactagttgtagctatatttcgacagaagtgaataatgagaatttggaacggtaaaacaggatcttcgttaatgtattcttgagatgataaattatatagagtacaaattggagaagataaataagagtacaaattggatcgagctatgtacacagatcactgtaagataaaaggcaggcagtagagtaaataagctgtcccctcaaaatgcgacaacgatatatggaggcacggaagcagaaatttcagaaaggctccacgctgcctcatcccctctcctcgccgattacatgttatcgatgagctcatgcggtgttcagcttagcgagcgtgcgcttcaaagccttcacgctcaatgggctgttcttgctctgcacaattccaacaaaaggaaggtcagttcgtacgttcaaatatcttgcacaattccaacagaagaaaggtcagttagtgcattacagttatctgaactatctttggagccaaagcaaccttaatgtctagttttttcagaaaaagcatgatgacaaatatttgctgagttcagatcatgaaagcctcgtgccttttcaaaaccgtatagcttgtcggagcagaatactatgatgaaaacaatctttggaatagaatgtaggcagtataaagttgcagtaagaacgaacaagaaagcgaggagattaccgctgagcaggttccagcccgggtgttgcagacagggtagtcaggcgggcagcagctggcatgatccttgcagcaggttgcaccttcaactgggcaacagccccaaaccaagcagagattcctgaagccgaatgcgcagcagcaggtgctgcccgctgggcaagagaagttatcatcgcagacatggtcaggggcggatgggggaggtggtgttggaggagttggaggagtcggagatggcttgggtgggtttgctccgctcttggtagggtatgatgccatcatggcaatgccacacttccccgtggtcacattgatattgcgctccatgcgaacgtatccagactcaccccacttcgggccccaagagttgcggacaatccagtagtctttgccattgtcagtgccataaccgacggcaaccacaccatggtcaaggcttgtgccacacctaccgctgaagacgccctgtaatgtaaaaatcaatagttgttacgaccaaaacctcctatatgcatggggtgatatctgcaagttcatttaccgaatgatagagctggaactcgcggccaccagcctcaatagcaacactgactggttggtgagcaaccgccttctgaagtgatttctcatcattttgaggtacatcctcaaagccatcgatgctcacaaccttagcattttcctaaaacaatgcacccgttgaaacattagcgatttgcataatgtgggaactgaaagatgaatgtatgaagttattcatcagaaaataagttaataccctgttgatgtcacacttgccatctacagctttgtaaggatagtcatcttcagtatcaatgcctccattcttaatgatgaagtcaaaggcatcatccatgagcccaccgttgcagccactgttctgtccattggttgagcattctacaagttcttgttccgacaatgtgatcatctcaccagtaacaagttggttgatgctttctactgtgcttactgcggagaaggcccagcagcttcctgcatcccaccattcaagaccaaagatgtcagtaaccatcaaaataactagtgtcatccaagagagcaacaactgcaatcataccgcaagcaaccaattgtaatatgaggcaagaaccctaaactgtttaattgtatcaatattatcaagatcaagatggatagtaagatatttgcagacatttgtttcacccctgtttttacccacaaaagcagtttgaagacacctgtaggctaatatcagcaaacagctcccagcacaggataaaaagtttgctcgactgaacacgaaaggttgataaggtgtgatatcccttaaaagtcttaaaggcccaaaatagttgcaatgcaaagcaacatcatcaaatcggtttaatgtcttagtagttggttacagggtcaccttgtccaaagtatttgactgatagatgcaccgaaaaagacctttaaaaatataaagacaaaagcagcacaaccacagaaacggcagtcctaaaatcaggaaaaaacaagctaagctaaactacaatcctggaaacaaggaaaccacactgagcaagtcagccccaaccaacggcgggctttgaatctgttcaagtccacaccgctgtcactgcacgattcacaagtcacagccgttgccaactccagaagcaaagaacgaagagaacaaataccttacacagttaacccaatgagaggattttccaagaatacatcctgcatccactacgtaataaatccttaccatagaattccaaacaattattcggtccagtaaattatcatcgtattaaaagaacaataactctgtcattaaatcagatatgctcattcaggggggaaagtcagctttagctagaaaaatgacccatcttttctagagactagacggtgtgtgactatataatcataatctactattatattatgtatatatcagaaggaaatctgcactgttttgcaagtaggggcaaaagattactagctgtgaacctgaattaactgttgtgaaattgccctacttagatccgagattagcgtgacaaatagataatcgcatctaagctttcaatggtaaataatcgcacaagggagatgagatgaggaaagagaagaaattccttaccgcattggccctggttcttgacgggggcgacggcgcccttctccctccagtcgacggactccggcagctcctccaccccgtcgtggcggtacctctccccggcggcgcggctcctctcggcgaccttggcgccgaggaaggtcgcgcggaactcctcgttggtgagatcggcgaagcggttcatcccgaggcggaacccgccgcgctcgtcggcgcgggcgttgtgggcgtcgacgaacttgaggttgtcccagaacacgaggaaccggcgctcgtgctcgccgccgagcgcgttgggcgagccgccgccgttctcggcgagccagaggtcgtacgcggcgcgcgcctcggcctccgtgggcccctcctccagcccccgcgccccgtgctccgcgttgtaggagatgatcgacatgtccggcgccgcggtggccgcgccgacgatgagcagcagcaggaacgcggcggcggcggcgcgggcggccatggcggcgacgtggagacgagcgtctctctccaacctcttcgctttcctcctcttttcttttcctcctttttttttccttcttcgttgggtttgtggttttttgggcttgataggctcgatgcgggtgggatttataggcggcggatgcgtgtttgggtcggcgactggaagaggagtttgggtttgggaattgggatgggatgaggtgagggatccaacgccgctaactaacaattctgatctgaattaggttgctaatcgtaacaattcctatcttaattaggagcgaaacagggtggatattctcccccgaataaaaaattttccatggcgaagtcgatcgggtaaaaaattaggaaccgaatcctcaagtaattagtactataatctagctcgtggtaactggtaagacacctcatcggtgtcgaccaaatccgttggatcgtaaataaacaaggcagattttcccccccccctccctttctcatcgggtaatttagaactgacggagcgtggggctcctcaccgggagaccgcgcaggcccccctttgccagttcggccgggggccctgggtgaggttctaagctcccaatctgtggaaggttcgcaagagcggaaacacacaagacacgggcgatgtatacaggttcgggccgctgagaagcgtaataccctactcctgtgttttggtggattcgcgtatgaagaagctacaaagtgccagtcagcccccgattcttctgggattgctttctcctctcctttctaagtgggcaaggtcctccttttatatcccaaggggatcccacatgcaccatctctccctccctttctttcaacttgacttctcttcattaatggacggagatttgtatcgctgccatccgaatcaccttctgacgggacggcccatacctacctccactttcaccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggaggtaacacgccggctccggctagggacgagtgcttggaggctctcgtcctgactggacggggcgaggcgtgcgtcagaccgcctgtcgccacctaacccacgatctgaccggtctgtgactggtcacagaccggataaacgagcgcgctgcaccgtattacacgcggcgtgacgcgttcgtccaaaccgcaataaatgcggttaggtgagcgccgctgtgctcacctaacccatacacgcggcgcaaaatccacaaggggtcggggcgccccaaccctcggggccaaggcgggagcggtccgaccccctcggggagacaaagaggagggcgaacacaccaccctcgggcccgacccccccccccccggtgggtgccaggccacgtgggcgattgtgtctgcctcaagcctctagtcacgatactcccggtcccatgtcatcgacagtagcccccggcgttatgccggggcgattaccctcctcgagggaagcggtcgggcgtgacgccacttcctaaggcctggtgacaggtgggaccggtctccacagttgggcagaaacccatcagtcgcaaatcacgcacatcggcaacggttactcggctgtcaataatgaacggtctcttcaagactgccacattactcgagtaacgtgtgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggattagtggaagagtgggcgcgagaaacgagggggcaagatagtgggcgcgagaaacgaggagccgggcacagcgttggcaagggtataaagttgccgaggaagagatttgcttcctttctttcgccattattccccttgtcttcgccgcttgcgccctaactccttgtttcctgtgccctacctccgccacacgcgctcgctctcaaacatctcttcttccggcgtcatggcacggggctccgctccgcttgacggtagcgtgctgccgccttcccgcatcgtgagcgagagacaggccgggctgctgcgccgcttcatgccggaatctgcgaccggccgggagatagtctcgctgggcgaaggatgcccggcgccacgctacccggggcggtccgtcttcttcctcccttttgctatggcagggctggttccgccattttcttctttcttcgtggatgttctggagttttacgatctccagatggcgcacctcacccccaacgcggtaatgacattggccatcttcgcgcacttgtgcgagatgttcatcggggtgcgcccatcccttcggctgttccggtggttcttcaccgtacagccggtttcgccgccgtcggtggttggtggttgctacttccagccgcgggggccggtgctgaaccgctacattccctgcgtcctccgcaagaagtgggatgactggaagagcgactggttctacacccccctcgccgacgaatcgcgcctccgactcccaagccagcctccagcgcaggcctccaactggcgggcgccggtagatctgggagatggctacgacgccgtcctcgaccgcctggcgggcctgcgatctcaggggctcacaggggccatggtgttcggcgactatcttcgtcgccggatcgcgccactccagcggcgcgcccggggcgcctgggagtacaccgggtccgaggactgtatgaggacccaccagggggtccgatgggactgggctcctgaggacttcaagatagtggtccaacgggtgctgaatctcagctccgtggaggcatccctcgttcctcaaggagtcctccccctctgcagtgatccagaccgtgcctccatcttgaccatcatgcaggcggtcggggcatcggaggagcgggctcctcgaggccacgatggcgcggtcgggagccgcaggggggaacgatctaccccgggagggggtcgtgcttctgggcctcgcgacgggggcccggggagcggccaccctgccgacgcccgggggaagaggaagcaggaaggaacccctccctcatctcctccccgagggggcggggcggcgcgtgccagcagcaggcgcccggagggggccacgccgacgtcgcagcccgagggggagcggaagaagaaacggccccgcaagatgagggggacagaaccatcccggggaaaccttatttcccctccaaggtggtcgtttaaccgaccccctcgcaggttcgtcccacgcccatcatggccgtattcattcctttaacgcgagttttcactcatccatcttgttttgtcttctggtctttcttctgtttcagcgagatcccgtcgcgtccctcccgccattccaagtccggccagtctgagtccgaggacccggcgtccacagaggcccggaggcgggaatctgaccggcgagaagccgcagaccgccttcgggaagccgaggaggccgctcgggaggccgccctggctcgccagaccgaggaagccgttcgggaggaggccggactccgccaggccgaagcgacgacatcctctgaggcgacccgtgaaactgaccggcaagaggccgcggatcgccttcgagaagccgaggaagctgttcaggtggccgtccaagctcgcctagctgaagaagccgctcgggaagaggtcagacttcaccaggccgaggcggcgacgacttccgaggcagcttgcgacgaggccgcgggcgcatcgcttgggcccaattcctcgggcgacgcccaggataagctaggtccgggggatatccctgagtccggcacgtccattggcgggccgagccgcgcggcatcctcaccgagacggctcttccccacgccttctgctgctccactgagcgcagaaccccttctgcgggccttggccgtcgcaaacacgacggtgttggacgggttaagtgcccaagtggaggccctgcaagcagagcgggcggagctcgacgccgcatgggtgcgtgtcgaagaggggcgacgctcggtggaggccatggtggaagtgggtcgcaaggcacaccgtcggcacgtctcagagctcgaagcccgtcggaaggtgctggaggagatcgccaaggaggtggaggaggagcggggggctgccctcatcgccaccactgtgatgaacgaggcgcaggactccctccgccttcaatacgggagctgggaggcggagctagagaaaaaactcgatgccgcccagggggtccttgacgctgccgctgcccgagaacggcgggcggcggagaccgaggtggcatcccggcggcgcgacgaagcccttgaggcccgtgccatggcgctggaagagcgtgcctgcgccgtggagagggacctggcggatcgcgaggccgccgttgctattcgggaggtcacactagcggtgcacgaagccgcctgtgccgaagaagagtccgcactccgcctccgcgaggacgcgctcaccgagcgggagcgagctctcgaggaggccgaggccgcggcgcaacggctggcggacagcctgtccctccgcgaggcttcgcaagaggaacaggcgcgccgtaatctggaagatgcccgcgccgagaggaccgcgctgaaccagcgggccgctgagctcgaggcgcgggagaaggagctggacgcgagggcacggatcggcggggcggccgcgggcgaaagcgacttaaccgctcgcctcgcaactgccgaacacaccatcgccgatctgcagggcgcgctagactcgtccgccggggaggtcgaggccctccgcttggcaggcgaggtagggcccggcatgcttcgggatgccgtctcccgtctagaccgcgccggccggcaggtgggcctctggggcgggcagactgcgaagtacgccgccacccaagggggcctcgcccagcgcctctcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccggaaccgaggacggcgcacgcgcgcaagtccgggacgccgccgaccatatcgtccacagcttcgagggttcggcccctcggctcgcgttcgccctcaactccgacggggaggatgatacggcggagtgggcaatagtggcgacgaggccggcgatccgggtgcgtcggagtgagcccccaggcccccgccaatctttaaatagtatcttcttttttttttaaggccttcgggccccctgcttgtatagactaatttaatctgcaatcaaataaagaggaaattttttgtgttaattctatttgttgtgtgtatgagacaaggatgtctgtgccgcggttctcttgtgtcttggcttgaacaagggctcgtgcccaggtcctagtcctcaaatggctcgggtcggggctagtgcctggagagatccacatgtcgagactggccaggccgggagcgtggtgaccgagggttatgggtgacccgattgtgggtttttgccgattctcccccggagttcaccacgccccggggcacggctcggttctgggccccgtttggcgattttagccgacccgagcccccgagggcaggattgaacacgagtgacctatttcaagtcaagattcttcaaaaggaaacaacagcacagatacagcctttaggaaatcgaaaatacttttattgaggtacagatataagagaaataagaatatgcatatgtggcagcccccggccaaccctgcacgcccgaggggggtgcggggttggcccaagcctaaatcctgatacccgatcccccttaggggtagaagcgacgaaggtgttctatgttccacgggttaggcagttctgcgccgtcgctcgtggccagccgaacggagcccggccgggggacaccaatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcctctaggtagtcgaggtcatctctacgaagctgatcttgatcagcttcgcagtacatggtggcccgaggggacctcagggtgagctcggatgggagaaccgcttccgcgccgtagacgaggaagaaaggcgtttccccggttgctcggcttggcgtggttcggctcgcccagagcaccgctggcaactcctcgatccacgaatcgccgtgcttcttgaggatgttgaaggtcttggttttaaggcctctgaggatttccgcattggctcgctccacttggccgttgcttctggggtgggcaggtgaggcgaagcagagcttgatgcccatatcttcgcagtaatcgccgaaaagttcactagtgaattgggtgccgttatccgtaataatacggttaggcactccaaaccgagctgtgatgcccttaatgaatttaagtgcggagtgcttatcgatcttgacaaccggataagcctcgggccacttagtgaacttgtcgatcgcgacatacagatactcaaacccgcccggggcccgcctaaacggtcccaagatatcgagcccccagacagcaaatggccatgaaagcggtatgatctgcagggcctgggccggctgatggatttgcttggcgtggaattgacacgctctgcatcgccggactaggtcgaccgcatcattgagagctgtcggccaatagaaaccttgtcgaaaagctttgccaaccaaggtacgcgaggcggagtgggctccgcattcgccttcatggatatcggcgagaagctcgacgccttgttcccgaggaatgcacttcaggaggattccgttagccgcgcgccgatagagggtcccttctaccagcacatagcgtttggaaatgcgccggacgcgttcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccaacggctaggcaagcctttcttcaaaagcgcccggtggggtctgggctcgcgaggaagcgagtcgtgagagttcgtcggcaaccgtgttatcccgtctgggcacgtgccgaagctctatcccgtcaaaatggtgctccatacgccgtacttggcgcacgtaagcgtccatctgcgggtcagagcaccggtactccttacagacctggttaacgaccagctgggagtcgcctaacaccaggaggcggcagatccccagtccagctgccaccctgagtcccgcaaggagtccttcgtactctgccatattattggtcgcccgaaagtcaaggcgaaccaaatatctgaggacgtctccgctcggcgaggtcaacgtgacccccgcactagcgccctgaagagacagggagccgtcgaactgcatcacccagtgggcggtgtgaggcagctgtgaggggcccgagctggcctcggggactgagacgggctcgggagctggggtccactctgccacaaaatcggcgagggcctggctcttgatagcgtggcgtggttcaaagtgcaaatcgaactcagaaagttcgattgcccatttcaccacccgtctagtaccctctcgattatgcaagatttggccgagggggtaagacgtaaccaccatgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggtggggccgatccccttcgctaggggccacatccctggggcgctcttcgtccaagcggcctcgcgaggcgcgctcgtcttctgtgccgacgacctcggggtcagaggacgacaggggcggccttcccacagtggccccggggccgtcctgggggtcggaggctcctggcgtcgtcggacaagcgggcaaagggccaactccggtcgtcaggggccttaggccaccgttcggctcgggggtctcttctccctgctctctcccgagtcgagcgggcacaggattagcctcggggtcagagggtgataggtgcggccttcccgcagtggccctcaggccatcctggggttcgggggcacctggcaccatctgacaagcgggcagagggccaactccggtcgtcgggggccttgggccgccgttcggctcgggggcctctcctccctgctctctcccgggccaagccagcacagggtggggatgcgcgaatgaggattatcctcatcgcgctccacaaccaacgctgcactaaccacttgcggggtcgccgctaagtaaagtagcaagggttcatctggctccggggcgaccagaaccgggggagagctgagatacgccttcaactgggcgagggcatgttcagcttcctccgtccaggtaaacggtccggagcgtttgaggagcttaaataagggtagcgccttctctcccagccttgatataaaccgacttagggcggccatgcaaccggtgacgcattgcacatccctaagcttgctggggggcgcatgcgctctatagctcgtatcttctcgggattggcctcgatgcctcgggcagagactaaaaacccgagaagcttgcccgcaggtacaccgaacacgcacttatcggggttcagttttatgcgggcggagcggagactctcaaaagtttccgctagatctgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaacgcagttttttcctcatcctccctagccatgcgaatctgttggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttacgcccggccgcacggcgagacggtgctcaatcacctccctggggaccccgggcatatccgccggcctccatgcgaagacgtcagcgtttgcccgcaggaaagagacgagcgcgtcttcctatttgccgtccagaagaccaccgatccgtgtggtcttggacgggccgtcgcccagggcaatctccttgaccgggacctcgtcgcatgtgactatccgctgcctcggggcggcgggggcggatgtgccaagcctctcgtcgccaccctcgggcttggacgcgacggcgaggcggtccgcgcgctgctccatacaagcaagcgcgactttgaggtcgccatggacagagatggggccatcggggcccggcatcttcatctggaggtaggcgtagtggaccgccgccatgaactttaccaacgcgggcctccccaagaccgcgttgtagggcagactgaggtccgccacatcaaagttcacctgctccgtgcggaagttggcgggtccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacactctcccccatcgacagtggcaatggtggccccaggctcttggaaacctaggtcatcatcgccgtcatcgatgtcctcggcgggggccttctgcttggcctcacttcgccgattgctggaaggaaccgccggggacttgccctctcggcgctcctgcctcctctcctcctcccacttcctcgtccgctcagccaaacttttgactgcacggcagtccgcgaggtcgtgaagggaagtgttgtggacgatgcaccacttgtcggttgggcgctccctactaggagcgccggcctccttctttttgtcgcccgcaggcctcccctttcgagtggcccgcgaagcgtcctcgacagcgaggacatgaccctcgtcgtcggtgtgggctgacctcttcttcctcctcctgtcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcgattgtgccgcacaccccccctgaacgcgtaaatcaccgtgtgtgcagggatgcatggtatggtgttgcggacttgacagaaccgctgaatgtacgagtgaagtgactcatcatcccttcgctgtactgcgtgcaagtccgcttcctcacctgggcgcggatatgtgccttgaaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtctgtggtgaggtgacactccggacgaggaggcgccctccgttgcgtggggagcacgtcggccattacgccggcgctcgatactgatgcgggcatccggtcccccacgcagatcttcccgggtcagaggcgttgacgaaggagtggcggccgaatggcgaacagcggctgccgctcgccgcgccctccgtcttgacgacgcggagccggtggtagcagcaccagaggccttggtggcggaggaccgcccaccagcatccaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggagggggcggtggagtacgagctcgacggcgtgggtttagctccccgtcgtcaccgctcatactcggggagaggtcgtgcgcctttgcttgctcggccattgggctgaacaggaaaagcttggcgaacacgaaagagtgcgagagctcagaagatcactcacagagccccctacctggcgcgccagatgacggagcgtggggctcctcaccgggagaccgcgcaggcccccctttgccagttcggccgggggccctgggtgaggttctaagctcccaatctgtggaaggttcgcgagagcggaaacacacaagacacgggcgatgtatacaggttcgggccgctgagaagcgtaataccctactcctgtgttttggtggattcgcgtatgaagaagctacaaagtgccagtcagcccccgattcttctgggattgctttctcctctcctttctaagtgggcaaggtcctccttttatatcccaaggggatcccacatgcatcatctctccctccctttctttcaacttgacttctcttcattaatggacggagatttgtatcgctgccatccgaatcaccttctgacgggacggcccatacctacctccacttccaccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacat

SEQ ID NO: 72614 - DNA, 516 bp, Oryza sativa
atatgtttgggccgtagagattgtcacggatcgggctatagagagcagcagtaattttgagttaacaaagcaagtttagagttttgatcctgtccaactaatcgccgggttaatcgggtctacacgcgtgacatgcgccgcaacgagattaccaaaaaccaaaacaagcaaagggcgggcggttcattcattcacagaagaagagggccatcactaggaaaaaatcatcatggtcgtcatggaggggagagacagtatagcctaatctaatcccagattgctagtgattagcacgtagatacatagaagcgatcgatcgaggacacatcgagaaaaaggtaaaagggagatcaattaatcgaagaagagagtttttgaaatatcgatcgatctagctatcatcatgtcgttcatccggaagaagtcgatggagttcttgaagagcttcgaggtgccggcgaagaacccgtcggaggaggcgcagcgccggtggcgggatgccgtcggcacactcgt

SEQ ID NO: 72615 - DNA, 12248 bp, Oryza sativa
cgaatccaagaatccccggctactacctccccgtcaaaggcatctccgtgtcatggagcgttcccgagacgccggcgtcgctgcccgccggcgcgctcgacctggacgcccgcactggccgcggcggcgtggtgctgagcacgacgacgccgtacacggtcatgcggcccgacgtgttccgcgcgttcgcggaggcgttcgacaccgccataatcaggaggagcaagtacacgtactccaacgtgacgcgccacccgcccgtgggacccttcaagctgtgctacaacggcgcgttcccgatgctgaagcggccggcgagcatggacattccgacgatccacctggagctggacggcgccacgggcacctggtcgtggttcaacgacaactacctggtgtttgcgccgggggcggcgttgtgcgtcggggttctcgagatgggtcccggcggcatgccggtggacggcgagccggcgatggtggtcggcgtgaagcagctggattggaacctgctggtgttcgatctggacaaaatgctgatgtggttcagtggggatctggcctttcgcttggcgggttgttcatattcttctcaaatcgggttataagatcgacctgatcagtgatcagtcactccgtcacggcctgaacgacgagttgtatgcttcagttcagaaactagtgttgaataagaatccgacagacttgatagtgcttcattatcgaagtgctacgaattgttttgctgggcatagtgatatcttggaaactaccattttacttaatcatgagtaaaaattttggggctgctatataccggtataccgttcggacagtataggcctataagcaatttagccggacaattccttccgttcaattagtatgtcagttatcgtgtctcaaaaggtgtgtcatgtcaccccatcgtttgtcattctgtccacgtgcatacgcaaaaaatcttcatgtgatagctaaactagttcagtatagcaagtagtagcctacctagctaccaggtgtcaaatctgatactaggtaggtatcacatctgataccgggtgagcatcaattctattatcaggtatcacgtctgataccgagtgggtgccatgcctcataacaggcatcacacatgtctgatatcgagtgggtgccatgcctcataacaagcatcgtgtgtgatatcggttggtatcaagtaccatataactggatggccaagtatcatatttgatacatggtgggatcggtcttgataaatgatacctggtggttatcaagtcctgatatctaaccggtatcatgtgtttctgccacgtatcaggtgatacttgcgaggtatcagatgatacctatcaggcatcatgcgattcttaccacgtggtgggtgatgcttgcgatgtatcaggtcctgatacctagccggtatcgggtgacacctatcaggtatcatgcgattctaccatgtatcaggtgatacttgtgatgtatcagatgatacctatcaggtatcatgtgattcttaccacgtggtgggtgatgcttgcgatgtatcaggtcctgatacttatcaggtatcatgcgattataccacgtatcaggtgatacttgcgaggtatcagatgatacctatgaggtatcatgcgattcttaccacgtggtcggtgatgcttgcgatgtatcaggtcctgatacctagccgatatcgggtgatacctatcaggtattatgcgattcttatcacgtggtgggtgatgcttgcgatgtatcacgtcctgatacctagccggtatcgggtgatatctatcaggtatcatgcgattctaccacgtatcagatgatacttgtgaggtatcagatggtacctatcatgtatcatgcgatttttaccacgtagagggtgatacttgcgaagtatcaggtcctgatacctaaccggtatcgggtgatacctatcaggtatcatgcgattctaccacgtatcaggtgatacctatcagatatcatgcgattcttatcacgtagaaggtgatacatacgaggtatcagacgatacctaccagatatcaggagccgggcactaaagcatcgtcgccgatggtcctaccgtccacgtcccgagccggagctcgtcgccggcggccacatcttccaccgtccgtgccatgtcggagctcgtcgccggcggccgcgtcctccatcatccacgccccacgccggagctcgtcgccgacggccgcatcctccaccgtcgatgccacgtcggagcttgtcactggtggccgcgtccttcgtcatccacatcccacgacggagctcgtcgccgacggtcgtgtccttcgtcatccatgtcccacgccggagctcgtcgccgatagcagcatcctccaccgtccacgccacgtcggagcttgtcacgggcggccgcttcctccgccgcctcgacgagctagccaagtacgtgctcgtcgtgctccacgccaacgacgcggcgagggcagcaccttcgcgctctacttcctcatctgtctttgcgtccgcgctgggctcctcctcccctgcgccggtgacggcgctgccggcaaggagctcgcggtcgcgcgcggggtagtgcgtcgacggtgcgggcatgggcgccgtagcgccgcggcccatgtcagccatgcgtacgtgctggagcggcactgtgccctgtacaggctgctgctgctgctcgggacgtgcatggtcaggtatcgttcctctttgaattagcaagggtcccgtccggacgggattccggtatgtagcattcccgaaaattttactgattttacttttggtgatgtggataaattttaaacgtccaattttaaatcaataaggtagttttaagttttctttacatatgtggtttctactacatattttccttgtatactaggaaatggatgttaaacttagcctaccctgtatatttcgtccaaaacgctacctattgagcgcctgatggataagaaaatattgagcatttgttccacatatcccgtgaccccctctctctcgtctctctcccacgcaagtcctcaacggcggactgagagacactactcatctcctttgtgtcgtcgagcaacgcccctgttggattggggggtgggggagggggcgtcctagcttcccgtgcagctcccggcaagatcctacggacattggcatgggcagaagcagcaagaacacaatggtccctacaagaatctggaagtagcgtgcctcctgtttgtcggcgacgatggggtgacgagggcttgggcagcagcagctacccgcctcggtggagtagaagggcactatgacatcttggtgtggatttgcaacagagaccaaaggagccaacgatcaccaaagaggaggaagaaaccagagttggaccaatacattttcatgattttttttgatgttccagccaatatatttggatgtttctgttataaaaccggcccgaaatcacatcggaaaccaaacgcggaagaaacgtcatagaagatccaaacacgatgacgacaccgaggcacgatatttgataacggagttcagccaaggcctacatctccggggcactgattacgggcgctcctccctgatccagcatatacaacgtatcagagttacaacgactcacggccggtcgatgccggcagccgctccctctcgctatgctaagtcgccatacggttacaacaggcacgcccctctatttatgagagaatctaggatagagtcgacttatactctagtcctacacctagtacaactccaagtcctaaactgtaaccgactacgtacacatattcgacacaaactctaacaaactccaccttggcgaatatgtcacgccaatccgaatctgttacttgctcgaaccttcgtgtaccaagacttgagttgatcctttttcgccgctcacgccgagctgccccgacaagcctccatcaggctcaccgtaaacaagagactcccgctatccttgtaatttcttcctcctgactccacctgcaacattgctccaccttctctcatatcaccacagtcatcttgccaagtgaattgaattcttcctagctgtcacatcatagactctccgaagaccatgttcaacttcatctaccgtcttaaatttgacttgatctaatccatggccagataaccgatgtcatcaccaaatagataaatcaaactcaccagacttgaagagaaccctttcttccttgtcgtcttatgaaccgagctaattaataaatccaacatccacgctttcccgcatccttagactgagttgtatgcttcagttcagaaccagtgttgaataagcttccggcagtcttgacagtgcttcattatcgaagtgctacgaattgttttactgggcatagagatatcatggaaagtggaaactaccattttactcaatcatgagtaaaaattttactaattttactattgtggataaattttagacgtccaattcttaatcgaatagtagttttcaagattttattacatatgtggtttccactacatattttccctgtatgtactactaggaaatggatgttaaactcggtctaccccgtatgtttcctcaaaaacgctacccatcgagcatccgatggataagaaaatactgggcattcgttccacatatcctgtgaccccttctctcatttctctcccacgcaagttctcaacggttgtcggagagatgctgctcatctccttcgtgtcgtcgagtcatggctgctgcgagcagcgcccctgttggattggggggggggggggcatccttcccgtgcagctcccggccagattctgcagacatcggcatgggcggaacctgtaggaagacagtgatccctacatgaatctgtaagtggcgcggctcatgttcgttggcgacgatggggtgacgaaggcttgggcagcagcagctacccgcctcagtggagtagaagggcattgcagcatcttggtgtggatttgcaacagagaccggaggagccaaccaccatcggagaggaggaagaaaccagatctagaccagtacattttcatgattttttatgttacagccaatatatttggatgtgtcttgggggttgaatctgtgatggatacttagatggtgtttcatatttctactttcgatttctttcatatttgtgatgtttcagcgggttgaagcttgacgtttcatccatgaaaacaaaatgtttcaatggtgtttcaactatgtttcacgatttttgtaggctgacaaattttctatttagtagtgaaacattttttttctagttgcagtgaaacatcgctcgatttttgcgctcactttgtagtcgccttcatgttttgtacttttgttgccccaaagcaaacatcctgctaggccagaaaagcttattttaggctccgtttgggaaactcaagattccgagaaactagtcggtgagaatttgtaaaaatcgggtttcttagccacttacccttgctgcactatataacgggagaaagtcgtcatataggatgtttctccatatttataaagtcctactctatataatctatctcttataatcgttcaatgtcagacaaccgtacgtgcccttgattagtgcttgctcggaccatgggtatgagatggtttcatcagggcataatccagcccaatgtttataacctaagactccagaaccgagccggattgtcttggatcgatccaaacgggcaattttcccttaccattgatctcgtgtgatgcgtaattgtgtactactgcagatagacatacagccagatccttaccagggttccctgacttaaaatccaaactgtgggtgctaatcaacagtgtacagtacagtactcgctcttatattcatttaaaaggccatcgtcaactccttgatatgcatgatggatcggtggcatcttgaccctacaaatattgaccaaaaactaattgaactactactcctgaagtagcagtacaaatacattcaactatgcccatttctgtcgccagccaatcaccttcccaatatatccatcagattttctgaatacacaacatgcctaacactccagccattgtgtcactggttctgttgctatcatgcttggtggcgaccggtgatcagcatgcaacaccagcagcgtacaagctacccctaatcgtccctctcatcagggacaccaacacctccctctacacgatcgccatcaagaaagacgatgcccctctcgtcgtcgacctcgccggcgctctcgtctggtcgacgtgccggtcgtcgacgcacgccacggtgtcgtgcctgtccggcgcgtgcggcgcggccaaccagcagcagccgcgtcgctgccggtacgtcgacggcggctggttctggtccggccgcgaggcggggtcgcgctgcgcctgcaccgcccacccgttcaacccggtcaccggtgagtgctccaccggcgatctcaccagtttcgccatgtcggctaataccaccagcagcggcaccaaactgctgtgcccggaggcgttcgccaccgtcggcgcgtgcgcgccagagcggctgcttggcgtcgctccccgccggcgccaccggcgtcccggggttctcccggcggccgctctcgctgccgtcgcagctcgccgcgcagcgcagcttcggcaacaagttcgccctgtgcctccccggattcgccgcgttcggcgacacgccggtgtacatcgggacggagagtctaggcatcgtcaactacacggaaagcctcccgtacaccccgctcctgacgaacccaagaaaccccggctactacctccccgtcaaaggcatcacggtgagctggtacgggcggaacgtcccggcgtccctgcaagccggcgcgctcgacatgtacgcccgcacgggccgcggcggcgtcgttctgagcaccacgacgccgtacgccgtcatgcggcccgacgtgttccgcgccttcgccgaggcgttcgacgccgccatacgaggaacggattacgccaaggtggtgcgcgtgccggcggtggagcccttcaagctgtgctacgacggcgcgttcccgttccggaagcggccgccgacgtgggacgttccgacgatcgacctggagctcgccggcgccacgggcatctggaggttgttcaccgagaactacatggtgcagacgccgcgcgggatgtgcgtggggatcctcgagatggaggccggcggcggcatgccggtggacggcgagccggcgatggtgctcgggctgaagcagctggacacgaaccttctggtgttcgacctcgacaagatgttgctgtggttcagcggggagctgtcctttcgcttgacgggctgtgtgtcgcccttttgagcctggttctgaacgtctgacgtcctgaaatggcggtgtttgtttgtttttcttttaaattttgaaatatggaggtgtttgtttcagttttgtacaaatgttgaacaaactctcggcagccttcatagagtttcactgcagcactaaaatgctgttttatcataaagatgtagaaacgaagaaggtgttgacacgtaaaattacagaaggttgctgcctctgtatatctttcgatcacaagaccagacaccagagcagcatcaagttacaaaataaaacactcagctgaataaggttttgcgattgttttttcacttatgactgaaaaaatggccatccgttgaaacggataagatgtttttaatcctttcttttggcccaacccacatgtggagccctccagaagatggtgccgtgcccatgcccttacgatgcttaaactgattctccccatcaaatttggccgagtctttctcgatctcctaaaattggtttagggcttttgatccactcgatcttctctttccgtttttctaaaattggagcgaacaaaactcatgataaaaacggtaaggaagcttgccggccggccatcatcggcgacagttaaatggtgattaaatcaggccaagccgaattgaaggagaaaatcataggaaaaatgatgagcgatgagtggggaatcgatttttgtaatccattggaggaggaaacacatggatagacaaattcgacgtggtgatagaggtagggttcggcctagcgaaggaaaaacacggtgaggaaagaaaaaccgaaaactagaagcccttactgcatgcgagaaaaaaaaggggaggaagaaaatggcaaaaaaaaactggacggaccattaaaaaactgtttgaaaaaaaatgtgagaggaaagcggcgactaaaaaaaatattctagtaggtatatatacattaaatcgactctaacagataacggaccacggaaacatcttcaatctttatctacttatattatatatgatatatgatatctgttaccttctaatgcagattttttttttcaaaaaagcacaatacaaacgcagacaataagaggaaggctactttttaactccacagcgaatagtttaattcagcctacagttaactctcacaacaaagaaacacagttgcatcaccactttgcacgctcgctgcttcctgggctgccgaataagcgatcgagccattttggacctatcttgggccaaattagagcaagtacagtagcaggctataaaccagctgtaaatatattttaagaagataaataaagagagaatggcagcggactacagatttgtagccagctatagcacggactctaagacgcagtgtgtgtatgacaggtgggaccagatattaatagtgtagtatgtaactattgtatgaatgagctattagattggctatagatgaattggatctagtagttggctatactattaaacttgctcttacggtcattccttttccgtagcattggcccaaactttgagcccattaaaaagtcttacatacactaaagcctagccgagaaatacggcagttactactcctggcccagtacgagcgtgccgccatacaacatgtgccttgggcccatgcctcgggcccaccccgaccaaactccaaaacccgagaccaccaccaccactccaaactccactcgctgaactagctctcacatctcacgcaaacacacgcatctacagctactacagtacgccgcgcgccatacaaatcgtcgagcaatccgcctcgctctcgccgcccgcacccacgctcacgcacgctcgcctcaccacccacagcgcacgcggccaccaatggcgagcgcccgcgcgcgcggcgggcgagccttcttcctcctcgtactcgtgctcgtcgtactcgcggcgcccgcggccgcgctgcggacgtcggccatctccgcggcgccggagtacccgcggctccccaccgggccgggccacggcggcgggaggcacgcggcgcccgcgcccgcggcggtcctcccgccggcgccggcgctctcgccggacataatgccgctgctcccgtccccggggcccgactccgacggctccgccgaggcgccgtccgacgtcatgcccaccatcccctccagcccgagcccgcccaaccccgacgcgctcttgccggactccgcgctcgccccgttcggctccgcgcccgccgtcgccgcccagtcccgcgcgccgccgccgtcgacgacgacggcggcggcggcggcgtgggcgctccccgtggccgtggggctagtggccatgtggttggtgtagtgggcgagtggtgcaagcgacagcagctgcagctgcagttgcagccttcgggttcagtcgtgcaggaaaaaaagttggccgttggttggtcggttggctttgtattcttggcagcaaaaattgtgaagaaattgttgcttcatttcactaaatttttttagctttcgatctcctgtaaatttttctgtcaagtttacgtaattgtttctggatgggggcggctacatgctatagttttttttttctttctgttttgtaattgttgttatgaggggattacttggttcattgctgtaataaaatcagagaggataatagtctgttcctatcacttctcactcactgaaacttcagttccaattccctgttcttgtttcatgttcatgttctgcaattctgcatcaacagttgatagttgatacacgagccaattgttcttggtttgatgggcccacaagccagtcacagtggcggtgactctgcttcaagcagtaataatggtatttatgattgttttggtgttcatgttaggagtatttgatgctgattaaaccattcggtgtacaggctagggaattatttattccttctctttccagaactgcgcataacctgaaaaaagtgtggctttatgaattaataaagaacaaggaaaaaatatctaaaagagaacataataattcaccagaaagtgcagtatgcaactggaacgccattcatcgaaattctatattctctctttcctgtttctttaggttgatgatcacctcatgattaccgtaaagcttctggcgttgccactctgccaagaaattagtaactttttaagacatgatcaaactgcaggcatgtgatcttgtagtttaattcatggtaagagaagctcacgtggtctctgaacaatgcatctactaccaaagaacatcgactgttgtttctggaaaccgtctaataaaaaattggaagctcctaatcagactatcagaggatgccgttggaccagcatacttgtcaaggaaatggtttttcttttgcaatttacagtattttaacaaatagtatttgttcttaataattactagcttcctttgctctctcggagaagtttacaagataactgcatgagctaaggttaaactaatcaaagaaaagtttgaagataaggatgagatatgctatgctatgcaaagctggtggtaccaaatcaaggatcagtagaaagaccagctgtgcattgttgtcctgacatatcatggacaaatgacaaagaacaaaaatgtcctactgttctacctattcccatatcactgttccactctcaacctggcaggtcaaaaaagttgtcacccaaagtaataagttcaaatgcgtgattattaccacatttccagaggtccatttgagtctctgaatcagaaacattcagacaacaactctcacaaaatgttctgaatttaaatcaacagagctgatatttagtagtataaaacggcaatgcacgaacatgtgaagtgagaaaggaagctggtgcatagctgcaaacacaaaaagggcatccaatgataggaaaaggacatccgtgagtttgagcatgatcaagatgggatcagtcgaccatgtcttcttagccctgacctgcccagtctcttcacgtgtagtgtccatttgccattcgcctctgttactgtttaccttatgattaatctgccaataagcatctaaactaaatcactcctccggtaattgttaatggagttacagtgtcacgtactatccggctcagcatccaacgcagatgcacagtgaagtttactgctcgatgtcgaggtaaaaacaagactgaacatttgacaagacttttgggtatgagggaagctgagcagaggttcccaagaacaacaaaagagcacgaccggtgtctgaagatgctggaatggtgaaaatggtgatgtgaaagaagcatgtgagcgcgagtgtgtgtctatgagagaagattcgtgtagtgagaagaggccaatggatggagtgttagtattattaagcgaggcttgtcacgtgaatgtcctagctgctcctcatccagagatgggagggatggttggaagaatctccattgtttgcgccgtgtcgtcttggacgtcaggattggatgctgtcctgccaaactttaggggaagagagaagggagtagattaacaacatcattgagggatgaagttagtgtgcttagggggtgtttgggagagaggggctaaactcttaaaaccataagtctctagaggagagacttactccctccgtcccataatagatggtgtttttgactttttatttgtaacgtttgaccatttattttatttgaaaaattagtgcaaatataaaaaaagataagtcatatgtaaaatacttttgataataaagcaattgacaaccaaaataaataataattccaaaattttttgaataggacgaatgatcaaccattgataaata

SEQ ID NO: 72616 - DNA, 10825 bp, Oryza sativa
tatatgggcagaattttggagccacttgataattttcagtttcagaccatgggaaaaagtggtggtttcaccctgacaaacagatcattagcaaaagtagtttatatcctctcaaaaaaaaaagacaaagtagcttataaacaaattggcatagtaaacatatagtatgaacgtaccacaagagcagcttccaaagattctgaagaaatacccacttcagatgctacatcaccaacactaacctttccttgatcaattagctaaaatacagtacagaaattaatgtttctttccttggcatgggttacgtagtaaatatcagagtcctaactgagctttgccagagtagaaattacctttctaagaacaagagcaacatcagcagagtttctcataaggttcccaccaaccgagagattgtcagtatccacttccatcccttggattgctagggaatctgaacttctaacagtgtggggtaaagaggcttgctctatggtctctactttgataaggttactagagttaaagctagtggcttcatagttcatgaatttatccttgttcttgcgcgtgaatcttagttttggtacctttccagtgataaggtttgcatcttttagccttgcttctgtaggactctggtgagatgcacagttacttctctctagagaattggcatatccaatagtagaatgctttgagcaaaatgctctcagctcgacctacatggaaaacaaacaagttgaacaacagcgacctaaataaggctaatggcaaacacctgaagaaaatgatctcacattaggatacccaaattttccccatatctccatttgatgcttggactctcgtgcacatataggatgaaaaggtgttcggcatgttcctgaaaaccacatggataactagttaaaggacttaaaaaaatgtgatgctagttttaagtgccaccaaaactgacagaaaatatcaaagataattcaaatcatagaatgcttctatcctacaaaatattatatatgaacaatagtttaatatataattcactgcttactccatcttcacagctaagacttaatatgtcaactcacatgtacttagtgtcttaaaatacataattttgtaattatattgtgaactaaactttaaagcctgggttctcagtattacttattacattgttcttagcagcctttttttgaagtctgtggatatggcataagtcaattaagggtgaaattatgattaaaagcatattatgcttcctgcaatgttttttgacaaagggtcaaatacttggcaccatcacaaaaatcagagagttggaaaatattatcatatgtggcaataatatatataggcccatgccctatgtgtcattctcacatgtgatggtattttgctatttgcatatctttacgatggcgttttccaatttctcttcaaaaatggatattatggatgttcgcatacattgagaaatgtatggttttatgtatctgttcgcaaaaaatacataatgtaaaccacacttatcagaaccagaccggcctggcagtccaaaaaggaaaaaaagggaccagatcccagccagtctggcacgctgttggatcattcaagcagttagcctgacttgaacaagtaaaaccctggccaaagtggacagtttttcagtgaaccagccacaaaatgtgtgtggccccaaaagttggttcagttattaattgcaaaaaagttatacaagggtataggtataactaactaatatgcagttatccatcattaacagcagcatagtaactggttggactagaacccagttatcattttgatatgctgtcatgtaaaatgcagttacaacttacaagataacctggcatgtagagaactaaaatggatatctgtatacacatttctttttactatatatacgaaaaatatttaaataaagccaacaaaggtaacaatgtaaacccattatttattgcatgaaaaagtaccattctaccaaattcccgcatgccaaacatagaattatctttgccagcaatattccatcattgtatggtgtagcaatacttctgccacaaactacgttgagttaatgagttgagcaaagtcatccattcagatgaggattacttcctttggaaagttatcaccagaaatgagataaatggcatgtttggtagctttgctcatccttatctagcaaggtcagtggacaaggaaactgggttgccttgcttggtttggtaatggacacacaagtcagtgttccccattttttgatgaaaagacaattcagctctcctctcctagcaatgatttcattgtgcattagcaagggtagccaaggaaccaaacacacctactgcccagctattttagcaagaattttgtgctaccgtgcaacacctgatttagaattacctcctcaggtaaacctgagtgacagcatatttgcggtttttcattgaatagaccgataaagttgctacatatcttccagttcaaaggcaaatttaaaggttgcttttgaaggcccacattgaagaaaggaaaaaaaaataagcaatgactcggtcttaagaaactcgagaccgcagtagaagcatgatgcagggaaattctatgcggtggtacaaaatggaagtgtgcaagaaaaattatctgcaaaacactgattctaaataacttaaatgtatatatacatatagttcatctaactaaaatagtaaaatggagacatagggtaaaatacataccatgactacatcggacacatacaccatgcttaaccttgcaaatgctgcacaccaatttccactgattctcctggacacttccaacattagtaacaggttccattgattccatgtcttccacaagagctcccggtgtccaaaggctacaaaacaagtgcacaaatttaaggttccccccatgcgctgtttgaccaggctcccctttgacaggttttagagcgcctttctcttttgggcatagaacacaaggcatcgacaaggtgttgtccgcatctttcttcaacgactgcagtgactccaaatccttacaccaagtgcacaaccactggccatcaggcacaacatgcaaaccataacacttctggtgcacagttaccttacagcggttgcaattgagcatgctattggacaccgtactactctcccccaaacaacaaacatcacatacagaactagcctcagctcccgagcgcggtagcagaacaagctgctctaaccctgcatccacacctaaaagcttcctcttcttgttgggccgttctgaagtgagcacaaaccgttcctttgatcctagcaaccaattcagtgatgattctccctcttcttcacattttgatgatacaatgccagcactgctagtagcttgctccacttccaatggccaattctcctgttgcacaaccacctcatgtatgccctgctctacactctgctcaccgcgttccttgttaccaacgaactgtcgcacaatcacctcatgtatgccttgctcaacactttgctcacttcgctcactccgttcgctatgctccttgttactgactctttcttcaccacccagacccaagtacgagcttgtttcagccacagccacatcaaatgtctcagctgtgtccatcaattccttgccactgcccacaaatggtatgaggatgcacgaatcgagcccgccatagccgaacggaaactttggcattaacatatcaatatcatccaaattcaccggccggaaatacgcctcgaactgctcccacacgccagtcttcgcagagggctccgtggctggctgcggcgggagctccacatcagccacgtcctggggctgaatcttcttgtgcttcttccgcgcgtcgctctgccccgaccagttcacgagccgcgcgggcagcgtgggaaccctaggcgccgtcccctcgccctcgaacggcgtccgcaccgacagggccttcctggcctgcgcgtacaggtccaccccgacgcccggggcggccccctccggcaagccctcggcgcgggccatctccccgcggcggccgccgctcataaagcctcggccagggaagggggcatcgccgccgaggcccccgcggaacacggcgggggtcgggggtagggcctccggcgaggagggacggcggcggaggaccggggggcggagctagggctagggctagggcgctagggcttcgttccgcgagcccgagtattgaagagtgtctccttcgcgtctgttcttccttcgactcctttccggcccgatttttccgcgtcagtctcgctcggatccgatgggagagaggggcggggctgggagaggctcgcggcgtcaggacacgggttcggttttgcacgggaggcacgcagcatatgctctgctgctcttctcgttgggtttgttatactactactaccggcaggcacctttactcaccgtcctcttcacgctagcaataacgtgaggtatcgaagtaacttcgaaatagagtgcggtgcaagtaaaatgaaatttacattgtggtgatatttggtttaaaaacagtaataaatacgttgcggtaatgaatgagtttcaagaatctacagagtttttttagcggagaagtttcaatgaagttgacggtttaatgaactatgcatggttaagataacgattttataagggagttggtaaaggatgaagatgattgggttaggtaacatttaatttggaatatagtttcttttccacttgaccgtatatagttttgacaaaaaaaatagatgaaactttgcgagtcaattataactttttaaatggacaccttcacaaatatgccaaaataaacatgacatgtatttttatccgatctttatcaaatttatcatataacattacgagataagctccaaaatcactcacactctcttgcatgccattttgttttccagcgtgcaagcatacatgcatgcaacatagcgtttatcgtaccagtcttagtaaacgacaataattcacgtactacatttactggatatttggacattcttgtcgtttctacctttcctgctatgctcactaaggagattgtttgtcgatacaatagagcatagacaaatatttctgcatttaccggatattattgacctacagctgtaggtgtatataccaacttcatattatggtaaatattataatgttaccatattgtaaagttatgggcccatggttataagtgaatttgaccttaggtcacaaaaataatggcattaagcttgatgctaaggcccactaagttccattcactttcacctaaaaaaacacaaagataacccaacatggcatagacatgccttggctatggaccatataagggtttgctttttcacccacgataattgatgtgtttttctcatttatccctgatttatgtggcattgtaatttgaagaaaatcaagtgtcctaagtaagaaaacatttataaaacacgtaatttgataagtttgcacttgataaaacatattgtaacttgaataaaatcaagtgtcctagtaagaaaaccttacctttataaaactagtttctaagtgtcctagtgtgggcaaataggatccgaaaaacttggtgttcggagatggggtcaaaagctatgatcgcatattttagcactaaacaagctcatacacacttgatttacccaggttttcgcgcctctcgagagatgatagttatattcttgctttcttgattaatatctggacaactttttgcaccggaggtgtgttagaactggctaagtccagagctcgtacaacttctacgtgttgtgttcttgtgtatctaggagagttgaacctttcactcggtgatctatctggtgcttataagttatatactctcccacaatctacctaatcaccatgggataactgacaaaggtactatagtcatacatcattacctacaccgtacccgctatcataccatccaccacttataattcttccatgctacaagatgccaccttccacaggtctaccatagaagtgactaggcctccccctgacggtatagcttggtcagatggagagaaaggagacatgaggggtgaggcgtgatacaccaaatccctacattaaatacctttgacttgcggtgagcatgcctaattaatgtggaatgatgggagcgagctattgcacgcttcatttgtacctgttgttagagcgtggtcatgtgatcccccaccgagggcgcccacgcgaccaaccattcgcgtcctcgagcaatcctcccgcgaatgaccatgagatggacgcattggcccctgaactgtcgcctccgagcaatcttcccgtgaatggtctcgagctaggcgcgttgccacatactagacccgagcaaccttcccatggctagcctctagcgggtcgacaaccacacgtcatttcctagccagtccaacctaccaactagttttctagtcaccctttcacgcagtgttatccgtacgctatcttgtgacctgaggaaaattgtaccgatatcttagcttccagcctagtcgtagggatatcaaggaaaattatactcattactttctaaaatcaagtgttctagtagtagtatagatgatgagaggtataaagtcatgtgtataccagattcacttcctccaatgtatctagccttttcaatgtactaatgcacacctaacagaaatggtgaaatatacacaccattcaccattacaaagaggatggagattggagaataaagaggcccaagctacaaactacacagtgctgtcaaatagtttttagggtgcgtttagttctttaggcgtaaagtttttgaagtatacggatgcacatttaaagtattaaacgtagactaataacaaaacaaattacagattccgcctgtaaaatgtgagacaaatttattaagcctaattaatctatcattagcaaatgtttactgtagcaccacattgtcaaatcatgacgtaattagacttaaaagatttgtctcgcaatttacatgtaaaccgtacaattggtttttttatacatttaatgcctcatatatgtggccaaatatttaatgtgacgttttttgctaatttttttttatctatgcaaggccttatttcaaaaggacagccagcagaaaaagcgactcacagcacggcgaatatactagtagatgcagatcagatcatcagagacgacggccacggccaaatcgggttgacgcgcacggcgcacacacactctcccccgaaggcctgaaaaccatcaggcatccgtatacagagcgcacagtgtgcagccagatcgagcattccaatttccaagctctctccccacagaggccgaggccgcaagcgcatccagagcgcacccacgccacgccgcgccgcaccgtgccgtgccgcgccgcgccgcgcggatgccatccaagcggccgtcccagagcgccatggacgcgggcgccgcgcccgcctcgccatcccctcccaggtcgtcgaagaagcgctcgtcccgccccaagccccgcgcgggcgacgccgcgcgccacccggcccccaaccctagcccgccccccgccgccgccgcgcccgcctcctcccgcagccgcgagcgcgagcgcaagcgcaggcagcgcggcgcgttcgcggaccccgccgcgggaccgcgcccgccgccggggggcagcacgggggcgccgtccagaagctctggggcgacgccgacgaggtcgcgctcctcgccggcgccgccgccttccgcgcgcgcgccggccacgtcccgcgcctcccggacatgggcgcgctcttcgactccatcaggggctccctctccccgcacatcgaccaggccaaggtgtactacaagctgaagcggctcaagggcaagtacctgcacgcggcgcccggcgcgtccgcgggaccgcacgaacgccgcgtgcgcgacctctgcgcgagcgtctggggcgccgacctcgagccccttgctgagggcgacgacgaaagggccgccgccgccgccgccgccgccgccgccgaccagccgcgcactgtcccggacgccgccgccatgctgcctgtgctgactgagatgcttgatgagtactggaagacggatgggcgagcgctgtccagtgtgtccctggcgaaggggttgtcactgctagggacagaggaagcaagattcatcgagggcaagtggaggaggcagcttgattcagagatacaaacgcagatgcggcgacatgatctggccaaggaggtctacgccttgctcatggacgccatcaaggccctcgggccttagctcgggtatgactgtcatctacacgagtaatttatccaaactctgccatttccttccctagtccaacttctcgctggagaattcgttaacgcattgctcgttcgttcaattacagtagaacttatacaatctattactcggcaattgattgttcttgctgactgttggggtattttaccaaaaaggataacacgattgtgtggtctgtcgtctgttcacaaagtagcaaagaagctatttttctccatcagcacaccacagatcgaagtattaagcaattatgcttcccatagcatgatggaagtaacagtcttataatcaggaagcaagcaatatcagcttgattttggtttctgtggtcaaaaaagcctagagaatttcatgtttcatacttgctttacatattctttgcatcaaccttgagcaaagccagaaatcaaccatgccaatcctaaatggctgcaacaccccagtttttatgcactactagtatgtatattgtgtctctgactggatagtttggattttggagatggaatagtagcgtgaaaggagaatttggagatgacacacaataaattatgcataacttcatacacatctaataaccaaatacagcacatgctataagccatatgatgatgatgatctcaattaagttgtcaaaaccaacaaccaagccaacagagtatctttgctaatacttttttccttgaggtgtatcagaaaatgaatttgtgagaggtcacaaacccaggtttttaagctacttcaaataaaactgtttgaatttagaaaaaacttctccaataaagtatgtgattgccaaatcaagtccatggcatagagaattctgccatgtattttcttatgttggtctcttggctttggcaggagtaaacacataagccgtacagttgtccaaaaaaaaaagggtaaaaagagagaagaagaaatgaccccactaagatatggactagcaataattgaccccacagggccacaggatatattttctggctctgctacttggctatctcatgggcacctgaaagaccagatatagatatgtgcacctgaaattttgaattctgcttggttagggaaacaaaattatcagagagatacatctacgaaatattagacacgagctattacatatgagattgatgactaagagataacatatttgaagtaacctatagtgatcgagaattagatgaggaaggtcatatactaattagtggagtagtacataacagggtgttgaaaggaacatttaagtactgagcaccaaggtcctttaataggcatgctgcatgcagctgaatgcttcgtttgacacctatagcaaagttgattattatttcgtctcttcagagcgttagagcactacctcagttttctttttaatggaagaaccggctattgatttttgccagcctcattgccaaactttattaacgatctgatcagctttgtttaacatcatggagacgtgatgcattatatctatatgactatatctacatatatcttcattcataggatgtactgtgtttcccttttttgctgaatttttgttcttatttgatagaattatagaatgtttgatgtttaggcatatctgttgggtatcttttatatagcgaagtacctggtgcttgctgggtataagggtattactgcggtagtcaaatttgttgagctcagcagctcaatgcagcttttctatgtttggtgcactaccgttgaaaagaatcttatcaaacttcattgctctcaggatctcaatttaccttatttgcagtcagtcacattgttcacaaactgaactgacacttaccttgcagtcagtcacattgttcacaaactgaactgacacttaccaacgtccgttttgcaggtacaagatggtggtttagatagagctgggtctgggtacatatatctgcaatgccttttgtattggctggtcgaagcattgtactcggttgatgattgacgaggccagggtacatatatctgcaatgccttttgtattggctggtcgaagcattgtactcggttgatgattgacgaggccagggtacatatatctgcaatgccttttgtattggctggtcgaagcattgtactcggttgatgattgacgaggccaagaatcaagtggaactcattttcgactgtatcaaataatttaggttcataacggttgctttggccgttctcccgtcagatttagatgtgaaaatgatttagtggcttaacctgtttgtaaatcgtatgctaacttctgtatctgtcatattagtgcattttcaagtgtaaggggtcagcatttcgatatttactacatggtgtggtaaaaaacaattaggccatcttggttaatgattacaatgttgaaactatatttgcttatcattcaacttctaaactgattgttcactttgta

SEQ ID NO: 72617 - DNA, 3718 bp, Oryza sativa
gtcgttgccgcctcctcctctgcctcgtgggcctcgtgggctcgtcgccgcccgcgcgccgcccctccccgccgcccactcgcagcttctcccccaccgccgccgcgtcgcctctcgccgacaccctcctcctcccgccagctaagtcagagaagggagagagataaagaagggagataagaggggaaaagagagagaagaggtgggttatatgacagcatgacatgtgggtcccactctgacttagccgtcacgtaagacaaaaccaggatcaaaactacctaaggatctattgtgaccggttttgatagttgagggatgctggatacctgattttacggttgggggacgattttgtaactcgatgacaagttgagggaccttcggtgcactttttcctaatttggcgtcaacagggccctgcaccgcggcctacgggactgtctatccatttgtcgggtgatttctaaccaaaaattacccagattttttttactcttagatttacatctaacggactacaaaagaatatacaaatacatatttacttacacattatttttatcaaaattacagtgcacttatatgccatatcaactgaatttacaaatgtaattttaggtatataggacagtaattttatattttaaagaaaataacaaatatatatttacttacatattatttttattaaaattacagtgcacttacatgccatatcaactgaatttacaaatgtaattttagttatgtatgactgtaactttatatttcacgacgacgacgagagtggccgtactgccggcggccagctcaatcagaggccaccttggcaccgtgcttctccatcatcacgcgcgcgggggtagctaggtaacacaggccgacgtgccagccggccggcgagctgcatggaacatcgatcttgcaaattgccgctcgcatcgcaagctgcatggaggccaaaacaaagtgtcaaatgccagaaaaaaatcacacggagatggatagcaaaatcgttttcatataaaaatgagattgcgactctttgagtctcctcctgctaccgaggatgtaacactcactctccttatgcaatattaattcaagtgttatataaaaagcttggagaatccatccccgtgtccctggaaaagccaacaccaacctttcaacgggcccaaatgttgctcctgcactaattaatcactttaattacagctacgcagagcattttggctaacttgaactcgtttaagaataaatctaaagcaaaaaaaagtcacctgtcactcttgatgtgtcattgtacagctggaagtcagacactgcgagctctcttcagaaaatgtatttgcacggtcaactctttgatgcacattatatggactctgctgaaagcttgaaattgcaacaaattactgctttgattgataaggcctggtttatggctagcttctcagattgggacaatgcttacatggatccttgtgtgtgctgatccaattaggcaaatactgagccaaagtactagcatcttctttaattttaagttaagtcaaacttcattatggcatctggggcaatagcaacatgccaacttgttaatttccataccaaaccatgcatgatggaaggaaagcatcagtgccaagtaaccatgcaattcacacttctgaatccatcatacattcattgtattgacacttttaaaaaaagagagatttgctctggtacgacaaaaagtaactcgaggtaccgatacctcatgatgctaaatcgttttcgatcgttggatctaacaatgcacatcatgtccagctagattcaacgataagaaacgatttggtaccgtgaggtaccggtacctcgagatactttttgttgaattggagcaaatttctttaaaaaatacctgcaggtgctctagttcaactgaagggccagatttagcaatatctgagtccttcaaataaattcatcaactaacaaacttcaaccgaagctatatataaacaaaatcaaaaaccgtgatagaataacggtatatatttgaccagaacatcgaaaacgaaacagggaaatgtacaaaattggaaagaaaaagggtgaaataacttatggaacataccaaaggttgggggtgttgacatatccacacaaattaaactataatctgaagacctccaactccaagttgtcaagacaaataaccgagcacgcgagcgcggttcatatgatgtgtatgggaattgggatgctgaaaacaaatgcaactggacacatatctgcaacttgtaaataacttttatttcttttaatggaaaaaatgtgcctctcgcgtattccggaaaagaacattctgtcctatacatgacatcctgatatgttgtaaacatgataaataactggtaagttgcctgaaatctctatcaaggttaaagtcggccgaagaattgcagggagacagatgaactgatgagtaagagacagcaaagacctgatgaacacaagagggtcatatgtccccttgctgtcagtgtcagggttggcatatttgcaagccggtgtgcaaagtcagattgataacgcatgcaatggccgttggatcgctgcaaaagatgtaggttagatagaaccgaagccgtgaacatgatactagtagctaacaacaacttttgttgttgatcctgacacgccgttgctttgcttcaggccgtcatgaaaaaaaaccagtgcatatctcatggcaagaagaagtgcaggttgtgaactgaaactgcaaacatgaagagaaaatacagaagtttatgaagaagctcccatcaatccaagcaaagttttttttttcttgttatttaatagaacaaagttacaatgccagagtaaacagtgctgagccacaattcttggaatctcattttactctgaacactgaaggattctgtggacagatacagaacataacataacagaacagaacagaaaaggaagagaaattaattaatcggcaagcaacagatcgattctgcgcacgcatctgatgggatattctgatccttggtggatcccatgggataaagggcagtcttctccggagatgcggcgccgaggttatctcctttatcaattcatttcagcttaatttaaacggttctttgctttcctgtaatatacatgcaatgtagtttcagagatcagagtcgagactgtcaacgctagctagctgcctctaattttgttgttttaaattcagaccaataatgcacccattgttaattcagaaagaaatcggtaagcccagagagttcagacttcagagagctgacagcgtgttcaggccgttcgattttggtgaggccattgcaccagcacgaatcacgaggcagatattacaacttgagctctctataaatagccccagcgatgcgcgatccaaagcaagcaacagcagcagaagtgcacttttgcattctatttccaatcaatccaagaggctagagctagcggccaagatcatcgtcaccggcggcatggactcgtcgacggtgggcgctccggggagctcgctgcacggcgtgacggggcgcgagccggcgttcgcgttctcgacggaggtgggcggcgaggacgcggcggcggcgagcaagttcgacttgccggtggactcggagcacaaggcgaagacgatcaggttgctgtcgttcgcgaacccgca

SEQ ID NO: 72618 - DNA, 7399 bp, Oryza sativa
tgttactcgcagccaacactgtcgccagcccactgctggcagggaatccggcagtgataggccccacgaaccgatagtgttagccggttttggggctattggtgttggtgttaccgaatggaatggtggcttatatagtcctaatttccaatatacatgagatttataacatagtcagatttagtccctatatttgtaggggtattccctcaaaaaaaaatatttgtatgggtagcactagatgctgcattttgttcatctgaatacgtgaatggaagtcaattattaaggccgtgatgtaccaatgagccttgctagaattgcattgggtgggttaaggtatgtgctgacaaagtaaaagttctaatgattttttatggcgtttttcaggtgttggtgaaatatttggacaggagtgtaagaaacgtggcatgatggttaaggttcttggaaacttgatagcgatgtccccaccactgataataacccgtgaagaaattgataaagtaattaagaacaaatcacagcataacctttctccctcttttctggttgtagatgaaagcaacgctgttatgtcatgactcatagtactctattgcttttcagctggtgagcatatatggagaagctctgaaggcaacagaggaaagagtggcagagctaaaatccaagaagaattagtcaacatatgtcatctatggcaatggcggcaaaggttgaaggcaatgatgtggtccctgcaccgaataaattccactggtgcttgttgttcgataatttgttgaaatattactgatgttgtgttaaaagacaattattagctttccactaaatctcggagtacttgttctttctgatagtacgaaatcgtactgccacaccttaagtacattatgtgtaacccgcagcggcacccggagacgcgccgatgcaggggaggcacatccccccctcccggcgcgcgcgcggaacaatcacccgggagatagcctggtatcataaacggcactgttcttgcttcatgttgatgtagattagcgacgctccaatacataaacgagtggcgttaatctcgacaaagagacaagagagagggcaccacggatgaacgacatattgtcatcttggcacggcggagaggaaacatcacggatggacagcatcacatcaccgttggtgtagcggggagaaggcatcacagacggatagcatctcatcatgttggtgtagcgaaaatgggtgtcacagacggacggcatctatctcagcgtgacagagaggagacgtcacggatggacggcaccaatcttggcatgacgaagagagagtgcaccatggactgatggtatggctactccggggtgacgaagagaaggcctcactggcggctggaatcgatctcgacaaagacttgcgagtggtgccaacagattggttggcacggcgactccggcatgatggagagagtgcacctgttgataaaaaaacacacactgatctgagagatttactttactctagtgcaggttcaaagattaatttgctttcgggttcagggtgtgccagttgatttgatcttacaaccaacaaaaaaacaaagaaaacaaagttaaatctataaacgatagccgatcggacggattgccaatgacgtatcgtttaatattaagacgatgtatcatgcatcagatcggcagtgaagtatataacaaagaaataattagatctacttgatcggctaaagatatcaataatatacaatctatgcttcgaaatatgtttaaaccaagtgattgggatagatcggacagtacgccgagacagtataaatcacttatgattaaaagtactttagaacaaagattatatatattcatagcatagccgatattccttattttttaattcaaatttcagctatttctaaattgtacttttatatggactatgtttttctttttctccgattaatatgaaaatttttatatgccgagagcgaatgtggagactcatttttctattactctaataagttaatagatagatttgacggtctcacttacacggtacactgcatgcatgcagtacgtactgatctcccagttcctccttggtttgccctcatacatgcatacgcatatatatattaaccaaacatgcatgtgtatatagctgggcacacacatatttgcatgcctcatgcatcacacgtaagccaacaaactagctagtttcacatattaatacatgtggctgtcattttgcttgttttggccaacatccatattctctatttgaacaagatagcaaaatgccctcaaacaacgagtgctccggcgagatcaatgatgggcctgtttgcatcataatttggcgggaaaaagtacaccgaagttccctcaacttgtcatcgagttacaaaatcatcccccaaccgtaaaaccaagtatctagcatccctcaactatcaaaacaggccacaataggttcttcggtggttttgaccccggttttatcctacgtgggccccacatgtcaggctgccacatcagcttctctctccctctctttccccctcttctctcccttcctcatctctctctctcccttctctgactcagccagcgggaggaggagggcgtcagcggccggtgaggggcgacgcggcggcggtgatggcggcggcgggcgacgcagcggtggtggggggagaagctgcgggtgggcggcgaggagcagcgcgcgggcggcggggggaggagtggcgcgcgggctcccccgtctgcccctgcccacgaggctcacgtcgtacaagtccttcccgtcggcactgcccagcgtgaactcggcgagggtgacgggcggcgcgccaccgagggagcagctcacaacgccgccgaagtcccccgtggcacaggcgagggacgcggtgccggagggtgcacagtccgtgcgcgcccacaagcggccggaccaaccatccggggctgggaacgagacattggcaccgagcgacagctcgaagccgccacccccgatggccaccgcggtgtttccggacaaggtggtcggccagacggtgtaggtgcagttgttgcgcagcgtgaagaccgtcgtgccagctgactcagcgccgaactgcagctgtgaccataggaaccctacattgagacacaacattgttgaagaatgagtcgggtgcaagtggctgggcgttcgacagcagcggctgtggtggtggtgaccacgactgcggtcaccggaggcatgacggcctcggacggctagccgagggcgtgggaaacagctgcttctggccggcacggcatcgttcgatgaaggggtcggagactggcttggcacagagaggcgtagccgatggcagcggaggccggctcggcgcgagaggcgcgggcggcggagatggaggccggcttggcgcgagaggcgtggccggcagtggaggaggcgacctaggtgagaggaggagctgccggtggatatggcgtggtcttcggcgcacgaaggctggccggcgggggacgtcggtgcaggggtcccacatgtcggcagagcttgtgtggtggtggcgcatcggtgcgtcagccgtggattcgcagccggtgagcggcgggtgaaaacccagtgcggccttggccgaaccgacaacgatcctcctgagggtgttgttgtgctgtctcacccctcaagggtgatagccgggcgaaagcccagtcttggctcttttgagtcccgacggacgggcggtggtttttccgtcgcttctcttcttgaagacgttgttttggcatcccctagggggcgatctcgtctgtgtccctttgttggtctaggtgacggtcggtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaagtatactctctgaaattttctcgaatttttcgaagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaagattttttttaatttgctaaatctcaatataaaattgggcgagataaaattttgttaaatacttctcttgaatctttagttcctagatttttctggatttatttgagccaagaaagtatttttaataaatggaattgcatttcatgaataatttaaattgaaaaaggtttttaaaaagtctcttttggctttgggccgaaagccggcccaaaacctctctctttctctctccctccccggcccagtcggcccagcccgtcgtcgcttccttctctctcggtgccgctgacaggtggggcctacctgttagggctgtcttcctcctccagccgtcgcctggccgaaccctagccgagctgcgccgccgccgcttcccttccaaattccgccgcccctctctatttccggtcaaattgattgagggcaaatgatccttgagatctcctcttcctttcctcttttggaatcatcgcctaattcggtttggaaacttgtggattcgatctcgaatcggattcatctctctcccctaaccctagactttccttctcgtcgccggtcgccgtgggccttcgccgccgccttccaacccctatataaggatccccaagctctcctctacccgccgccaccctcgccttcgtctctcgccgtcggtagcgccctagcgccgtgtaacctcgagccgccgtcgttgccgccgctccagccgtgcttcgccatcgtttcagtcgtcgccgtcgctcgggaaggtcgccatcgtggtcgccgtcgcgtcgccgtcctcgtccgccccttcgccgtcgctgtagaccgccggagcatcgccgtcgtcgtcaagccgaaggactccgccgccttttcctcgacgccgccgccgtccgttcatcttccgccgcttctttggtcatcggtgagttcgccgcgtcgctctctacgtgctggtgccctccgttcgtgccgtagtgccgtcgttcgccggcgagcaagtgcgcccgagccgccgccggaggtgacatcaccgctgacgtcgtcgtcatcgactctcgtggcccggtcgtggaccgttcgatctcggccgtccgttttggataggatcgatctcggccgttcgttcccgtgagccgccgccgtgcacccggttcaccgcaaaccctagccgatgacgcaataattccctttttcttttcaaaaataattcattattgcgtcataattcaattaaaatccatataagtgttttaacccgatttaatctttaaaaattcataactaattcattgtaactcagtttaatgtagttcaagttacaaaagttgtgtaaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttactttcgaatgtcactgggtggtgtgaatctattcctttgttatggcctgtttgcattgattactttattacttgataccttgggttattataacttgactagttgagctttatatattggtttagctagatattagatatgattgcttagccatgcttagaaatattagcacactattgggataacttatgactcactattatttaatgatggcttaatgatagttcacgatggtcaatcgtgattggttaattaattacttgccaactcaaacttgataatggtgggttgtgagcacatggttttgagaatcgtgctcatggcaattaaggaccggttcgcgagctactgttgtgaaatattaaccgtgccaaccacaagccagcgtgggcaacggctttaccttttgtataacatgattcattgcggagcaccagactgagaagtggcggagataagcccacggaggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgagcagcatgggcgtgttgttcagtgttgattaaaattaatgattaaagtactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataattaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaattttcgggcgtgacagtcggtcacgcttagcggcggtcggtcacacttagcggcggccgctccggtgctagccttctcttggacgcttgtgttggcgatgtcggtgtgtgagtggtggtattcttttttttccctggttacgatcctccagggttgtaatctttat

SEQ ID NO: 72619 - DNA, 12073 bp, Oryza sativa
cagacataatattgattctcctgtgaaataccagaaaaaatcccaaactgtttatttgctaatggaatcaatgggaggccattcatgcatttgccgatattaccactgtccagatcagcaaggcaatattccaataatattagcttctgagatttttctaatgtaccaagattttcaaaatccttgaggaaatgtcgcactgtagcaggagttactattttgagcatatacttcgaatggaacttaggaaacatatcagcaatcgcacctggtagacgaacgacaggcatgcctaacatcacaagagcctcactgagatcatcacttcttgaaaatccctcgtcatgaagcaaactctcagctggtgttatccaagtcccacctttgatctccgagtgaaatactggagaggtgtaaataaatttacagatttgttccacgagaatactccagggctcctcgtacaaaccagttggccataaggaataatatgatattttggagtccaaaactgtacgcaactgtagcagcagttctctgaacaaaggagcaacaacatcttctaacaataacatattccagtcagagcgaagcttaccacccctgtccatatcagctccataccaaatgtcacgtcggttggatgatacttcaaagtaaccattcacatgcacagataatcctgtctttactggcaaaggaagaaaacagaatgcgcggccttgtctgagaataacttcctgcaaattcagtgattactaattaccatagagtaaccacagcaaatgctaaggtgtaaaaaacacactgaaatgatgcaccacgttctgaagaacgtctgatatagcatgaagtccattagataacataaatcaaacacacattttttaagtcaaaggtattataatcaattaagttatgcagtgtacaaagtttgttcaaccagaaaaaaaaatcacatcaataaccatggtcatattgttaatgattattttaaaaatattcagcatcagataacaataggcaacgccctactgttgctaaaaaattggtgataatagccataataaagagaactgcaaaacgaactagatattacctcaggtcccacgttggagatgcaagcagcaacagaagcccaaggtagtaggtgaagatcataatccttggcagcagttgttgcaaaaataccaattttacttaatgcagatgccattccctgtacaataaaataggtatagctcttcttctcaaacttctcacccaaaaatgactttgatacaaaatccattgaaaaggaatctatctttttctcagaggactcagcagcagtgccagaaaacctgacaagggcttgtcgatgccagcgcaaattgtcatgctgtgaccctatggagcaagagtacactatctttggttcactcataccagattcccatacatacatttcaagtgacagcacatttttaaggaaaagtaaattatatacagcttcttcgtaaagttgagcaaacagagataagatatcatcttctgtgtacacttgtctcgataaccgactaagagatgcttgctcagcagtccttaaaggaaagcgaaacaaagttccctgaaatggtgctttcatgtcacaaccaaatgcacaatagggtgaaagctggtcgttgtatagtgtaattgctgaagaactgacaaaatctatacgttttccaggatttgcagctgacacattcggaagataagcaccctggggatcaaacaggacaatgtacttgccactcacaaatgatggcaagtcagtcaagtggtacaccgagttaaaaccaaccctgcggaaacagaaatcgtgagttatcgctcacagcaaaactaaataaataaataaaatcatgcgctattacagggtgaacattaaacagtgaaacataaccagttaagaacaaaggtaagtatctgttgaatcattagtggcatgtctgacaattccagggtgcttgttcaaaataaacttaggagcctagacattgatatattcactacccaaacccatcaatacctaaaacattataacggggatgacatcagaacacaatagcatagatcaggaactaaataagcgggacaccacggcgacattgatatattctataccaaacccatcattaatacctaaaacattataactgggatggcatcagaacaacaaataagcgggacgtcgcagcgacattgatatattcactacccaaaaccatggatacctaaaacattataacggggaaggcatcagaacacaatagcattgatcaggaacaaataagcgggtcgtcacgccgattttactaccaatgaagcttagcattgcaaattacagctcgaacaagcttgagagagagaaggggggcgcacccgaagcggccggtcttccagacctgggacaccttcctgctgtccccgatgcgggagatactggcgaagtcctcgtcggtgaagacggcgtcgttgtaggcgagcaacgccgggccctgccattgcgcgagggcgggcgcgagcagcgagcctgcgccgtgcgcgcggcggtcgaggcagaggcggacgcgggacgcccccgcgtcgtcggcgttctggatgagctcccgcagcgcggtggtgccctccgggtagttggcgagcacctcgcggatgcgccgcgtgaggtccacccgctgcccgaagtcctcgagcagcatcccgccgggatccatgggcgaggaggcgatcgaagcgaagctaccgtgccattggaagcgcgaggaggggaggaggaggaggctagggtttgggaggggagtaggcgaggattttttgggcgagggagaaggggtgggaattcgcggatttgggcgtgagcgctcgtaattttgcctccgccctcgctgctgctgctgcggctgcgggcgttggttggagattttgactcctccgccttttcgcggaggcttcgtcgtcgactcgttcgctcgccttctccttcctcttcaagattgcgcgaaccggacgccggaagggactcccggcacctgccgctgtctctgccgtgtggggcccacgtttggtgcctcctttccataacatttttttgatttgggtgctgctctgttgggcctttaatagtgaaacggcccaatgttgagcgctaactgggcccacgattcatcgtagatatgggccgatatggggctgcccggctggtgcggcagagcagcccatttaggctgtgttcgtagctccatgttgataataactaatccctccgtaaatagggtggctcgttagagtataattaattaattattaactaaaacctcgaacaatataataatatatattttttcaagcaggtttactattcgagtatagattattgttgtttagaaagtttgtgcatgaaaaaagaagaaagcacaagttgagaaagagggaaaacaaactcagcctttcgccatagaggcctaaccaaagcaggtacagactataagctagctataaacacatattgagaagataaatgatgagagataagagcagcgagctgcagatttgtagccagttacggcacatactacaagacgtaatgtgtgtatgacatgtgggatctaatattacttatgtagtatatgtttataggaaactattatatgaatttgatattaaactaactatagatgatttgaagatagtagttggctatactatcaaacttgctctcacaccacggatgaactaaagagtagggtgattactccgattagttgtcctaactgctgaccatcagtcttatcttttggcttatgcttatgtttataagccaaaatttgaatttccagccttaaatttgtagtttattttgggattttttcatcgtagtttattttccaacctttgcttttagattactaagaacacatatatataaaagttttatttacaaaatattttctgtttgtaaatacgttgtttcgcttattccaccaataagcgaaatgatacagtcctatggcagacagccgtagcagcagcagtagccaaagcagtcgggtcatagcaatttttttgttaaaaaaatagttaaaacccagcctttatatgcaaagagatagatgtagctgagttgtagcaatagcagctgatggtttattttcaatttaattaagttggtccttgtatactcattttattccaatatatagttagctttagttttcaacacgagtattaagaatagatccaaaaagacttagtttccttgagtgggtgaaattatagagttatactagttgaagatataataaaacaaagagttaatatggtaagtataatttagtggggaaaatcaccttttactaataaagtttaaactctaagagttattatattttataaggtatggagtaaccatttatgtcaataatgctggtggattatttcctatttaaaaccatttcagtaattatcgtatgaatggttggttttttttatgaaaagattagctcctactctcttttgtagaaaaaaagtggttttgcatttttttttaaagtcaataaaacgtagctttggtcatttcactcttttgcgtaaatataagatactcaggagcacgcaaaacgataaaactcattagcatatgattaattaagtattaattattataaatttaaaaatggattaatttgatttttaaaaaaacaacttctaaaaaaacttttttataaaaacacactatttaaccgtttgaaaatcgtgctaacagaaaataagtaagttgaagtttcgagttgagaaaaaagaactaggccttacacaagggctaacagcctcatcttttaacccatgcttatccttataagccaaaatgtgaattttcaatcttaaatttgaagttgattgtggagttttttttatcgtagtttatttttccagtctttgcttttatatcgctaaaaaaacgtatataaaatttttatttataaattattttctgtttgtaaaaatactactttacttattccgtcaataagtggaacgatagagtactaacactattatgaaagctttgattgtaacaaacctggttacgccattttttatgtccaagacatttactattccaaaaaccgtaactatggtcaaaatcaatttatattcactgcacggatttacagacgagatgtcaggcggagtatattccattccagggtccgtttattccattccacaagtcacaagttacagcttcgtgataattgttgttttcctgggcgcgagtagatgcagcctccgctggttgttggcgcgcggacgcggcgtgaccgcgtgagtcgcggcgttttcaagcccaatgatcgctgatgcgagcaatctgaccgtcttctgagttcagatatagaatcgccacaagtggagtagacgatggctcagacatgggcgccacgcacaactagcacacgtagcacaccacaccacacagcccataggtagatgtgatgtggctgcttctgccgtttgctttgctctgcaatcctgcatgctctcccaggccggatcgcgtgccatctgcaaagccaccaactttgcctttgcctgctgctagtactagttgtactactgtgatctgaacatggagctttgcactttttcttaagaagatatcaaatcatacagctagtgacaattaacaaatcagattgtgatttgtgcaatcgatccatatcgaggtcattaggaggccagagacgctgcaatttggtgcttgtagttggagaggaaatcaggaaactgaactggcacctaacagcggcactgatacagcagcagcagcatggatactgcaggcgatgaggcgtggctgcatgttttgcgaggaccgaacgaacgatatggattgcctcgtttcaatatccatcaaaaaaaaaaaaacaagatagcaaccattccatacctgtcgctccagacaaacagtggctaccaccaaacctgtcaaaactaaaatgataatgagaagtccgcaataacttcgtcaattttaacctgtgacaacacatcaagtatttgtaaaaatagagtgtgcgtgtttgtttataggatgagtatgcttgtgctgtgagcgcttacgtttacatcgtgttttttttaaaaaaaataatcgctctgttcttttcaaatttgcagcccgtgtcttttgtacgtcaggatcacatcagtaagtgaaactgggtagtagctgatgacaaaactctctgaaccaaagttgttgggaggatttcatcaaagaatggggccaccgttttctcctcatgttgcatcacctctcttaccttgacaaaggaaacaacgtcaccgtcttaagtgtgggtaggtagaacaagataaactgcattatgcgcctaaaagaaagatacttcctccgtatctagctagattcattaacattaatatgaatgtgagaaatgctagaatgacttacattgtgaaacggagagaagcatgtttcattattgacttggttcaggtaatccgatctaaattatatgtcgtgttgatgatcaccctctctcaatttgaggcaggaatcataacccctgatctgtttacagtgctctcgatgttgccagcggtgtagttgccagcaacctgtgcatctaacaaaatggacgaacggaaatggttaagtatagaagcaagggcgatgtgaattctaaatcaaccgcgttagcgaaaagccggaaaaaacggatttgtacatcatatgtgaggttgcttaattgaatgctaccttgtttggacgattagggaggtggagttttttttttgttttaaaaaggtattcaataatttggtaatcgatttgagcagttgtagacattatcaattcgctaacaggcttagtaaaacttagatcttttttagccagctgtataagagattaatatattttctatcggttataaatattctctatttataaaagaaagtcatgacagtaactaaattctttcgtgtattcttagcactaaacgaatcgactgttccactaataaaaaaacgaaaactttgctgggctacttgtaccacatctatatattcatcatccgtacttctaatccgtacctcaccttattccaaactgaatagaccacccgagcaaccttcatcgagtaaaattattttgtaccaccgatgatataatcatgctaattagttttaaaatgcggttaggataggaatggcgcgtgatgaaggaggacaagcaggctacggagatcggtctaaagagatgcaatggtagcggaggcccagaacgagcaaggtcagcaatatcatgacaagaagaacgggtcctgaaagaagggggtgatgaaaaaaaaaagacaatgatcacgatgaagtatatgccacggtaccgccgttatcaatagtcggagatagaaacgactcatcggagccaaggaaaaggggaaggcgaaggggagtataagagagagtgtaggacacaggaagatagagtgtagtgtattactaccatcttatataaaaaaggcaaaggtacattgagacaaatgcaacccaacagaatcgccataaaaagacatctgtcgatgaagaggagccacaccattatcaccaccaaacctcaaaggctcaacaagcttgagtgcaggacaccaactcgtcgtctcatggttcatgcttgacacccaacagtgtcacatttggaagcaaaatgacgctttcagcctctgccaatcctcggactggcacctaaccaccaaaacccaacgacggagagaagaaaagagagatcaaaggcgaagggcaaatcagaaaaaaacgtgcctcgtatgagctcatatatataatttttttctccgaagaaatcccatcattttctccgggggctatttaacgggctcatctggtcctccacattctccccctcctcctcctcctcttccacctccaccctaccactctccaccacccacccgcccgtccgcctccctccgctccgctgctgcagccagccaacccagccttgctgcctcgcgggcgaacaaaaacccccagaattctccgcgtcgatctcgccccgccgcgtcccggctcgacgcgggccggcgccgtgagggtggggatcgcatgtgaagcgcattggagcggataactcgtctctatttgggggaattttttttagttttttgtttggggtttccaatcctttttcttcggcggagccgcgagcgtaggtgcgtctatctgctccgtctccggtggttgttttgattttatccgatttcgaggggggttcttgtgggcggtgtgattaggcggggtgatctcggctcgatcgatcggaacatcatctgcaggggaagcggttggcctccccccctacgccctttgaggatttttttacccttggtgtgatgagatagatgtgtgctgttttggggattttggtaggtcgatcggatcatcggatgcgctatgccagcatattcttgtcgtgtttcctgatctgagcactaagcctcaggcagtgatgagagttcggtggagctcgttagtttagtcgatcgtgctgctcaccctagagcttttcccccttttgtttaatggagaaaaactcataagcatactgtttctgttgttagcttagctgtctattgggatttcttttggagagtttagatgcagcaacaagtagagtgctaggataggctattatttatcatttgtttatctgtggctgtgatcaatatggagcatcttcaccactacctgactgtaaataagtaattgatagtgttgactaattggaaacgtcactatcaattgatagtattgtcgatttctatgtatgttctccccttcaatctgaattaaacttaggctggcccgggtgaaaaagataatgctgaccaatctgtagaccctttgaccactgtgttttcatcaatacatatacaaatacttagatctcggcactactataaatgtatggcgcgaaatgaatcttacaatgtgttttttctttcacaaaacaaagcggctgaaattattgtcggtcaaatttgaacgagagaatcttcgcgccaccgccgtgtaggcacattgtgtaactgaaatttgtttcttctgatatattcacgtgcaaagcttttgcgtttccgctaataaatttgaatgagagaatcaacggtatcagttattcgaaaacggacggaatatatttttttgtcgtcttctatgctcttttcagaaatatatatttcttaaatagcttcataccatttttagattagcttatttctaatcaaaagtacttcgactttgaccttgttatatgtttagtattgttgtaaagatataattaaagaaagtaaagccaaacattgtccaaattgcaagtaaaaatacagtgagtagtgtgttcatgacatggttgtttggcccgaactgcaaaaaattgtctttgaaacattctttttcatctacttgattagtttcccctcaatgtagcacgatatgctgcggcaacctgcaagcacctctggagatgttgatagaattgcaaacaggaagcatcgtcacatagtgcctaggcgttcaacagaaaagaagaaccctcataacatccagtttgtaagtactaacttggaaagagagatatggtgtagcgtgcattttttttggagaatttatttatcctttttttttctgttttgttattttgcaggaacgtcaagtagctgcgcttgaatacaggcaggaagaacagaggaagaggtacgctgatgtgctctaaaatcaatgtgctttgataaatcattgttttgtattatctccagtatactgaacattttctagtggttttaataattgatcagtattgatttcatgtcactattattagctgttattattactctttgttcagcatgttagttgaagaactgcattaactttcttgcctggtttgttattttcagagccaatggtggtcgtttattcttcacattgtctttatcatcccatctcgtggaaaatggagatgaacttgagacatccgcatcaccatcattgttactttttcacttcaatgatccagaggatttggcaagatgtttaacttcatcaagggcgttgctagaggactcccaacaatcagacaaagcccctgataatgatttctcagtcaacaccttcagcaacgcgagtgtggacgtgaagcgaacttcacgaaagaaaagcaaaaagaaaaacaagaggcacaaaagagtgcatggcaaaaaagtatctgaggcatctgacacacagtctatgcagagcaagggtgcttctcattgcatcgatgttgctggtggtgaatccttgacactttcatccaaccatgtggctcatgctggatctgaaatgcggtgtagaaaggagacttttccttctatggctgatggaggtgaaactttgacactgcctccaaaccatgtggctgacaaattgtttggggatttgtcttctgattcttcagtgagagaagtttctgcggagagacctgatagtgaaactggtaacgatggttctttcataactctgatatcaagtacatcttgtagtgatgagatagaattgtctaggcatgcttcttattttgaatgctgtgagcaatctaacagcaataactccagatgtttggacagtgcctccacttccactcttactgattcctctttggatggccattacacagatagcagttggaacttcagtgatgataccgagaacttgttgattgacaaaaatgagtgccctccgtgtgttcagtcaaaagtgacagatctcaggggttctaaatgtggtggcagtgaaggttggctaaacaaagcaaatcatgataaattctcctgtttcagaaacagtgctgatgctagcagtggtacacaagaaatgcaatcatgcagtaatgctagtagcgatggtgatttcctcccagtaatttctagaaaaagagcccggaaaaatagaaaggtccaacctttggggggttgtaatgtggaacatatttgtggtgttgagcatggtcaaagtggaaaacaatccaaaatttcttctagaccaagtaattcttgcacacaagttgcatcaaaagattccactaaggatttcattcacccaattaaagttcgcacatggactccacatgaagttacactaaatgattacatgataggagcaaatatgaatcacctccaggatccaaaacaaaaccgtagggggaaaccacataagtactcttgtttgagtgaagtggcaaactgtggttttattgaagagaagagtgcctgtacagcgaaaatgcttcctggaattacacactcaacagaaacaggtgttggtcagatagcatcgagttcagcttctgatgtgacggtccgagagatatctgaggaaatttgtacaccaataggtcctgtgcagaaaggagggctgcagattttgcttcgagaagaaaatgttgttggcacaggttctcttgatgttttgaatcatgtttcttctgttgattccgaagaacagaagaaagtagataatgctgtaatgagcagatctcatggcatggaaggtcaccatctacaatcccaagattcaggttctcagttccctggatgcaccacagattactggaaaacttccaggcctactgaaagtggtttggaggttggctatcatggtgtatcagcttttgaagggcgctgtaacacgaaccagcaaagatctgttagttctaaattgcaattaggtgagatgatcaaggctgcaaatgatgcctgcaaagtgcaaggtgcatcagatgttcatctgatttctggtcacccccttgctgattttgagacttttatatattctgcaagtccagtcattgctaagacatcttgcatgaggaatggcaactgtttgcaggacccgcaagctggcagctcaccatatcaatatcagatatcggatgtctccttgagaaatgtgtgggaatggt

SEQ ID NO: 72620 - DNA, 28137 bp, Oryza sativa
cgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtggaagtggaggtaggtatgggccgtcccgtcagaaggtgattcggatggcagcgatacaaatctccgtccattaatgaagagaagtcaagttgaaagaaagggagggagagatgatgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctctcgcgaaccttccacagattgggagcttagaacctcacccagggcccccggccgaactggcaaaggggggcctgcgcggtctcccggtgaggagccccacgctccgtcatctggcgcgccaggtagggggctctgtgagtgatcttctgagctctcgcactctttcgtgttcgccaagcttttcctgttcagcccaatggccgagcaagcaaaggcgcacgacctctccccgagtatgagcggtgacgacggggagctaaacccacgccgtcgagctcgtactccaccgccccctccacgccaaagtcctaggcgggagaaggcgctcgagagggccgaaggatccgcgacttcgacatccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctggatgctggtgggcggtcctccgccaccaaggcctctggtgctgctaccaccggctccgcgtcgtcaagacggagggcgcggcgagcggcagccgctgttcgccattcggccgccactccttcgtcaacgcctctgacccgggaagatctgcgtgggggaccggatgcccgcatcagtatcgagcgccggcgtaatggccgacgtgctccccacgcaacggagggcgcctcctcgtccggagtgtcacctcaccacagacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaactttcaaggcacatatccgcgcccaggtgaggaagcggacttgcacgcagtacagcgaagggatgatgagtcacttcactcgtacattcagcggttctgtcaagtccgcaacaccataccatgcatccctgcacacacggtgatttacgcgttcagggggggtgtgcggcacaatcgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagacagggcggcgtgacaggaggaggaagaagaggtcagcccacaccgacgacgagggtcatgtcctcgctgtcgaggacgcttcgcgggccactcgaaaggggaggcctgcgggcgacaaaaagaaggaggccggcgctcctagtagggagcgcccaaccgacaagtggtgcatcgtccacaacacttcccttcacgacctcgcggactgccgtgcagtcaaaagtttggctgagcggacgaggaagtgggaggaggagaggaggcaggagcgccgagagggcaagtccccggcggttccttccagcaatcggcgaagtgaggccaagcagaaggcccccgccgaggacatcgatgacggcgatgatgacctaggtttccaagagcctggggccaccattgccactgtcgatgggggagagtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgctccggccgtcccagccgattatcggtgtgacgccggggcacacttggccgctaggtcatatcgacctcccggtcaccttcggtggacccgccaacttccgcacggagcaggtgaactttgatgtggcggacctcagtctgccctacaacgcggtcttggggaggcccgcgttggtaaagttcatggcggcggtccactacgcctacctccagatgaagatgccgggccccgatggccccatctctgtccatggcgacctcaaagtcgcgcttgcttgtatggagcagcgcgcggaccgcctcgccgtcgcgtccaagcccgagggtggcgacgagaggcttggcacatccgccccccgccgccccgaggcagcggatagtcacatgcgacgaggtcccggtcaaggagattgccctgggcgacggcccgtccaagaccacacggatcggtggtcttctggacggcaaataggaagacgcgctcgtctctttcctgcgggcaaacgctgacgtcttcgcatggaggccggcggatatgcccggggtccccagggaggtgattgagcaccgtctcgccgtgcggccgggcgtaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccaacagattcgcatggctagggaggatgaggaaaaaactgcgttcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcagatctagcggaaacttttgagagtctccgctccgcccgcataaaactgaaccccgataagtgcgtgttcggtgtacctgcgggcaagcttctcgggtttttagtctctgcccgaggcatcgaggccaatcccgagaagatacgagctatagagcgcatgcgccccccagcaagcttagggatgtgcaatgcgtcaccggttgcatggccgccctaagtcggtttatatcaaggctgggagagaaggcgctacccttatttaagctcctcaaacgctccggaccgtttacctggacggaggaagctgaacatgccctcgcccagttgaaggcgtatctcagctctcccccggttctggtcgccccggagccagatgaacccttgctactttacttagcggcgaccccgcaagtggttagtgcagcgttggttgtggagcgcgatgaggataatcctcattcgcgcatccccaccctgtgctggcttggcccgggagagagcagggaggagaggcccccgagccgaacggcggcccaaggcccccgacgaccggagttggccctctgcccgcttgtcagatggtgccaggtgcccccgaaccccaggatggcctgagggccactgcgggaaggccgcacctatcaccctctgaccccgaggctaatcctgtgcccgctcgactcgggagagagcagggagaagagacccccgagccgaacggtggcctaaggcccctgacgaccggagttggccctttgcccgcttgtccgacgacgccaggagcctccgacccccaggacggccccggggccactgtgggaaggccgcccctgtcgtcctctgaccccgaggtcgtcggcacagaagacgagcgcgcctcgcgaggccgcttggacgaagagcgccccagggatgtggcccctagcgaaggggatcggccccaccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcatggtggttacgtcttaccccctcggccaaatcttgcataatcgagagggtactagacgggtggtgaaatgggcaatcgaactttctgagttcgatttgcactttgaaccacgccacgctatcaagagccaggccctcgccgattttgtggcagagtggaccccagctcccgagcccgtctcagtccccgaggccagctcgggcccctcacagctgcctcacaccgcccactgggtgatgcagttcgacggctccctgtctcttcagggcgctagtgcgggggtcacgttgacctcgccgagcggagacgtcctcagatatttggttcgccttgactttcgggcgaccaataatatggcagagtacgaaggactccttgcgggactcagggtggcagctggactggggatctgccgcctcctggtgttaggcgactcccagctggtcgttaaccaggtctgtaaggagtaccggtgctctgacccgcagatggacgcttacgtgcgccaagtacggcgtatggagcaccattttgacgggatagagcttcggcacgtgcccagacgggataacacggttgccgacgaactctcacgactcgcttcctcgcgagcccagaccccaccgggcgcttttgaagaaaggcttgcctagccgttggcgcgacccgaccccttaggggagacggacgcgcctgacaggcccccgatgcccgtcggagtccaggcctcgggacccgaggggagcgctcctagctcccttagattgattgcttggatcgctgagatccaagcatacctcacagataagactctacccgaggaccgcgaagggagtgaacgcgtccggcgcatttccaaacgctatgtgctggtagaagggaccctctatcggcgcgcggctaacggaatcctcctgaagtgcattcctcgggaacaaggcgtcgagcttctcgccgatatccatgaaggcgaatgcggagcccactccgcctcgcgtaccttggttggcaaagcttttcgacaaggtttctattggccgacagctctcaatgatgcggtcgacctagtccggcgatgcagagcgtgtcaattccacgccaagcaaatccatcagccggcccaggccctgcagatcataccgctttcatggccatttgctgtctgggggctcgatatcttgggaccgtttaggcgggccccgggcgggtttgagtatctgtatgtcgcgatcgacaagttcactaagtggcccgaggcttatccggttgtcaagatcgataagcactccgcacttaaattcattaagggcatcacagctcggtttggagtgcctaaccgtattattacggataacggcacccaattcactagtgaacttttcggcgattactgcgaagatatgggcatcaagctctgcttcgcctcacctgcccaccccagaagcaacggccaagtggagcgagccaatgcggaaatcctcagaggccttaaaaccaagaccttcaacatcctcaagaagcacggcgattcgtggatcgaggagttgccagcggtgctctgggcgagccgaaccacgccaagccgagcaaccggggaaacgcctttcttcctcgtctacggcgcggaagcggttctcccatccgagctcaccctgaggtcccctcgggccaccatgtactgcgaagctgatcaagatcagcttcgtagagatgacctcgactacctagaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccgatgtgggagggtccgtatcgagtgattggtgtcccccggccgggctccgttcggctggccacgagcgacggcgcagaactgcctaacccgtggaacatagaacaccttcgtcgcttctacccctaagggggatcgggtatcaggatttaggcttgggccaaccccgcacccccctcgggcgtgcagggttggccgggggctgccacatatgcatattcttatttctcttatatctgtacctcaataaaagtattttcgatttcctaaaggctgtatctgtgctgttgtttccttttgaagaatcttgacttgaaataggtcactcgtgttcaatcctgccctcgggggctcgggtcggctaaaatcgccaaacggggcccagaaccgagccgtgccccggggcgtggtgaactccgggggagaatcggcaaaaacccacaatcgggtcacccataaccctcggtcaccacgctcccggcctggccagtctcgacatgtggatctctccaggcactagccccgacccgagccatttgaggactaggacctgggcacgagcccttgttcaagccaagacacaagagaaccgcggcacagacatccttgtctcatacacacaacaaatagaattaacacaaaaaatttcctctttatttgattgcagattaaattagtctatacaagcagggggcccgaaggccttaaaaaaaaaagaagatactatttaaagattggcgggggcctgggggctcactccgacgcacccggatcgccggcctcgtcgccactattgcccactccgccgtatcatcctccccgtcggagttgagggcgaacgcgagccgaggggccgaaccctcgaagctgtggacgatatggtcggcggcgtcccggacttgcgcgcgtgcgccgtcctcggttccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccttgggtggcggcgtacttcgcagtctgcccgccccagaggcccacctgccggccggcgcggtctagacgggagacggcatcccgaagcatgccgggccctacctcgcctgccaagcggagggcctcgacctccccggcggacgagtctagcgcgccctgcagatcggcgatggtgtgttcggcagttgcgaggcgagcggttaagtcgctttcgcccgcggccgccccgccgatccgtgccctcgcgtccagctccttctcccgcgcctcgagctcagcggcccgctggttcagcgcggtcctctcggcgcgggcatcttccagattacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggtccctctccacggcgcaggcacgctcttccagcgccatggcacgggcctcaagggcttcgtcgcgccgccgggatgccacctcggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcgacccacttccaccatggcctccaccgagcgtcgcccctcttcgacacgcacccatgcggcgtcgagctccgcccgctctgcttgcagggcctccacttgggcacttaacccgtccaacaccgtcgtgtttgcgacggccaaggcccgcagaaggggttctgcgctcagtggagcagcagaaggcgtggggaagagccgtctcggtgaggatgccgcgcggctcggcccgccaatggacgtgccggactcagggatatcccccggacctagcttatcctgggcgtcgcccgaggaattgggcccaagcgatgcgcccgcggcctcgtcgcaagctgcctcggaagtcgtcgccgcctcggcctggtgaagtctgacctcttcccgagcggcttcttcagctaggcgagcttggacggccacctgaacagcttcctcggcttctcgaaggcgatccgcggcctcttgccggtcagtttcacgggtcgcctcagaggatgtcgtcgcttcggcctggcggagtccggcctcctcccgaacggcttcctcggtctggcgagccagggcggcctcccgagcggcctcctcggcttcccgaaggcggtctgcggcttctcgccggtcagattcccgcctccgggcctctgtggacgccgggtcctcggactcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtccccctcatcttgcggggccgtttcttcttccgctccccctcgggctgcgacgtcggcgtggccccctccgggcgcctgctgctggcacgcgccgccccgccccctcggggaggagatgagggaggggttccttcctgcttcctcttcccccgggcgtcggcagggtggccgctccccgggcccccgtcgcgaggcccagaagcacgaccccctcccggggtagatcgttcccccctgcggctcccgaccgcgccatcgtggcctcgaggagcccgctcctccgatgccccgaccgcctgcatgatggtcaagatggaggcacggtctggatcactgcagagggggaggactccttgaggaacgagggatgcctccacggagctgagattcagcacccgttggaccactatcttgaagtcctcaggagcccagtcccatcggaccccctggtgggtcctcatacagtcctcggacccggtgtactcccaggcgccccgggcgcgccgctggagtggcgcgatccggcgacgaagatagtcgccgaacaccatggcccctgtgagcccctgagatcgcaggcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaccggaacagccgaagggatgggcgcaccccgatgaacatctcgcacaagtgcgcgaagatggccaatgtcattaccgcgttgggggtgaggtgcgccatctggagatcgtaaaactccagaacatccacgaagaaagaagaaaatggcggaaccagccctgccatagcaaaagggaggaagaagacggaccgccccgggtagcgtggcgccgggcatccttcgcccagcgagactatctcccggccggtcgcagattccggcatgaagcggcgcagcagcccggcctgtctctcgctcacgatgcgggaaggcggcagcacgctaccgtcaagcggagcggagccccgtgccatgacgccggaagaagagatgtttgagagcgagcgcgtgtggcggaggtagggcacaggaaacaaggagttagggcgcaagcggcgaagacaaggggaataatggcgaaagaaaggaagcaaatctcttcctcggcaactttatacccttgccaacgctgtgcccggctcctcgtttctcgcgcccactatcttgccccctcgtttctcgcgcccactcttccactaatcccattcgcccgtttacggtgcatgaggtggatatgcggctgtggcagtcgagatggaacatctcgtgcgcgcgttaattacgctcgccgaccgaagcgccatcaccatatctccaggcaaaacgaaccggcacgtcccgattcacacgttactcgagtaatgtggcagtcttgaagagaccgttcattattgacagccgagtaaccgttgccgatgtgcgtgatttgcgactgatgggtttctgcccaactgtggagaccggtcccacctgtcaccaggccttaggaagtggcgtcacgcccgaccgcttccctcgaggagggtaatcgccccggcataacgccgggggctactgtcgatgacatgggaccgggagtatcgtgactagaggcttgaggcagacacaatcgcccacgtggcctggcacccaccggggggggggggggggtcgggcccgagggtggtgtgttcgccctcctctttgtctccccgagggggtcggaccgctcccgccttggccccgagggctggggcgccccgaccccttgtggattttgcgccgcgtgtatgggttaggtgagcacagcggcgctcacctaaccgcatttattgcggtttggacgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtgaaagtggaggtaggtatgggccgtcccgtcagaaggtgattcggatggcagcgatacaaatctccgtccattaatgaagagaagtcaagttgaaagaaagggagggagagatggtgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctcttgcgaaccttccacagattgggagcttagaacctcacccagggcccccggccgaactggcaaaggggggcctgcgcggtctcccggtgaggagccccacgctccgtcagttctaaattacccgatgagaaagggaggggggggggaaaatctgccttgtttatttacgatccaacggatttggtcgacaccgatgaggtgtcttaccagttaccacgagctagattatagtactaattacttgaggattcggttcctaattttttacccgatcgacttcgccatggaaaattttttattcgggggagaatatccaccctgtttcgctcctaattaagataggaattgttacgattagcaacctaattcagatcagaattgttagttagcggcgttggatccctcacctcatcccatcccaattcccaaacccaaactcctcttccagtcgccgacccaaacacgcatccgccgcctataaatcccacccgcatcgagcctatcaagcccaaaaaaccacaaacccaacgaagaaggaaaaaaaaaggaggaaaagaaaagaggaggaaagcgaagaggttggagagagacgctcgtctccacgtcgccgccatggccgcccgcgccgccgccgccgcgttcctgctgctgctcatcgtcggcgcggccaccgcggcgccggacatgtcgatcatctcctacaacgcggagcacggggcgcgggggctggaggaggggcccacggaggccgaggcgcgcgccgcgtacgacctctggctcgccgagaacggcggcggctcgcccaacgcgctcggcggcgagcacgagcgccggttcctcgtgttctgggacaacctcaagttcgtcgacgcccacaacgcccgcgccgacgagcgcggcgggttccgcctcgggatgaaccgcttcgccgatctcaccaacgaggagttccgcgcgaccttcctcggcgccaaggtcgccgagaggagccgcgccgccggggagaggtaccgccacgacggggtggaggagctgccggagtccgtcgactggagggagaagggcgccgtcgcccccgtcaagaaccagggccaatgcggtaaggaatttcttctctttcctcatctcatctcccttgtgcgattatttaccattgaaagcttagatgcgattatctatttgtcacgctaatctcggatctaagtagggcaatttcacaacagttaattcaggttcacagctagtaatcttttgcccctacttgcaaaacagtgcagatttccttctgatatatacataatataatagtagattatgattatatagtcacacaccgtctagtctctagaaaagatgggtcatttttctagctaaagctgactttcccccctgaatgagcatatctgatttaatgacagagttattgttcttttaatacgatgataatttactggaccgaataattgtttggaattctatggtaaggatttattacgtagtggatgcaggatgtattcttggaaaatcctctcattgggttaactgtgtaaggtatttgttctcttcgttctttgcttctggagttggcaacggctgtgacttgtgaatcgtgcagtgacagcggtgtggacttgaacagattcaaagcccgccgttggttggggctgacttgctcagtgtggtttccttgtttccaggattgtagtttagcttagcttgttttttcctgattttaggactgccgtttctgtggttgtgctgcttttgtctttatatttttaaaggtctttttcggtgcatctatcagtcaaatactttggacaaggtgaccctgtaaccaactactaagacattaaaccgatttgatgatgttgctttgcattgcaactattttgggcctttaagacttttaagggatatcacaccttatcaacctttcgtgttcagtcgagcaaactttttatcctgtgctgggagctgtttgctgatattagcctacaggtgtcttcaaactgcttttgtgggtaaaaacaggggtgaaacaaatgtctgcaaatatcttactatccatcttgatcttgataatattgatacaattaaacagtttagggttcttgcctcatattacaattggttgcttgcggtatgattgcagttgttgctctcttggatgacactagttattttgatggttactgacatctttggtcttgaatggtgggatgcaggaagctgctgggccttctccgcagtaagcacagtagaaagcatcaaccaacttgttactggtgagatgatcacattgtcggaacaagaacttgtagaatgctcaaccaatggacagaacagtggctgcaacggtgggctcatggatgatgcctttgacttcatcattaagaatggaggcattgatactgaagatgactatccttacaaagctgtagatggcaagtgtgacatcaacagggtattaacttattttctgatgaataacttcatacattcatctttcagttcccacattatgcaaatcgctaatgtttcaacgggtgcattgttttaggaaaatgctaaggttgtgagcatcgatggctttgaggatgtacctcaaaatgatgagaaatcacttcagaaggcggttgctcaccaaccagtcagtgttgctattgaggctggtggccgcgagttccagctctatcattcggtaaatgaacttgcagatatcaccccatgcatataggaggttttggtcgtaacaactattgatttttacattacagggcgtcttcagcggtaggtgtggcacaagccttgaccatggtgtggttgccgtcggttatggcactgacaatggcaaagactactggattgtccgcaactcttggggcccgaagtggggtgagtctggatacgttcgcatggagcgcaatatcaatgtgaccacggggaagtgtggcattgccatgatggcatcataccctaccaagagcggagcaaacccacccaagccatctccgactcctccaactcctccaacaccacctcccccatccgcccctgaccatgtctgcgatgataacttctcttgcccagcgggcagcacctgctgctgcgcattcggcttcaggaatctctgcttggtttggggctgttgcccagttgaaggtgcaacctgctgcaaggatcatgccagctgctgcccgcctgactaccctgtctgcaacacccgggctggaacctgctcagcggtaatctcctcgctttcttgttcgttcttactgcaactttatactgcctacattctattccaaagattgttttcatcatagtattctgctccgacaagctatacggttttgaaaaggcacgaggctttcatgatctgaactcagcaaatatttgtcatcatgctttttctgaaaaaactagacattaaggttgctttggctccaaagatagttcagataactgtaatgcactaactgacctttcttctgttggaattgtgcaagatatttgaacgtacgaactgaccttccttttgttggaattgtgcagagcaagaacagcccattgagcgtgaaggctttgaagcgcacgctcgctaagctgaacaccgcatgagctcatcgataacatgtaatcggcgaggagaggggatgaggcagcgtggagcctttctgaaatttctgcttccgtgcctccatatatcgttgtcgcattttgaggggacagcttatttactctactgcctgccttttatcttacagtgatctgtgtacatagctcgatccaatttgtactcttatttatcttctccaatttgtactctatataatttatcatctcaagaatacattaacgaagatcctgttttaccgttccaaattctcattattcacttctgtcgaaatatagctacaactagtacatctgatcagtgaatttcagaacactgattacttgtaaggatacaatggaaggatgcaagaatgttcgtgtttgcatccttccctcttattgcgatgtgatatcagattgttgtcagcaatgcgtcaggctgagatttgcggcacaaattggtaggccgttttccgtttattgaccaacagttacaaagtttggaatcatgcgatctgaacgacaaaacgctgacaaagttggtgatcgctgatcagttcagttgccaccacctccgccgccgccgccttcttcagctgccacagccgaaggcaacgccgccgccggcggcctgaagcccggcaggtcgcaggggatgtgcggcacgaaggggcagtgctgcggcgggtcggcgtagaagcgggcgcactcgagcgccggccgctggtgggggaagttggggatgcagttgaggcgcacgtcgagcaccttgctccggacgagctcgaggcaatggcggcggccgacggagtggaagtagttgtcggagagggagaggttctgcagcttcccggtcttggccagcgcgcagagcacgtcggggatgtggccgtacagctggttcccggcgaggttgagctcctcgacgagccccaggcagccgagggagagcgggatgggtccggtgatgtcgttgccgccggcgtcgaacacggtgagcccctccaccaatccgatctcgtaggggaggcatcccgagaggtggttgttgaggaagagcacctcggagaggttcgccgacgtgttgtagatggagcgcgggatcgggccggtgaactggttgttggccaccaccaggtactccgccgtggtgctcccgaagttgtccgggatgttgccgtagaagccgttgttgttgaggaagagcgcgacgacggtgaggtcgaacaccggcggcggcaccgtgccgacgaagcggttgaagcggaggtcgaggaagaggaggcggccgagcgggacgacggtggccgggaacgcgccggagaagttgttgttggagaggtcgagctcgtagaagtacgggaggccggtgaggtcggggacctcgccggagaagttgttggagttggcgtggaagagcgctaggtccgggaacgcgtcgacgaagccggagaggctgggcgcgccgaggccgtagccgttgaagtcgatggacgcgatggtgagcgtggtgttgtccttcggcgtcgttgcacccggcggcgccggcgggtgctcgcagtagaagcccttgtacatgtcgccgccgaagtagctgtcgcagaggttggggccgacccacgacgccgtcacgccgcgcgggtcgctggtgatggtcgccttgaacgcctggatcaccgggtacagcgcctgcaggttctcgttcaggaagtcctccggcgacggcgccgataccttcccttgtccaccgcgatcgggcctccacgacggcgcattgcgcgacaccatggcgaagtgagtatggctggggtcacacaccacgccgtgcaggtgcagcgcggcgagcaggagcgcgagcgcgagcgcaagcaggcgcgcattatggcctgaagccgccgccatggacgcacgttagatggtggtgagacgtgggggggaagacgagttttaaggaggaggaggaggagatgggtccatggctccatgaactccattgacatggaatggatcagcacaagtggagcgtgctttatgggaaaaactatattcattttttaaggggatatcatctcgtttttacatgtcactcccaaaataagtgcagttttaacaccgttcatgctcaacgtttgaccgttcgtcttatttgaaaaacaattatgactagtatttttattgttattagatgataatacatgaatagtactttatgcgtgactaatatttttattttttttataattttttcaaataagacggacagtcaaaacgctggacacggatatctatggttgcacttattttgggacggaggtggtaaaaaatttagtgtagcagattatggctcggtttagttccaaactttgaatcccaaaaacgtcacatcgaacttttctacacacacaaactttcaacttttccgttacatcatttcaatttcaatcaaactttcaactttagcgtggaactaaacacaccctatatgtgatatgtcacttcaaacatgcatattcaaattcaacttatacaagtaaaaacaaaaatagcaaatttaactgtgaaaagaacacgtaatttacggttaaatttgtttgttatttttgtttcaaattacatatgtcgaattttaacttgcatgtttgcgaaaagatatatcatatattgatcacaatatatatcttgataattttttttaaaaaaattttgataactttttaaacgatacgcacaaaacgagaggatgtcccgacaaaaatccacttccgctttatgggtgaaaagaggtgggaataggagagaagttgttttgccggggaagagaggaggcaatggcagccagcaaagagagaggcggtagtggggttggcggttaattagtcgtcatcgacggtaggagtgaagaagaagaagaaatgaagcagcgctcgtgcgtgcaggcagcggcggcgtgcagctcgcgaccactggccgagccgagcggggcgtgcacttgattccagggcgaagtggctacgtgcctagctcgcgaagtgaatacacacataatagtatggcagtgtgcggtcaaggcgttttgtgattttgagttgagttgttgatgatgggtcagtgcggggaaggcaatagcgtcggctttcctcggcaggagggcagaggctgcctcacgaccgggctcagtgctctgtagtctgtacataccggtagtatatgattggggcactggggcatgacaaaaggcacaatgtgtgtatgtagcaagtggaacatcatcatcttctgggccaggagcaaagatatgttcatatagcatattagcgtttgctaaacatgaagtcagcatgacatgactcggccggaagcaatatttgccgtctgattcataatagcaaaccagaaaaaaaaaggtgtcttctctttgccagaataatgcttactatattccatatcacaaataagtgtgcagatatgtgtactgtggagtatagaaaaagaatgttggaagatggagaacttatctgcttgacccagtgagtagtgaccctacaatttggatacccacccaagtttttatgttagtgtcccaaaaaggctctgcactggtagtcttgtaccataatgctcacacatattgaattgccaataggcgtcccctttcggatatgcctaagccaatttgtccactggtgcccgtaatggccttagcccctctaaagagaggtgttgcatactggagcctgagcagacaacttaagtttgaaaatatgttatcaaggctggctcatgcataatttgtttctacaatgaactgcacagaatttccaaatatgcatgtggttgctctgacttgtcttgttaatttttcttaatttctagcatagcgattttacaccaacacaaaatacttacatgatacataagttttgcagcaaattaatacaccagaatagtaaaaactgaacacaacggttcataagtagtagagaaaaatggctggccctagacgattaccaaagattcaggtatgcatgtgtgcagtttggcatcgaatgagctcactaaagtttattagggaactatttaacaatgagaatcaagaacactaaaaaaacggtttagtgcaccagcaaccaacatatttgtatatgccggctacagaaaatgatttcaggggaaaagtatatatcattatccacaagatatgtgcccatgataaacctcagcatgtgtcatgttacttgaaaaaatatacaaagcattccatttctcaaattgaacagagtgcatgtaaactacatcagcagtcaaacatgacatcttcgatatccaagaatatttccagtggtggttcacaggtatggagagtaactgacgaggttcatgaccaaccacatatgacaaaagaggttcctgataagacaaaagatgatcattatagagaagtatcatttctcaggaacaacagaagatggtctcagaacatttgtaaatttcatgtgtggtaacagttcaactccagaaaaacaaacttctgaaagtgattacttggttgtatttagagtgccttgaatgccattcctgggctggtggtttctctttttattaacaaagggaggacatcactgcctcgcctttctaagaaagaccatttttgccttagaaaaatacaacagaaatacagaatacggtgagaagtaactctatccatttgttcaacgagaatttatctcatctttgctgcccttagcccttaggtttttgtgggacttttcgagtaacaaagatccactggcattgccgttatagcatcttaaaggttttttgaactattgcaacattatgtaaacttgagattgcaagagttaaacaaaaatgttgtccatgctatcatgttaacgaaatgtgtagcatactaaatatgtgaaacacaaaagctattagtggtttgttggatttagagtataccatgaactagtaaaaaagattcaaaccgtcttagaagctcacccaatgtagcaaaaacaccggttactcagtcttcttttgcttggttgattctccagtcttgctaatgatggtatctaagtgccttgatagtacactgtgcgccataccaatcttttcatcgacttggtcctggtacttctcatacaatggtggaactaacagagaaaacattacacctagagaaaagccagaatgatacaattattacatatgagctatcataaaagaacgattgatccatacatgaataggtccaggaagttaaagagtaacaaattcagtagtactcaccaatgtaaatgagcgtaaggaagttgaagagcattccaatgtatgaaaccacccataaaatcaatataacctatatgaccaaacaaaataaggggcataagaagaaagcatacaaaggcaggtacagccatatagacgtacagttgtgtgtgtactagtgggcatggatgtgtgtgtataagagagagacctttataaaaacactcctatctctcttgatggcaatatcatggccaacagccaacaccttgttgatccatacaagagcccgatctgcagctttctcaacaaccacatctgagacctctagtttagggagtggtggaagaggcctgcaaaaatcacaactttgtgtcaaacttggatagatgatatgggcaatggaagtacaatgccagtcacagagaacaacataaaacaaccaaagtgccaaaaacagctctttctttttcggtttagcgatacaatcgcagagacactgcataaatgcatatcaattctaggcaacaatcaagtcagatggggaacacaaactcataaatgagccgataaggaatggcaagcgcggtgattgaccatgtaatgtaaatctaggaaaaaaaccttgtggattgcttgcagaagagaccatatagcacagttacaagctctagagaaaatgacacatgctagcagaattaacttatcgaactgctatcgcggcttagctttaaagtaaagcagcctctttactttgtagataagggatcggatagatgcattattggtaatgtaataaaaacgaaatatgcaggtttcaggaaaagggataattaggaaaccccgacatatgcagagttcaaacctttgaacaatctctaatcttaggagatcatcggatcacttccaattacaaactgctctggcctgaagtttagtttcttactgcaacccgtaattcaaaaatgctaagcaagttagtgtatgaaacagtttggcagtgagcttcttgaagccaaaaagatgcaacaaccaaacggttggggaaaagaaagtccacattattcagcaaaacctcatacacattacagtgaacaccgcagttacaactacagcgaatcagggccgcagggcgcggcgcgactctacatgagatcagaaacacgcggtgctgtagagccagggcaaaaacccacctgttgagcagcgaggcggacttggcccagaagaagaggatggcgacgaggaggagcagggcgttggccatgactgacgggaagctgtaccccgcgcgctcgaagaggaaccacaccgccgtggcgcccgccacggccgccgcggacacgttcctccgccgccacagcaccaagtcggcgactgcgagacgagagaacacgagtgaggagaaaaccgaacccaaattctcgacccggatcggagagcgccgggaatgcgcgtgcgtacctgcgccgccgccgaggagggcgtggagggatcggcgggaggtggtggccatcgggatcgccgcgggagggttagggtttggggccgcggccgaagcgaggagaggaagtggggtaggtgagtggagctcacgaggcggaggcgacgaggacgagatgggatctctctctgtgtcctttgctggatcaggaaatggattcggtttcggagacggcgcgagcgaatgaattccgtcgaattattttgaaatattatggtgagttattgcaattttgcgggcaagtgatgcccgatggtgttggaataactccttccatttctatacttttaagatttaaattttacaccataatattcttatttttcactgatttttgtgattcccatcatttcaataattttaaagctaatcaaatgcttggaaagagagaataagtaaatttcatttaaccacccgtattatgatctacctcttaatcacaaataataataacctataactagatgggatacattatagtactacgaatttgaacatagagcatataatacccaacgaatttctgtcgagatttatagtactatgatgtgtcctatctagtactaaattttagaacaaattgagtaaattaaaaaaacatacgattttttagcacataaacatatgtattatggtcatttcaaaaaacacaatatttatcattctaactttgaattaccataattttaagttatacaatcgcatctcgaatttatgagttatttatccatcatataaatgttacatccatggccttttaaaaatttgatatatgagtatgtcaaattggttacaatgtggttttgtggaactttatatccatagtacctatgggtcatgtgctatgtgtcaaaatccttgtagttttgtgtaattttgatcataacgagtgtatttttacaaaatttcccaaaagaaatacaagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttggctgaaattgaagatgatgtgactgaaaagttacgtgtgtataacaggtggaggtggatgtgatggaaaatgattgaagtttggatccaaacacagcccataccaactcacatagttcgtggaagggagacaataattgtgatcctctaaaatatcacagtaaatttctatttttataataaacacacaaacgaacctgaacagtaaccgtttcatattaaatgaatatacggtccttacctgagacctgttttttcagcaaaactatatagtcatggcatgtatctatatatagaagaacaagatgcacttatagaatggaatgtgtgatttcaattttgagaccccgtgttcaatatctaacgcgcttacaattttttttaaaaatgtgtttggaatccaaatatcgtcttttatctatagaagaacattttgttcagtacaccatattgagtctggtggatatcctagaaaattccaactccaactgacggtacgccagtacaccgccattggcagctagcctgaagtgatccaatttttaatttttaatttttctgatctttttaactcttatctcatcatactttaagtgaacaaacacttatccaaaattatatcagaaatgctattacattttaaaatggagaaggtatggcacgaaaagcaccaaatccaatagctagaagccgcattcagttcaagatttgaagcaatatattcaaaactcaaaaatagcctgaactcctcaagattagctcacacgatgatgacatgactcaactgaagaatcctggccttgtaccaaaaacaagtccaggttcagagaaccgcccccttccgcggaaacggcagctgttacaaatcccacccgagcagcagccactttcaacacacacgctcacccgatttcccgcttcgccgccggcgctcgcatcggtcaagtcaactcgacgcccacacacgcaccggccatggccgcggcggcggagcagcagcagcagcagcagcagcagggcttccgcccgctcgacgaggcgtccctggtggcctacatcaaggccacgcccgccctcgccgcgcgcctcggcggcagcctcgacgccctcaccatcaaggaggtcggcgacggcaacctcaacttcgtctacatcgtcctctccgacgccggctccgtcgtcatcaagcaggtccctatctcctccacgcgccgccgccgcgccacacatgtacgcatcttctctctccgttcctccgctgacgacgctgcaatccaggcgctgccgtacatccgctgcgtgggggattcgtggccgatgacgagggagcgcgcctacttcgaggcctccgcgctgcagaagcaccgcggcctctgcccggaccatgtccccgaggtctaccacttcgaccgggccatgtcgctgatcgggatgcgctacatcgagccgccgcacatcatcctccgcaagggcctcatcgctggcgtcgagtacccgctgctcgccgagcacatggcggattacatggccaagacgctcttcttcacctcccttctctacaactccaccactgatcacaagaaaggaggttggttgatttattatacaggtttggtttgcctgtgaaaagggagaaaaatgagaaccaaattgatagaatgttgtgttctgtgactatgaaaagggagaaaaatgataaccaaattgatggaatgtttgtgttctgtgaactgcagttgctcagtactgcgataatgtggagatgtgtaggctcacagagcaagtcgtgttctcagacccatacatgctcgccaaatacaatcgttgcacatcacccttccttgataatgatgctgcagcggttcgagaggatgctgagcttaagttggagattgctgaattaaaatcaatgtaactagctctcctgattaaaccagcgtttctctttccttttcattggagatgatggacatgatttgcatatgcaggtttattgagagagcacaagcttttcttcatggagatctccacactagttccatcatggtgacaccagattctactcaagtgattgatccagaatttgctttctatggcccaatgggttacgatattggggccttcctggggaacttgattttggcatatttttcacaagatggacatgctgatcaagcaaatgatcgtaaggtgtgtatggatttattggctaataatagtaaatgaaagtgcgtaatcttacctgggtggttaagttgttttgcgtttgctaagataatggcaaccacatgtcttcctgtgtactaatttcgataggatagaagtttggaacatgatacttgtatcctatagaataactagcaattgatattgttgatatatgccgtatgtaacagagggaggagggtgctcagcagacgatgaatgtccctgagtattactccctccgtttcatattataagttgtttgatttttttcttagtcaattttttttaagtttaaccaaatctgtagaaaaatagaataacattttcaatacaaaacaaacatattatcaaaatatattctatgttaaatttaattaaactaatttgctgttgtaaatgttgctaatttttttctataaatctggtcaaacctaaagaactttgactaagaaaaaagtcaaacgacttataatatgaaatggagggagtacttaatgggaactgcagaaatgacaagttatgatatggcaaagtgcaattgcaacatctagattctagaaggtattttcatgatgtttcgccaggcataaaataagttctatgtctgtacatattttgcaggcttacaagaaatggatcttgaagacaattgaagattcatggaattttttccacaagaagtttgtcgaattatggaataaacacaaagatgggaatggggaagcatacctgccccctatatacaacagctcagagcttttgagccttgtacagaagaagtacatgacaagcctatttcatgacagtcttggatttggttcagcaaaaatgatcaggtaattaaacagtacaattatgtagagtctgtactactaagtcaatttgctgaatcttatttacgtctagactatgaagatatactagacctgccctttttaaatgtaagaagctcaaaggcacagtaagttagtccaaagtagaggtttccgatgccaattttgatgcagcacttctttttcataaatgtatatcagtatgtgctatcctaaaagagatgttccagaagaccacctttgacgattataagtatgactgaaaaccgtcataaatggttaaattggaggctattcaggatattatgttgtgagaagctaagtgtaaagaacttaaaatcacatttaaacgccattttcaaattttttatctgtgttccgatgccttgtgcatgatcctcacgcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgagcaagtgattgtgcatgtacaatcgtttgatcgggactgataaggctaaccatctacacaacctttctgattgaggagacaaaagttttcatctgtttaccatcagcgattatctgtgcctattataaagcagaattggccggttatatgtgggctgggcaacaacaatgtatatagccaaagtagtccatacagat

SEQ ID NO: 72621 - DNA, 4004 bp, Oryza sativa
cggtactaccatttgcattttgcagtgtcctacactacaaccaaatattcgctaacattattttccactcaagttctattggcacctataacaaacacgttagttggtgctacatccaaatatatcttgtactaggtcatttgcacttcagctctggtaacaaccatctatggcttcaaaatacaacttttcatactgaattacgcccttgagaagaaaaattgaagcttccttgtccaaatccctattgtaatcactgcatgcaaatgattggatgcaatttggacacccatcagagttggtgcagctgcatgatgaaacaagctctaaagcagcaaccagaagctcaccaaagagcagcttggcctgtgatgctaagccgatgccaccgggatgtttgtcgtacaacagaattctgtctgcagtttcagaattttcttgaggctctgcacattgtgttcctagatcagaaccactgcacatcatgtgcagaggtattatacttagaagcgcatgagaagcagcgtgtacaccaccacagagctgatattccatctgctccatagtcgtccttactgacacaggaatctgtacccaaacggcttgagtttcaaaggagtatggaggtagatgatcaaggttaatgctgtcggatttctggttgtttgacttcaatatccgatcaaagccaacccatttggttgtcaccctgcagtcatttgcttgagctgttgtcctcctgatgtcaggtttacactcactcgcaggatgttcatcaacatcacctccaatgaaactgatttcagtgtagtcctgaactttggtgtagtagttcagatcaaacaccttgcagtaagctatccttgatgtcagatcaagcttatcaaccaagtagctgacaccttggtgcatgtagacagcaccatcatacacctgaaagaaagccttgctttcctcaatctcttcaagaactcgattgcttctcctgtcgatcaccttgtacctgtgatgctcaattgcccgtatgcttacactatgagaaggttttttatcaggtccaatatacttccacacgcctgaatctcctccagatggattgttcatgagacagcccttatctttcagtgtcatcaaaacactgttcatgctaaaaccaaagtagctctcgtcatgttcctgacgcagtggatattcagaagcggcgcaagcgagatgctgttcaagaaccttgcggttttgtgaatcaacctggcagtgctcaatgggcttgccaaacagcttgtgtggtgatctcatgaagtactggtcaagagcaccctcaaaggctacataaacagctatggactgctttgctcttctccctgatctccctgcctgctgccagaagctagccatgcttccaggaaatcccaggtgcagcgtcgcatcgatgtgcccgacatcgatccccagctcaagagcattggtagccgcgacgccgcgaagaattccaccgaagagatcagcctcgatcttcctcctgtcactcgcaacatagccaccacggtagacacagatagaattcaccaattctgcagctgtctccttaagaatctgacgcgtctgcattagcacctgctcacacatcttcctcgtcttgcagaaggcgatggcacgaagcccatgctgaaccatctcggcgaacagataggaaacctctagtactgggtttggtcttctgtcttctgctttcgccaattgcaatggcggattccacaggaggaagttctttgagccgcaaggactcgtgtcattatcaaccagcacgactcgatcaagatttgccagctccatgacatgctccctcggattggccaatgtcgcggtgcagaatatgaatgttggattgcttccataaacatatgaacagatgcgctttaatcttctcagaatcaacgcagcgtggcagccaaatgcgcccttgtaggaatgcgcctcgtcgatgacaatgtacttgaggttgaagaggaccctcttgaactgagcatggcatggcaagatcgacatgtggagcatgtcagggttggtgatcagcagcctcgcggtgttcctgatccttgtccggtctttcatggcggtgtcgccgtcgtagatgctgacgtcgaagtctgagcggaacgccggcttcatctcgagcagtgtcttgagctggtcttgggccagagccttggtggggaagatgtagagcgcgcatggcgcggagctctgggagatggactcgaggacggggatgttgtagcacagcgacttgccgctcgacgtcgaggtggacaccacgacgtgctcgccggagacggcggattgcacggcctgcgcctggtgggcgtacagcttggtgacgccgatgcttctcagcgcgtccctcatggaggacgagaggtggccggggagttcggcgaacgtcgcctcccttcccgggatctcctcgacatgggtgatctgtccggccttcccgagcccttgcctgagatgctccaccatttgggtagggtcgagaggttgggtgccatggcaggagagcggcctcggcggcgctgggttcgtcggcttcttggcgtagatgtcttcgccgccgccgtcgtgccaagaaaacttgcgtttcctccatggattcggcgcgctcgacgacggagggtgcggcggcgctgacttggcgttgaccgggatgaaagagatggactcgccggggccgacggggaggttgccgaccttggcgtcggcgatgagcttggtgcccttgaggaagaggtggaagtcgggggaaaccagcgcgggagcgaaggaggaacggagcgccgtcctgaggtcgctgacggtggcggaggcggcgatcgtgacggtggtggagcgcccgtcgtgggcgcgcacccggatgactctcggctgcgccattgccgtcgccgttgcggaggaaggaaatccgcggcggatttatagccaaattacgcgcaatgccgcatcggaatcggatctgctgcgatactccacatagaaaccaactccgatgctgtgaagtttgaacgtggccgacatcgccggtggcgtgctgccgccgtttagccggcgccgcgcactcatcactcctccatggggcttgggctgactttaccacgccggctgcgtcgatgagattgagaatttgaggcccattccaatttattcccgcacggtaaccctggtaaattttggcccgttttcatgctcgagagaaaggcccatacgcataaataggccgcacgtataatttggcccaatttgtgtgggctgcacaaaagtcagaatctcgtcccggcctaacatgggctgcgaacgtaaaaacccaatcccgttattgggccattacggtaagtgtcggcccatatgtggtccaaactgagaaggaaacggccatgtgagctctacggcccagaacgggttgtcgtctccccgtccggcgggggcgcggggcgccgccagtctcaggagcccgccggccgccgcaggagagggagagcacccaccgagaccgagtcgacgctagtgcctactgccgccattctcaggaacccgccgcctgcgcctggttccctgcaaccgcatcttccgcccgccaccaccaccaacaacgaacgacggctgcactcaaggtgttcgatcgtgggtttgccccggagtggccagaagcggcggcatcatcttgatgcacactgatatctattctcgtctccggaggagctcgcctcgccggcaatccacgacgtggcggttccaatccgggaagcgtctacgatgacaacggtcgtacgttaccttgtcttgccaacgacgctgcctgtggctacgaggacgtcgatgtacatgtacgtgagttcagcacgcccccactgcaatttctttcttcactacgattaatatctggtctctacacacacctgtgaatattggtttagttccaacggattgtgcgctttactctgacagaaaat

SEQ ID NO: 72622 - DNA, 688 bp, Oryza sativa
ttcaagtaattggtcctcatcaacatgggaggagggcatgttgtaattggtctatacgctcctccatcacttccctagttccctgtggcataaccgggaacccgttggatatttggtcattatttgatatattttaatccagaaatatgatactaaacctaacttgtgtataatatggtggtctagtgatagtgctaaatatgaatatgctaagaacaataataacatcatttagtaacatgtttaacattgaaataaagagaacatacctaaaaaatacttcagatccaatagcggtgttggtgttgatgttcctaatgtcggtgacaaagcaaagagcagttgcacaaagaatgcgtacccaaaaacttgatcgtccacctaagtactatatatgggggatacacttccggaggcctgcttgtcctgaatacctgggcgtgcaggtacttaggaccggggattaccgaagttacttataagcataagaacatgatgtatctaccagagagaaccagaacaagacgaaggaacatagagcttatgtgcgggagaattctttcggacaagagacagtgtttttctacctcttagggaatgagaacagacaccggtagtggaagaggtatatgttgtttactcctcttgatggaagagagagcttatgtgctacagagttctttcggac

SEQ ID NO: 72623 - DNA, 1736 bp, Oryza sativa
agcgaatgaagatggcatcagcagaggttctcagcgacgacgcactaggggtggtggtgacttgaagactttcactaacggaatctggccgtttcagcagggtgtggtgaggtgtaggttttctttttctggttctatgttctcatcgttgaggtgtgagtctaagtgctcttgtatctttttggctgtgtatatctttcatggatacaaaggctggataaatgaaaatccattatcacaaaaaaaaggatttacaccaaatcaaacagaccgtagaaaggattgatcacgcttagccaataattcttttattgatctattaagctaatatttttcttaatttggaagacgacttttctttcattttttgatgtttgttggaagattcttctgctgcattccaaccagacgttcctgttaggatacgcataggctacggtagcataaattaaattttttctaccgcgtaaaccaggacccatacatgtattagatcatagatcattatcattcgacgcgctgcgcagcggaagaaagcgataagaaggcgaaggaaccctcaggatgtagcgcgcgtcgatgtagaggaagtagttgaccgcaccagctcgaccttctccttctcgtgcgttctcctcgccgtactcccacgctgatcaacaccgcaaagcagcggctcctctaccgtattcacatgtatagggacggaacgccacgcgcagatgtgctagcacatgcgcgcggctagggttttgctcgaggaggggagtggcggctagggtttctcacgtgatggaatacctccgccggtcacacccctcacaaatatatagaatccatgactcgggcctccaaggcccgtaggactcctattcggatccctatccgaattaagctcatattggatctccatctaatccccttattccggcccattaagcgtgcgaccctgtagatttatgtacactcggctgcaacccgaaaactccttttcggtctacgtgtcaacagcggcccctagcagaatgtattgatcgaccgggcatgcacaaagatcatctcggttaaacctctagtatatacttgtatgaacccctttcccttacgatatcgattaagctcaaggctagatatgtgccatcctcttcgcatggattgaaggctcgctttatcaccttatttgcatatgctttctcctataatattaggtatatgctatttccatataatatgaaccatgtatagcatatagtatatcttactcgtaacaccaacactatcatggagcaggtgatcgacaagaacatggaagaaattaaatggaatcttggagcataggaggagcgaggagtaacggtgatcttgttttctcccctttttttagcaacatttttttatattttccttgttgagaggaatggtgatcctctgtttgctgtcaaattctcaattagaacagaaataaccgcttaggcaatattcttttctcgtcaatatacatattttatcttaatttccgttagcatgttttttcaaaccacgaaatataccatttatgaaaattttatatacaagtcattttaaaaatttagataaatttatttttaagtttatactccatccgtttgataatgtaaaactttctagcattgcccatattcacacacacacacatatatatagatatatgtatatacctagattcattaatatttatatgagtgtgggtagaaaat

SEQ ID NO: 72624 - DNA, 15918 bp, Oryza sativa
ttttattcaacagaatgtttgtgatcctcttttgcatttctacacaaaacatagtgcctcgagattcaactaatgcataagccaataattcctgtgaaaatcaatgcacgtgcaaaaaccatttagcttcaaatacagaacatgacagattctcagatacagcattatttattgttaaccaataaaatataacatggtacctgctctaaaattaagcctaccaactttgtaggcaaaggaggtgtacaacccataagagagtggtacagaaggggagcactatcaacactttcatcatccttagcatctttgtgtgttatctgtagtgtgaataaccaattaaatgaaatcaatagtggtcttggtagcaacataattcttttcagatcagtaccttaacccacaacttgatgaggactaatgaactgttcaaaaattcggatgtgctatcattagccagcaattcagacaagctcttcacaataatatcaggtattatttttactccacatctatggagaatgtcaaccatcttggtaatcttagcaaacgcatccatactgatgtccttcaatgtatctttcggtatatcctcaataattctctgttcgtcctggcttgcagatagtctatggtaagaaagcctggcatacacccatactgtttgacaacatagctctaaagcctttggtgcctaaaatagagaaaatggttttgaatttgtggttaaaactcaaaagcatgttcaagtaaatggatcaacatctcagaatggtacctcatccaaatgtccaatattgtaaagcgtcacaccgatgttaccaagtgaggacatgagaaatttgatctcatcaagttttatccatgtacttgaaatggcacatttgatgaaggacacgctcttctggactatgaaagcaagatacattaataggtgataaggatgcaattctaattagtaaacagcaggctatgtaaaggcaatactccactaatgtcctttggataggagaacaacaaacagatttacttgtaagtcaactgtttctatatgtaataaaatgatatcaatattaaaaaccaacaggctgaaacaaggcatactgtagttgcaaaagacatagtgtcagtgataaatggtgtccgttcaaattaatcagattcaatctatgtgtaaatacttcacatggtcccaaccatcacccattgctcaaatcagtcctccaacttaagaaacaagtcatactagcacatgacctttattagttggcccattctcgtccatattctgggtcagcagccaaggttacccaacaagaactatgagaaacgaatgaaataccctctaattatttcactgcatggttttatgcatcatgcacaaacacaacagacgctctgttgggtctatgagcaatggaaattaaaaaaatgttaatggagagcaaatttggtcatttcatgtactctaggttggctggagatcctaggtgctgactcagcatagagatgtgtgatgccacatacacacaaggactaaaagagctaattaatgaaattcgaggattgatttgactagttgaaggaccaacgtgaaccacaaacagtaattaagtgaccaaacgaacaattaactccaagatagatacaggaaaagcgaatggggtacctggataccttcattggtaataaaagaaactttcattgctgaaactagggctctcagcaaggttccatgttgttcatgctgtttatccttgtctccttcaggcatttctgtacagctgtcacaagaaaattcaacacgcagaatcagggatcccttttgtttcatctatatcaacataactattttgcaaatttgctcatataaacataggtgggaaccctattgactaagaacatatcaataattgaaaataacttgcaacatagtgtagagctgacaaatgctgcctgtgtatttctgatgaacctacctataagctgcaatgctggaattgataaactgatgcagtgctgttaacacataggtcatgtttatagaataattgggtgttattccttcagagaagttcttccaaactgcattcacgtactgtgataatatcttgcaaagaaactctagcgaatccaggtatgccacaaaagatatatggtcatcagagtgagacaaactgttcttcttattagaatgcccaggctgcattgatgaactagaagctttacccatagtatcaagtggaatggatctaccattggcaaaacaaaaaagatgtgccagtgtggcaagggcactctttaaagtttgtagatgcttttcatcattaagaaaatctgtggatttatgaggccgctctctattttcaatttgctgagcactacagtataatccaatggcataaagaataagtactgaggcagttgcaggggttgaggaaacctacacacagcaagtaattgaattaatcaaaagcactgcttgcattgggatggtatgcattcacattaaatgatgctaacgaaatagtacagcatgtacctcagagaaataaccaccttgttcataaattagctcagcagcaccaacagataaatcccaatttgaagaaacaaagcttcgagaaaaatatgctacaaattctacaagcccatttacagcccttggtaagtcagcctgaaaaaggttacatcacttacatgacaacattacacaggtaaagatgccttggcagaaaaacaggttgttggctatttatggaatgaaagaatagacagatgaaggtgtcattgcacattacaaataaacaaatcaggccagagtgcgccacaaatctgctctccatgacctagttgtttctagtcattatcacttagcccatcagatggcacatgactacattactcaaaagagggggaaaatgatacagtgaaacagcaccgatcagtcctcgatgatatttaacataaaggaataacaagcactggaaatggtcctatataaggggcattcatggttaccagtttaagcaaattaaaatgtaagagaaactacaaactagaaagaggtttccagctgcataaaaacaaaggaagcatgaaaatacctttagacatgcagcagacccaacaacggtctttaagacatcaagcaaaagctgagtgcccccaccccaactcacatctacagatgaacaaatcttgcgagcaacctgatccataaaaatatagtaacatcattgactagccacgttttttagcaaattcgagagggtaatcaattgtgtaatgatacatactgccggcaagcgttcaatagtttgcgccttcatacactcccccaaggttgcacgacagaattcacacacaaggttggtattgaacactgaatattcagcaaccaagagaatggcacagcgacttaatgcattcacaagcagtgtcagatacttcctgctgacatcctcagccagaatcctgcgcacacagaagtacactttaaaccactcatttcctattttattaatcaaactgaatgcaaagcttagctgagcacacaatctcaccgaagccatggctggagttggtcaacaaggctgacaacccgttcgtatggggcagcttccttcaccttgcacttgctggcacaattagcaaagcacacggtgagctcaatcgcgaggatggtgacttcagggtccgcaccagcctcccctgagatgccaggatcaggaaggagggaagcaaaactcgcagtcgcagcacggcgagactttgaggccgtcggcactgacagcacagaccgaagcgaatccagagtggcagcagcgtccgcctcggcgcgtgcgtagtgtccgcgcgactcgaggcagcacacgaatcggccgcgctggagcagcacggagtagggcttcccggcgaggcacgccgatatgaccgcgaggcagtcaaggaggagggcgtaaacgtcgagcagctcgtcggtgcacccggcgtcgcctgagctagggttggggcggagtagcagcgggagtacctggagcgcgcggcacaggaaggggaggaaccgcttagcgagcgggcggaccgtggccgcgtcgggtggcggcggcggcggctgctgcttgcgctgcttcgccgtcctcttcgccggcggtttggcgctagggtttagcgtgggtaggtagggggagaagggctcgaggtaggcggcgaagcgggaggtcaggccggattgggaggacggggaggagagcgcggcgaggaggtcggcggcggcggcctccattgccgtggtgcggattgcgcttgcggcgccgcgtgtggggaaatttttgtgcgcgtatttggggatttcggggacggggatgggcgggaaaggaggaggatttcggagctctgcgcgctggacagaggagataggacggtggggaccggcgaggaggaggcgtacgctggaagatttgattaatgggctggtaaattatcttgtgggctgccagtgggcctattctgatgacctctatatgggcctcacttcaattcaacaatttggttagtgatgcaagaagaaaacattagccatttccaaacatttgaaaaatatcaggcagaggagtgagttttgccgacagtcaacacaatgtaataacagattgttacagtcgtagtaatatctcggttttatttgctctagtatgaccaatgaaatatacatcttgattctcaaatgaaccatgtgcacaaccatccatcaatctacactctacactttttccatggccatcgaatgcgaccgccgcgcgctactccgatgtaccggaactcgagagagctccaaactttgaattaaaatttatgcaactatgctacgtatatgtacagtttttgcagtgtcgtacactacacacgtcacgtttcagaagacgaggcaggacttgtcgaggtcatagcccatcttctccaggcccggccgcaccgtgcactcgaccatcgccggcggcccgcacacgagcgcgagcgtctcgccgtcgcccggcggcaggtgctccctgagcgtccgctcgtccaccctccccacgccgtactcccacccgtcctccggccgcgccaccttgctcaccacgtaccacaccttgagccgcgccgggtgcgccgccgcccaccggtcgatctcctcccggaggagcatgtcgtcctccgtccggttcgcgtacaccacgtgcatctccgttccgtcgtcgggctggtcccagagcacggcctggatcacctggtacaccggcgtgatccccgtcccgccggccaccatggcgagccgccgcgcgaaccggcgctcgccgttcaccgtgaaggcgccgcggccggcgtactcgatgtgcccgatcgggcccttgatgtcgatggtggcgccgagcggcaggtagtccaggtactgcgacatgagcccgccgtcggggaacttggggtcctcgcccttgaagtatatcttgatcaggagctcgatgtagccgacctcgtcgacggagctcgtcggcgtgtacgcgcgcatgcagagcttgccgccgatcgacgcgcacacgtacacgtgcttgccgaccggtagcccgagcttctggtccggcgacggcagcgcgaaccggaacaggcgcacgttgtaggacaggctcttcttgtccatgagccggcatttcaccttctcccgcgggttggacagcgcgacggtcgacaccggcacggcgggcgccgccgctgccgtagggctctcaacgatggacgtgaggtcagcactgctgctctgcggcgagtagtcgctgccggtgacgatgagctcgccgatgcggtacatctcgaggaggccacgggccttgtcggagtggatggcgtcgaattcctcggtgcagtcggtgccggcgttgatcatgatgctgtcggcgccgccggggtggtccttgaggaaccccgtgcagtcgtagacatggccgtgcacgatgatccaggcggactccggcgtcgtgtggcggcgcacctcggacatggtgtactgcgtggtggccgtgttgaggaacggcgtggacgtgctgcgcttcagcgtgctcaccgcgctctccgacgtctcgaggtgcttctgcctcgccatccacccgccggcctggttgcccggctgcgtcgggtgctcgaacaccagcccgatctcccccttgtgcggcctgcacgtcttcgtcttcaccctgaaccagcagttgttcatcatgccctgcacacacgcacacgaaccaaaacgtaagcacatcgtcgtcgttgaaacggatggcgttgccgttgctggtgcttagtgcttaccatgagattccaaatgagcttctccggctgggtgttgagggactcgtcccaggcgcggacggcgatctccttggcggcgagcagctcgagcacctcgacatcgacggaccagaagcaccagcaccagtactttccgtacttggtcggcctctccgggtggtcaaggttgcacacctgccacgtctcgccgccgtccagggtcacctctacccttgtaactttccggccaccgcctggcaacagaaaatcatcaccgttaatcacccattcaccatcagtacaaagatactgatattataacggcccagtaaaagcataaagtgatcatggtgggcttttagaacgagcaggccgaagcccaaaaacaaacaacatgatagatgagatgggcttggggcttaccggagtaggcgtatcccttcatcgtatacggccgctgcgtcgtcagcgcattgatggggagcacctcatcgtgtcccggcgtggtgatcaccgagtttatgttcagctcgtttatcatgtactccggcttgtaccaccaagctgcacataatccaaaaaaaaaacacacaagttaagatcacaaagatgcaacaatgtgtgtctcgtgcagtgcgttcgaggaagatatggttggttaattaccttcggcattggcgagctcggcgtcgacgtgagacgggaggacgcggttgtcgcggtaatggtagtagctctccgactcgctggacgcgacgatgatgcgcttgagccatttcaccatgcggccgccgatgaagcccgggacgatgacccggacggggaagccgtggtcgggcgtgagcggctcgccgttctgcatgtaggcgaggatgacgtcgtgggcggggtccatggccacctcgcggcgcaggctggtgccgtacttgcacccgccgccgcctgggaggtcctcggcgccctcgaagcacacgttggccgcgccggcggaggcgcccatgacaccgcaccaccgcagcacgtcgcgcagccgcacgccgcgccacacggaggtggagatggcgccggggccccagttgaagcccacggtctggcgcaccatgttctgctccttgcgccggttgcccgcgcacaccagcgtgacggggagctccacggcctcgaacccggtcacgagctgctccatgttgagcctcgcggggcgcttgacgagcccggtcacctccacggcccacgtcgaccagtccgccttgggcacggcgccgtggttgcgcacgtagtggagcggcgccggcgtgatgaagccgtgcgacatgaggcgcggcagcggcggctcggagttgaacgggtgcttgccggtgagccggacgagcgccgggtggcgacgcacccacgcgtcggaggtggcctcgtcgcgggggtccttgacggccggctccgccacctccagccgcgggtggtacagcgacctccagtccggtggtatgctgtcctcgtcgtcggagtcggtctcggagcccgaacggcgcttgccgccgccggacgggaacaagtcgaggttgctcgacggagcattgctcgcccacgggtgcggagccagcttgtactccaccgaggccgccattgttgccgatggaaggacacaatgttacaattttgcggacactgtaagctgtaggttgtagctgtggttactgagctagaagaagagatcactcgcgagctagaagctcaggatggcatctgttcttggaagcagtggaggtggtggtctggggtttatatagggacgaggaacgcgaggtcgtagtagttgcctctgctctgatgcatgcacggacccaagcaggccacgagctggcgtcaccacacgcgcaggcgcgcgatgggatttctagggggattcggccggattttttttcttcattttccagattaataccggcgacgtgacgtccatccctgtagcagcctcccatctaatacgtcctttcaattcctcttgtactagatagaaaatgacctatttcttttggagtttcagactgttgggagtgaattttgatcactctagggatggtcgatctctcgttatctgtatgttacttaaaaaactagcatggttgccccatgcagattgtgcggctagcatcattatattttctttcatataatagcatatatgttttctcattatattatttaaatatattaaaatgacaacataattttaaattttgcaataactttataaaaccactaatgtgtaatattcatattgtattttatatacgtgttagttattaattatttttaatatcaaattttagttatttgtaaattatatatattcctatatggactctacactcgtcttttaatatttctttttttaattctgaattttcagtgctcttctttcaatattatttatttttatttctgaatttttattatttataattgtatttctatgtggactttaaacttatctttcaatattatttaatttttaatttcgaattttagttacttctaaattgtattcctatattgactttaaactcttcttcctatgtttttcttaaattcgaattttagttatttgtaaattgtatttttatacggactctaaactctacttttaattttattatgtttattccaaattttagttagttttaaattcatatatgaactctatactctacttctaatattccttattttttaattcataatttctatttttttcttaattgtatttctatatggactctatactctacttctaatattccttatttttaattccaactttctattacttcctaattgtatttctatatggactctatactctacttctaatattccttatttaaattatatatattcctgtatagactctagactcgtcttttaatatttctttttttaattccgaattttctataaattgtatttctatatagacgctatgctcttcttccaatattatttatttttatttctgaatttttattatttctaattatatttctatgtggactctaaacttatcttttaatattctttaattttcaatttcgaatttcagttacttctaaattgtattcctatattgactttaagctcttctgctcatatttttcttaatttcgaattttagttatttgtaaattgtatttttatacggactctaaactctacttttaattttattatgtttattccaaattttagttagttttaaattcctatatggactctatactctacttctaatattccttattttttaattcataatttctatttttttcttaattgtatttctatatggactctatactctacttctaatattccttatttttaattccaaatttctattattttctaatcgtatttctatacggactctatactctacttctaatattccttatttttaattccgaatttcagttatttcctaatcgtatttctatatggactttatactctacttctaatattccttatttttaattctgaatttcagttatttcctaactgtatttctatatggactctagtctcctcttctaatattccttattttttaattctgaatttcaactatttctaaattgtatttatatatggtctctagtctcctcttctaatatttcttattttttaattccgaatttcagctatttctaaattctatttctacatgaactctgctttttctttttctccgattaatgtgagaatttataggccatgagagcgaacgtggaggctcctttttctattcctttaataatataatagattataaaaaataaaaaaaataaaaagatgtattaacatatgatatatcgctccataaacatacaagtttaaattcaacttatacatctcgaaaaaaaacagacttgatcatgaatatgatgtactttaatttgtttttttcgttgcaggatatagaagttgaatttgaacttgcgtggagtgatatgtcacatgttaatacatcttctcaaaatttttcaatttttttataactatttaagtgacatgcaaattatgagaggagatcaaaatagttttctcaaactgttgcactattttcacatctgcattgttaactctggtgagaatgagcagctcggactgttcaacctctcgtaaatcagacacgtgcatacgtgcctggtaaatgccgtggccgtgttatgctaaacacaggctgatggattagttgatcgaggttcaaaaaagaagtttttttcctgacctcctaataaccccagctttaggtgcaagaaaaggagacggcatttggtggctgccggatccagccacccccgaatgcagcttgcctgagaaatgacctcgcccaggtgaatcctggggagctcatggacacggacaccgggcatgcacacacgcacgagccccactcggagatcctgcctgtacactctcgtcgcttctttcctgcttcctttacgcttctctgaatgatcaacgccaatatactaatcaggggcacggacccgcgttccatggtggatggatacgtgcatcggcaaattcgaccagccgacctccattagatcggctgtgatgcagcattggagcgatcataatttagtagctttctttgttgattccccccgtgttccaggacatgcgtcaggggcaaatatttttagcaggtgaaagcctgcaagatcatgcatgagcttgcagcaaacgtcctatgggagttgttcagaactggttgattaacagcggcttggttagtttgagaagccgagtattgtagttatggaaatggcctctaggatctacagagcaggcaccctgtggttttaattactgtaaaggcaagttctacttgcatcattttctcacataattaagtcaaaagtcagagcacaaagtcataagcacacagcaaattcccagctctctcgagtcgacacactaaaataaaccaaagccttgatgcatgaccagcaccccgattccctgtaaattaatataaaccagacagaacaatactaatccaagcatgatgcagagagtatcttatcacaggacataacatagaaagatactttcccattcaaaaggaaatgaaaaaccaaatgattgacttaacccaaagtataagcagcaacagcaggtcgggtggtaattaacaatggcttggcgcatggcattttccaatggccaagtaaccggtgggaagctcggaggatacttcatcacatcacttgctggctggtttctttcagcagcagctgagctgcctactgtagctgcatcttctcaatatcccaaagccggccggctccaaagcaggagttgcctcccgccatcgccaagggccaactggaccaagccctggtccagaggcaggcaggagagtagtagtagtagtagctagtagtagcagcggtggcttgttagctagcttctggagtccagccttccccagttggcgactctgccgctgcgtgccattttgatttcttgagagatctctctttttcatggatttggtgttttgcgagatgcatggaggcaacaacctcctgttactgacgttaaagtgttcgactcgccatcagaaacgtggtctgccagtatggtttgtcgacattgtgactttgtgaggctgacacttcattcacttggctttaggtctagtagtatcctaatgtaaggtggttaaatatctatcatttcctgtatagaattttttgtttgcacattacaaaacagtcattgcttcgcttattctgattataagccacaacagcttattagcaatcaaaaaaatatataaataaaaattatatatatgtgttcttaattagcaatttaaaagcaaatggtgaaaaataagctacaatgaaaagacccccaaaatcaactttaaatttaagtttttaaatccaaaattttgctgcagcttacgagctgagggtaaacaatgggagttttaagagagtaagtgttttctaattggtgcagccctgagaccctatttgagagaactattagaccgtagcccctgtggagaagagtgttgtcacgccccgaactaatcccgaccggaactagcccgtgacgctctaaattaacctgttaatcgatatcagtcccaggaaacagtgctggtatcacagggagacagaatatcacagcaacagaggtctttttattatagagtagaggtacagtcatgttgggctgcggacagatcccgagctcacaactgcaatacaaaagggaaacggaagccaggacttggaccaaacaacacaggcgcgacttgggaactaggccgaaaccctaaaactcatcgtagccggcttgctcctggaagaactcctcatcggcaggttccgcttcatcttcttcagcaactgggggggattatttatatagagcaagggtgagtacgggagtactcagcaagccatgggaaataagtgtttaatgcaggcttcaaggaaaggctgttgtttttgcaattgatttttatttgaactcttttctgaaaacaactaagtgagtgcttctcaaacgacacggatgggacagtgcgtctcgtccggtcggagtatgtgcaatgtatcagtctttagaattgaaacaaggttggcacccggccaacagcttttcaaacggccacccgggccaaccactttcaaacggccacccgggcctagctgatcccatcagctgcagattttttttttaaacatcgaacccctttccacaacagtaatttcgcaagcagtagtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgacaggaagcccaggggtcctccccgacaccaccccggcgaatccacatgtctctcggcatcaagactcccctgataagctagttactcagccaggggtgtcccattccacccatgtggtcgtacttgtgttatgtttggatgaaattccaaggaaacggtccttaagtgcaagagcggaaaaccgtacacccggtacgttccccggtccgcggttttggaaattcatttagttcacaagcaccgacccaggtgtcgggttttccaagtcttttgtaaaacccaagttttacccaagttgttattcagattttaagtttgaaggcgtccgtcgatactcgcacagggtgcacgaatatcgagacgcaactagatggatacaaggagacatgatataacaattaacaaaggaaggatcaaatgcaacaaattaggtaggtccgccaatctgccttgcagacgggacaacagattaagtgcgatcctatcaatgcataatattttacaagcaacataattaaatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaaataaagccctattaatgacctctaagtgtgccattagttagatctcgagatttgaggaattttggaagttgaacggagtcaaacggatttacggttgggaagatattgaatttctaagattattggatttttggtctaaaggaaaaaggatttaattaaatcctttttggaaaagaaaagaaaagaaaagagggagggaaattagactttcctcgggcggctagggcgcggcccgagagaaatggagcggttcggccgagctaaatgggccggccggcccaaggcggcccaaggcacgcgcgcgcgggaggggaggagagagagagccggtggaccgggctcaccacgcgtggtcccgagtgggacccgcttgtcggtgacacggttcaccgtgcggagcgagcacgcggcacacgcgcgcgggcgggggagggacgcggtgcacgcgcgcggttcgcggtggatgcggatgcggcgggcccacgcgcagcctcacggctcgcggtggaacgcttggccgagctggcgccgacgtggcgcctacgtggctgccacgcgggccggcgggaggtagacgacgacgccggccggaatggacggcggacgacagcggcgagcggcggagcgaaccacggcgatacaggcgaaagcgagcacaccgggtggttgcacaggacgaggggagacgagccaacggctcggattcgccggagggagcttgacggcggcgaattgcggcggcggcaaccggcggcgggagaaggggaaaacggcgacgaggtcacgaggggccgattcccggtggcgagagcatctacgcggctacgggaatccaatgctagcgttggattaggaggaaacgcatcgagggaggccggcgacgagaggcgcttccgagctcgggcggcgacggcggcgggcacatggcgagcggcggcaacggtcggggcggcgccggctagctatggggaggctactcgtgctactacccgagtctaagggaaggagatggaacgaggaggaagaacggagggaggctctaccgagatgaggtggggcgctgtgacgagaggccgacggcgcaggagtgatctatccggcctcgggcaggggaagaggaaggagacgagcgcccggagtccccttccgcgtcctcgctcgtgccggctcctccgacgcgcgcgacgacgaacggcgacggcgaaacagaggggtggcaataatggagtggaggcgatgggaggagaagagagggagggcgcccggggctttaagggcggcaatgtcggtttggaaaccgactttgggcggtcaaggcgcgagctggcgctcggcgctcgtggccaaatcggcgacaggacggagggaggatgatgccggcgggaggaaaaggggaaaaggagggagagaaaggggcttgcctccttgccgctttggaaaaaggaggaggggagcgggggcgtcgcggcagagggaggaggggctctgcctccgtcccttggcggcttgcacgcggagtggcggggccgaggcgatgacaacggcgatgacggcggggcggtgtggagcggagcggcgacacgggcgacaggcgtgggcaggcgctgacgacggcgacgaccaggcggtcggccaccacggcacgcgcgcgcggcttgcacgggagacgcggcggattgagtgccacggctcgggcacgcgcgctggctgcggggccgagcggcggcgcggctgcaggcggcagggcagcgggaccgggtgacgcggacggcgcagacagcgcggcacgggcggcaaccacgcgggcgcgcgcgcgcgaacgacgcgcggggagcggcagcgagggagcggagagg

SEQ ID NO: 72625 - DNA, 14379 bp, Oryza sativa
cggtggtagggaaaggcggcggtgccggtgggatcgccggcgaaggggaagaagggaagagaaagagagagaagggagtgagggaggaggaaggaggactgacatgtgggccccacatgctagtgggcccacatttttttttgtgtgaatgactaatgggtcctacgcatattttttatttctactgccacgtaggtgccacgtcaacgccacgtgtaacaaagactcggtcaatattgccacgtaggcgccacgtggcgccacatcagcaaaaccgctcagggagtcaaattgcaccggttttagaagtttaggggtcgagatatctggttttgtagtttagggtcatggtttagatttcgatcacatttgagggtcatggagtgaacttattccttatactgggcgccgtatcgagggaagtatcgaccatgtattgatgccgtatcgctcatttttttttatttttttggctaacaaatcagcgatacttctccgataccgtatcgctcgcgtatcccacgtatcgccgtatcggatacgtatcccatacgggaacggcggcaaactgccgtatcggtgcatcacaggtgaacactcaaaggcaaccctttgggtcacatgaatttcagaaacaatattattgccttgatccatgtactaactccacgttttaatgcatgcaatatttctttttccccattagatgtggatgctgaactgccggcatcaaccgtatcgcgaagaggatggtgagctaaggattgttggtcctccacaccagcacgctcatctcaaacgcgttcgcatcagtggtttctttggccacaaagaccaggtggagctagcacttcacatccttcgcagctccatgaccctcgagcagatggtgatcaccccaaagctagagattggcaacgatctggcgttttcagacccttgtgctgatgagtacgagaagaagcattacgtggatggccatcgagtcgccactgaatttgtttgcaagacagaccatcgcaatgttgtcactgtggaacgggtggtgccagagcctgccgacggcgaggtggagcgaaaacggagaagggcaaattagacttttgtctagaatgttaaatttgttagatgtgctcatttttagtttttactggtagtatcaaacaaatgcaactggtaaaaagatgaagattagttctacctccgttctaaatataaaatactataaggagttctcgttatgtgttatgtcactacagaaattgtgatttgtagtgagtgtgtggccctttttatggcactgttcttcttttttggaataatgactcaataggttgataattatttgaaggcaccaacaaatgagttagtaaatactataaagttaaaaataaatttaaagtgatattataaaaataataaaatatctttcttcgtcctgcattagttgccgttttatgttatttaaaaaactaaggtttagtaaaaatgactacaatgtcttctattaaatgatataagattgagaatgagaggataattagacttggaatgtgtatggtgtcttgattaatgtgatttaaattatacttggtcttgatatataaacatatatgatgatcaatttgataaggagggagtacttgaaggtgataagctttttaagataagttttgaattaaaacgatgactattttagaacgaagggagtataaaggtcccattcatttctccaataagagtttgatgcagataaagatttttgtgacacgcttttaaaattgctaaacggtgtgtttcgtgcgaaatctttctatatgaaagttactctaaaatatcatattaatctactccctccgttttagcatttcccgtattcatattgatgttaatgaatctaaacatatataatatctagattcattaacatgaatataaatatgaaaaatgctagaatgcattacattgtgaaacggaggaagtatttttcaagtttacaataattaaaactcaatcaatcatgcgttagtactactttattttttattttttaaaaaaacttaatcttcatcttcgaaagaaaaagaacaccaccaaagtttgtttaaaggttcgaaactcaggaaacatatgcctctttcgtaatccatggccgtttgatgcagatctcgcttggcaaagcaaatctccaaattacttcaccttcactattatgcctttgcaaactgcaacctccgctaatcattcatgacggccggcgcatggccggccgccgccgccgccgccacctccgcgccactgtccgccgcggtgcgcggggccatgcgcacgctcggccacctccttccccgcccccaaccctccgccgccgccgccgccgccttctcctcctctccccacaccctccacgactacaaccgcctcctggatgccttcgcccgcgacggcgacggcgacgcggcgctgcgggtgctccgccgcatgcgccactcctccccggcgtgcgcgcccacggccgcctcctacacctccgccatgtcggcgctcgccaaggccggccgccccgccgacgccgcggccctcttcgacgacatgctcgccaatggcgtcgcccccgaccggtgcgccttctccttcctcctccacgtctactcctcccacctccacctcccgtcggccgcgcactccgtcctcgtctggatgtcccgcctcggccttcccccgactcccatcgactacgcggacctcgtcttctccttctgccgcgcgggccgcctcccggacgcgctccagctgctcgacgaaatgcgcgccctcaattacccgctcaccctgcacagctacacaccgatcctccaggtgtactgtgccaatgctgatatgcagtcggctgatgcgctcatcagctccatgcgctccactggatgccaccccgatgtcgtattttacaacatctacgtaaatgggttatgtaaggttggggattttgatgctgtccagaggaccattgatgagagtggccggaatgggtgggtgccagatgcagttacatacagcacctacattgctgggctttgccggttcgggtatgtcgaagaggcactccggcagctggaaatcatggtaacgatggggttacagccgacagtagttggtctgaacatactgctcgactatgttgcccaggaccttgatatgtgggcaggcaaggaggtgctggaacgatgccaggagcttggctttgtggtagatgtcgtgacatacaatacggtcatggatcatttctgcaagaagaggaaatggctgcgtgttctaaaactgttcacagatcttctcaagaagcccataacacccaatgtgcaaacgtgcaacatttttatttcatgcttgtgccgagctggaaagtttcagtttgccaagtttgtgttcagcagcaaggggttcatggcagacactgtgacttgtaacattctaattcatgcattctatgaggccgggaaggaggatgagcttggttttctgttcgctgatgtgaatgcgggtaaaattgccccagatacgatcacatacaatacgctggttgattgcctctttaggtcagggaggagagccgaggctgtcaatttgatcagacatattgatgatggctatcctgttgagcctgttgcacgcttggcgtattggttggttaggagtggaaatgttcgtgaggcattgaggttgtttgatgatatgctagaaaaaggattgttattagatagtaggatttttgctaatgtcatcaaggcattctgcagaaagggtccaggggaatgcacagaaatgctgcagctgtgttctgtattagataggatgcttggaattgggtgatccttctgtttaatgtgtttataacttggaagtgcttgattggagttaaggaaaaaaaagggacaacttgagagtgctcataggtctgccaagtctttttcactactttacatggtagtggcattgtttttggacatgtactatcagtgaatagccaatgaaggtaaaattcctgttgcttttgtcatgcaaattttcattaatatactctgctgatataatctgtcagccaacacttgtaaagtacttgctgtaaaagccccggtgttataatttttttgataaagcatatctggaataaatacccacttgcatggcattctttttcttccttcataaatgtgggatcatgtgcttgtgatcctgtccaatgcttgtcttatggtgttactttgacagtcttcagagttgtgggagcagataaatagcttgctcctagaacttcatatagggtaatccaggaggtcagtacctccagtaaaaagcattggctcttgtagtcttgttggtgctccaatgaatatgttctgaccatgcaatccttgtgatccaacacaaaaatgataattgtgtttattttttaggaacagctggtttcactaattatcagaggaagtgttagtcatgaaacgtgcttctagtcctggtttgttgcattctcattatcttccccccatcttgtctagcacttgcattatacatgctcctttaagaaaccactcgcttgacctgattttgcaaactgcaagcgctgaagactaattcatttgcagttagatgcaatcccggataatcatggatgttccacctgatgatccttataggcaaggtctgatttggtagagctagtcctaacaaaaaagcaagagatctccgtgtttatgaattaaatcaggtagtgttctactaatacttacttttatctgttttttcccatcatggaggaaatactgacttggctgttacttaattcatggcataattatatagctcaattctttctgttgtcctgctactgcagagtaggcgatacttcctccttggtataaatgctacatcaactttaagtcacaaggaaagctttttcttgatcaaggattgacactaaaactctagtactattttgcttcaaaggtattaatgattgatttttcaggtatattataagaatatacaattatctttttaaaagtgaatatacaatgaaacttaactctgctaataacgatgaattaactactccatttagtatggccgaaataaaacatgatgccttttagatagaactaatgaattaaataaggctgctaggctatgggtttcgaattgaattttatccagtgttctggtcttctgggatatcatctgtcaagagttatatatgctctccttgttgactttatatggtttgggtgtcagttgtacagatcttacgtgttatgtgtgctgttgtgaataactgaacagttgggctggttcgctgtaaggaagatctccaggccagcgtggagctacttcaacagacaccagtgtgtcactgaaggccgatagcgtctttgtatggatgacagagggatagtcatagagagttgtcagtgttgatggacctctgaagttctgattatctgtcatcatgtagaaagatagtgttttggttttaaacatcatctgttctatctttttgttggttatcttgtgttttgcgttttggttatcaaatttagcagcagatctaccagctttagtttcaggttctggatcgaggtaataacaaaccatcagggcttggattctcagccatgttgttcctacttgtattccgtgaagctgtgggcagaatgtacttccagttaatggacttcaccaatgtgagcctgattcatgggatgaatctactgaagattagataaagacaagtacgggtcgttgggggattgtaattcagaaaataactgaacttgcaagaaacctcaatggataatttgcattgtggttgtatcaaaactagctgggaattccgtgtactcacattgtttgtatcttcagtaccttgccatctcaagtgtcttttttttttcaggatctgttttttggagagatttgatgttgttcttgaaaaaattagatacagtaaaaatctactgatagcagcgagccgcgagcgacgtgtctcccgccctctccagccaatggcctgcggcgattcaagtggggcccagtttccagcgtcacagaggcgcctacgtgggggctcccacgtcagcacttgcatggcccacatgtcagtgtaaccatcgcgtcgtcatccccgtgcgcttgactctgctctcgtcttcctcctcctcgatctcccagatccaaaccgaacccaaccaagcggccgcggcgctctaaaacctctcccgctccacgcgcggggcgcatgaaaccctagcgagaggcgccagatctcccgcatccggatcgccgccatggccgccgccaccgcgctggactcgctgccggcgccgctccggtcgctgcggctgaagacgaagcagcaggagctcctgctccgggtctcggcgctggcgctcatctacgtgctcgcgttcgtcgtccgcctcttctccgtgctccgctacgagtccatgatccacgagttcgatccctacttcaactaccgcaccacgctcttcctctccgaccatggattcagcgagttctggaactggttcgatttcgagagctggtacccgctcggccgcgtcgtcggcggcaccctcttcccgggcctcatggtcaccgccgcgctgctccaccgcctcctccgcgcgctctccctcgccgtccacatccgcgaggtctgcgtcctcaccgcccccttcttcgccgccaacaccacgctcgtcgcctacgccttcggccgcgagatctgggactccggcgcgggcctcgtcgccgccgcgctcatcgccgtctgccccggctacatctcccgctccgtcgcgggctcctacgacaacgagggcgtcgccatcttcgcgctgctgctcaccttctacctcttcgtgcgcgccgtcaacacgggatctctcgcatggtcgctcgcctcggcgttcggctacttctacatggtctccgcgtggggaggctatgtcttcatcatcaatctgttgccgctgtacgtgctcgtgctgctcgtcacggggaggtactcgcagaggctctacgtggcctacaattccacgtatgtgcttggaatgctacttgcgatgcagatccggttcgttgggttccaacacgtccagtctggggagcacatggccgctatgggagtattcttccttttgcaggtatttcttacacatattgttatgaaatgatgtaacaattcatccgtagcgatgaaagtgccttctaagattagtagctagttacagctctggtttattagatggctagtttagtaaattagcaacagttgacataaaaaggtatgattcagatgaaaagtcccgccactttaggaaatttgcaccacccgtcttaattgtcctggaaatgagttaggattatttgtaactgagaaagggcgaaacacttaattgaaggcaacccgatcttggtttgtaggcaaactatggagtaaattggacaggtaattttgtagaacagttaagatcaaatgacctgttagtacttattgttagtttcatataacccagatgattagatggaacattggcatttgtgtcagattgctgctactctcattttgcctcttcagatagatcatgtttactgggtagacatgttatggaactgtgaattcttgtatgtttgcagtgtgattggtggcccatttatgcctggctgtaaaatgtgagatgctatactctttactcttgaatatgtcccacagccaacataactcaatgtcgttattgtgtttgttgtgtgtatatatcaaacatagcgtacctttgttatttgttaatatgaatgctttgacaaatatctattctattatgaggtactttgtgtactttgtatagatagagcagtatagcacatgtataagagagctatcataaaccatttcctctttttgcaggttttctttttcttggactgggtgaagtacctgctgaatgatgccaaactattcaagtcattcctgagaatcaccctgacatgtgtgataactgttggcaccctagctcttggaattggtaccgcgtcaggttacatctccccttggacagggcggttttactccctgcttgatccaacctatgcaaaggaccatataccaatcattgcatcagtatctgagcatcaaccaacagcgtggtcttcgttcatgtttgatttccacatccttcttttcctgttcccagcaggcctctacttctgtttcaagcgcttgtcagatgccacaatatttatagttatgtatggcctcacgagtatgtactttgctggtgtgatggttcggttaattcttgttgcagcgccagctgtttgccttattagtgccattgcagcatcagctacaataaaaaatctgactaccttgattcggacaaaaagcaaaagtccacaaactgtctctggaaaatcatctggctcaaaggcagctgcaaaggtattcccttttttttttttgtctatgcttgcttgcatgctttatattttgtatatggatagttgaaataaataaatttgatggagcttgaaatctgaaacatacttagataaaatcaagtggtacaattgaaatcctttgtttccgccaatcaataccctccagagtattgtgccatttgaaatgctggattgcaattttccagtttaccatgtgcatggctgataagaatataaaggatttgcgccttttctctgacaattctaattccagtaggttcaattgcacataattttgtggttttcagtttgcttgtatcaattattttaagtttctggttttcacatcactcagaagctgacttggtttcttgtgtaaacagggtgcagttgatcaatccttgcctttccagcagaatgtggccattgctttacttctgggtgctttctacttgcttagtagatatgctgtacactgcacttgggtgacatctgaagcttactcttctccttccattgttctggccgcaaggggtcataatggaggcagggtcatatttgatgattatcgtgaagcgtattattggcttcgtcagaacactccttctgatgcaaagattatgtcatggtgggattatggataccaaatcacagctatggggaacagaactgttattgttgataacaacacatggaataatacacatatagctacagttgggcgtgcaatgtcatcctatgaagatgaagcgtatgagataatgcagtcactggatgtgaattatgtgcttgtcgtatttggtggtgttactggttattcttcagatgacattaacaagtaagtttatccactgaatctagagcaaattttaataaatcgatgttattggttttattcgaattagtattgaacattttttcaaaaactgaactacaaaatggattcttacttagctgcttatttccaggttcttatggatggtgcgcattggtggtggagtttttcctgtaatcaaagagcctgattaccttgttaatggggagtatcgtgtcgacaagggggcagcaccaaaaatgttgaattgcttaatgtaagtatgaaacacactaatgagacttatttgtcaacacatgtactattttgttatttatccgtgttacttctatccttccatcacctctaattgtttcctctcttgtttgacaggtacaagctttgttattaccgttttggagaactgaccacagaatatggaaaacctccagggtatggcacatccttgccattgttattgcttttacttcattgatttatttaaatagatattacattgtactctgtattatattttggttatgaatggtttccctaataagccaggcaccataatttgctggttgtagcttgcattgtcctatttgtataacaagcctgtttttgatatggtaatggatgctagctctgctatttattttgtatgtagatacgatcgagtacgaggagtggagattggcaacaaagacattaagcttgagtacttggaggaggcattcacaacttcgaactggatagtgcgcatatacaaggtcaaacccccgaagaataggtcttgaggagaggaatcatctcttggttagtatctggtgctattaccttgaggtacattgtgtcaagtcaaaacgtattggagttcctacaggagacgggcaattgatttgaaaatctgcatcagctgcccccaagtgcgatcttttgttttggtgagactgacggaagtagaccataggtcagtttgaagtaacgatcatccgtcttcccctatatcattttgttagatgtaatcaggtgccattcagaactagcaattgcgacgaccgagtactttttgattgctgagcatggtatgacagtactccagatgtttttgtaagcacaacagcttatttgcgtagtaactttagatcgggttacacgggacacttgcaattttctggtgttgaagacaacaatgaataacttaactgtggttgctctgttttcctctgtgagctctcatcatcttgtggcaatcgcagtagtcgtttttatgttaataaatgatgcctataaacttgcatcatctcattagttagtactcagtactcgctgcctcataaaaaacagcagttcttgcaccctacaagagaactgatttctcgtccaaaccacataagctgaatgctatacgtctcgtacatttcattttgctctactttatatctcattttttcaccactaataaattccttaattgcagtaacctttatatacatgcatctatactactatgtatacttcatctatcctatgtatctttatgtcatcgtgaataaatcatgtattcgcttcatttcctgaagttcacttcgctcctcgcgagaaactgaatgaatccggcaatcgccgcgccgatgatgaaccatgtcacggaggctaggacgatcttgagctcgaagctgttcacgagacccagagcggcggcgccaccgacgtgctcctggatgccgccgccgccgactccggccacctcctccctgttgtaacccacgaacccggccgagatgatcgccatcagcagcggcgccgtcaggtcgatgctgcccaatgtcaccccgccatcgccggtgggggttgctcgccgcgtctggctgcggggaggagaagcgctctgcctccggtgaggtcgctccggcggcgatgctagggacggcaggttcagctgcggagtccagtagtcgtcgcggcgggcgtacgaagccaccgtcctcgccgccgtcgcgcctcccgctttgcgtcgagctgccgcttcttggagcctgtccgtcaccgggtcggcgggcatggaaggagaaggcggcggcgccggcaggtggagagaagcgagtacggtggtcgccggagctctgaacggctgccagtaccaccagttcgagatcgacctgatcgtctgaactgccgagctcctcgattgccttgctgcctccgactcctgcacgcacgcgagcgagcgagattagttaacccgagcttactgtgctcagcttcagctctgcttgttaatggtgattagtgagtcccttatgaaatcacaaggctacttgaatactggatcaaatcatcagatttactacctcggattctctcgtggcagacttctgcttcatctcctggaacctcttctgaaacttgcttacctcgttgaagatgtcgggtgcgcgagcgcccacggtgttgccttccgagacccggactctgccgcgcggctgtttggacatcaagaactcgagagccgcgagatctgacctctcgaccatcctaatcaaccgtacaaaccgaaccaaatcaaccatggagatgaacaaatcaggacaaatcaacaagcagaacacggattaattgggggatttagaggtgtgttggattacgagatgcagtcgacggggcatgtctggatggcgtcgaggatcttgtcctcggcgtcggcccactgcgcgacgacgcgggcgcggccgtagacggactcgacggcgaacgtcttgttggcgtagagcgcgcacttgaggcagccgacgcacctcacctcgtccacgaacaccgcgcgctgctcggcctcgccgccgaaccacgccgagtagagcggcttccccgtgtacccgacgaactccgactgcttcgcttgctcctgcatgcgttccgtgcagatcgattgcctcatcaataattgtacgaacagttggtgtgcgtacgtatatgcgagagatcgatcgatgaagcaacgtacctggtcgtaggcgaggcgggcggcggggtcggagaggagggagtagacctcgttgaggacgatggccatgtcgtggcccttggcgccggcgacgtcggggtggcaccgcttctgcagcgaccggtacgcggccttgatctccgactgcggcgacgaccgctccacgcccagcagcccgtacaggtcgtactccgtcacccacgtcgtcgacccaccgcgcccgctcctcccgcggtagctctcgccgcctccttcgttgctgctaccgccgctagatgaagcctggcatctgcttctgctggttcgccgtcgcgcggcggtgcgcgtggtggggaagggcatcgagacagcgccggtgttcatgagaagcgcagccatggctgccgcgggattaacttgaaattgaacggaattatctcgtctcccggacggctggagctcaattaatgggggagaagagcaagtaagtgactggtcactggccagtagtacagcagaagtgatcgctgggtggcgtcttccggggcgagagctacgtgaggtgagatatttcgcggcggcgttgcgcttttcgctttttgctcttgctgcttggcacagatattttccccttgctgtttgccccggttgcggcaacgcctggactatcgatggccatatggccggacccgacggcacggcccacggcacgtccatttggcttggccccggtccaacagttggactgtgcctgggctgatgccttggcatgttgggttggcccggcatggcacagtcaataaaaatactacaaggatcgaaaatagacttaattcagccagacaagtcgcagcccaaagacaaggaatacaaatttcagccatataagacaaaacccaaagagatgagggaagaaaaacagaattattctatggagaaacacgatgaactgttgtgccttcggaccggaccggcacagccctgcttgggccgtaggtgtagcccgtgggtagacatggcacagcctagctcggcgtgtagatcgggttgtgtcagcccaactgacctcgacccaagccgggttgtgcctagaccgtgccggatcgggtagctcgtttggccatctatagcctggaccaaccatgcaacaatttgctaagagaatgattgtacttcgaaatttgctgttttgaattttgcccctccactgagcggcttataactatatatatttcgcctcaaactgaaaccaaacacttcaattttttaaagaatctacacagtaaaatgcatcgtagctgtacatggaccataatgtatatttacacccatgatttacgggcctatagttttccagttaagcaactaccgtgactacatacaagtagcagcgaaagttgtatacacagacccttaaaaaaaatcaaggtggctaaatgagcatcttgaaaccgaacttgagcatcgattacaaagaacgttaccacatgttattatagtcacgatacctctgcattaaggcatatacggcatgaccatgctgacttggcaacatcagcttccctaactgcagtaattttgctaaaaaaaaaatgcaacatacgctgatcgagcagttatgtttggaaaaaaataccgagttgttaacgttgtattttaaaaaaactagagaactagctgaactatatattagaaaatcaacatagtaatatattatcttacagaggatagataatttgaaagtattagaaattggatttgttttctttttttattggttattttttcttatgcataatttcttattttcaaatttaacaccgctatatggatcaataagattaagttttttatgcaaaacaaggtggcattaacgtatgattgatttagttttaattattataaacttaaaaaatatattaatactccctccgttttttaatagatgacgccgttgactttttatcacatgtttgaccatttgtcttattcaaaaattttatgcaaatgcataagatataaatctcacttaaagtaatatgaatgctaaaacaactcataataaaataaattataatta

SEQ ID NO: 72626 - DNA, 21464 bp, Oryza sativa
cagctatatttgttataacttatagaagttgaattttaacctgtatgtttgtggagtgatacatttcatgttaatctatatcttagcattttgtttcaatttttttatgactatttagatgatatgtacaaaacgaatgaatatcctctcgagggattaataaattttcccccataatgcttcatatgctgcctctaaaaatgtcacattggatagagtgatgaggtgaaggacagaagtgaggagagagattatgagctacttctaaattaagaggtaacctccacacaaacttaaaaaaagatgtgtgagtattagatgattgacatttgtgtgttggaagtgacatattgtatatgttgccttttagtttattaatgaataatatggataaaattaaaggtggcatttacgtctatcatagtatttgctcttgtagtcgccgcggagtccggcaaataactgtcataactttttcttttcttttcatcttctttatatatggctgggtgcttaattgtacatagttactaagtatatatagttagcttaattatcatgcctggtttatgtatcggtatgtctctgaattggtctcgtgtaaaagatttgccgtttgatggaatttcagaagttgccgtacaagaccggtactactagtgttggacatgtcaactgaaagtcgtttggcccaactgagaaagtcgaaactggctcttaacagactagataccttaagaaagcaaaagaaggaacagcatactgacctaattaaaagctttctgtgtcactctatggttcaattcccgcgttttgggttacttgtgcacaacaaaagtactagatcctggagcacaaaaatccaagctgcaaccgagggaggctcaatctacagagtatatattcctgattatctaaccggcctgtcataggtggtgtttggttggagggactaaagtggagctaaactttagtccctctcacaaaaatataagtccctatggtagggacttatgtttttgtaagagggactaaatttagtccctagttcccaaacacccccatagtattttcaggctgaactcttgttgcttgggtcatgtgttgcttgctgttgattaatgagggtgctctgcttttttgagcacttgtctgcatcacatcatatgccaaagtctctccacttaaagtaagctagagacggtactccaaaacaatcatcaaattccagctctattgatggagctccctgtcccctttagcttttggatgagactttggatgctgccgcttgggaccaaacatgcagctagccacagcccaattaaaccttgaacgcagtaatcaggatgtgtccttttccttcttttcgtgtgccatcaatcccattgcctcatagatctatgcatcaacaagcatcagaaatataatacattttcttagtgaaaaggcaaaccgaaagaagatcagaatccctgaagaaaccgacatgcacaccatgcagatagtactaaactggagcacgatttaacacgttgccactacaagataatcgttgtggatccaccagtttattccagataaattaacactgttactctgatagatactcctcctatctctcacctgtctctaccatatatatatacgtggtcatgaggtgatcactaatagtactactatatatagttgacggcaaatttttttggcacagaagatctgaagatgcacacatatgctgacaactgcaggggcagtgtcaagctgttaatgcagatagggaaggaggtaggctttgccaaaggctttttggtggtgttcttctcaaagcataaatatgggtctgatcttgctgtcgggaaggagatctccaatcctccaaacctaggaccacacctactatatggcgcagctagtcatcggctcacctcctctcatcacccttcaggctcagatcaatctgcatgcacaaacaagcaagattcaactagaaagagcaatagtagctggtgggtgtggagtggactcgtaccgctcacatgacccatgggtgtgagcaagagctggagatatttaattagtctgctttgattggttgggaagagccatagaagccacaacggtgggggtagaaagttgctttcaataactgtccacaactggttggagtacccttgtcgttgttgaaattgcacccctaaggctaggattagttcctaactttttcttcaaacttctaactttttcatcacatcaaaaaacttttctatatacataaactttcaattttagcgtagaactaaacacaccctaattatgtctaaggggaggcaggaatgtccaaataacaagatgaaacactctgtgattttacgctgtttggtcacttaaacatcgatctgatctcttttttttccaacaggccgctagaaattgaattaattggatgatctgaaagctctgtttatctgaaaattactgtatcagagcatgcagaatatatatatatatatatatacaacgaagaactagtataattaattaagttgttttcgggggagcatatatgtttctgttcccgagaagactcgatcaggttgtcatcgccgtaaccaatcacgtcttatcccttaatgccagcatgtacgtacggaaaacatagtaggatcagagtagttgctactccagctagctcatgtaaattctctcccggccgggcacgttcgagacaagatagtacacccaccccacagttcatacccaattcaaactcgcatctgtcgagctatagcttagctagctacctgcttcacaactcaggagttcaacatcatcatcgttagctcccttgaatgaatccccgtgacccggagaacgtgtcgtcgtccgaccgtttcagcgtcgatcgatccaacgacaaaagacgctgcggccggcggtggagccagcgcgctagctagctgcacgtactggagttacgtacgtacgcgcgcggcactgcaccgcggtcgacgacgtcgtacccgctccatccgtgcatgcacgagttgcgccccctccccccctactacccctgctccggctggtaggggacacccctcacatcaacccgcgcgccgcagcaaatccatccatccatccatgcaaatgttaggttcaccggccggctcgtttcgctacagatgcgcggattgcgccaccaccgcgagcgcctgatcgctctcgcgtgtcccgcgagatgttgggcttgtggctctcgcgtgagatgccggtgcgagccgtggagtacgtgggatttgcgtgtgagacgccgtaaattcacccgacccaccagcagtccaggcgtccagcacgttggatagggtgggggatgctttgcttattaagggaagaacatatgagcagtagtactgggcgggcgcgcttgctaattaattggtttttgcgcttgctcgtgctcgcatgtggccgcgaactaccgtgaattaatgtgtttggaatttcgacgtgatcgtcgcgagtcgttattcaaaatggagtactgcgtactagtaccagtgtgtaactgtagtgtgttcggttaggttcctgtacgtggaaccagctccagcaactggtgacctaagcttttctctagtttctttgtacttgttgctatttgcacggctgcctgcagttatactaccaagcactttaggtacggtacgtgcattgtagatgtcacttgtttgttactgcttcgtggagaagtgataccgatttcccaggagttaaaacttagcaaatcttgtacaaaaaagtgctctcgtttgaaaagaaaaaggtccatcaaaatagcatatactagatgccatatatacgattttctatcaatcagaaagatattagaaaaacgtaaaactatgtacagttacaggctacaacaatctgaatgtctatgtaaaaaaaggtgaaacaacctttctaatctactttcacaggtcacaacgaatacgaaataaccattgctcggacagggagtacagtacatcagcatccccattcaccggtctcgaaagctatctctacgcaatttatgagaacgacagcgcgcacagatcaaagtttgtacaccccgtccttgatttcagtacacaaaggcccggaattcaattcctttgccggaatccgtaggtggtaggaaaagccgtgcatggccgggaccccggcttgtagtactcgtacacagtagtcgtactctacatcagtagtagatcaggccgtttgctgaacatgcccatgacgcccattcaatgatacactggctgtagaggagtagctttttttttttctatctcaaacgacatgcacagcactctgagcatcatttaaacgtggtcccaaatgtaagcgctaccctctgcatgcatgcccgattcattcgtcacttgcttcatctgtttcattgcatcatgcatggcacacaaaaggcaacgacacatgcataacaagcacaaaaagacgcaaacgaagagaggatagggtccaagtgctttgcactagggtcttctatataattttagaaccgaatgtaggagaaagattttcatcatctaactatctaagggatatctcctcatttttttcatattatttatatagttaaaaaaataaaacaagatatatcaatatgagatatatcactctacatgtcaaactcaaattttacaagttgtaaaaaaacttatattaaagtttgaggcgcattttattattaaagttttattttggatcaatcttaaaccaatctctttttactttggactgaataattttgtcctttttttttgattcaccaactcttcaatataaaaacaaagcctatcaaagatatgaccagtgtatagatggggaagtttattggtgtgctagagccgatttacttgaggtttgtgtgtatggaacaagttgtttgtggtggtccaaactgtgataaaattatttggtttaaagtgaaactttagtagtaaaataatctcagttcagttttaagtttttgaattaaaactaaagacatgtccattgtactgcggataacacatgaaaaaatagttcataatttccaatgacaggttttatataataagagttttgaatatatactatctatgaccattataaggcaacccacctaatcagtggatatgtcccacgaaaaaatagttcacagtttccaacccacgatcgagtgagcaatggattttttttttgcgggagagagtgggaagtggatttggttgaataggtggggctagaagagtatttttcatattttgttagtcaattatctgttttctttacctcacttaatttgggaccaccgaacggacatccaatctaggggtaaatggattattcagttcagaaaagtgagggcaaatcgcaaagtctgaaaagtaagggtaaaatcacaattgcactaaaaaaacatgagtaagaacacaattgtctcttccttaattagaggagatataatagcatactacaagtcagctataaacacatatccagaagaaaaaaaatagagagatatgactagcgggctacagatttgtagtcacctgcagcacagactctatgacgcaatgtgtgtatgacaggtggtaccaactattaatagcgtagttatttatatgtaactattgtatgaattggctattaaattgattatagatgatttgaaactggtagttggctatactattaaactttaaaattgctcttaatctcaaatgaaatttatgacgcgcgaagttgcactccgttctttattcagtgtctgccttgtacatgttcctgctccatgtttgtaggatctgaaaatcaaactgcctgattaaattctgcatctgacgttgtaagatgggaaatgtttacacacagttaaaatacagacaacgtacatggatgctatatatgctacgacacaccaattcaccactatgcatgcaagcaacagcatcgtcccttgtccctagcttatctggaaaaattaattcaataagaacttcgtagcccgagtcccgatcgatcgactactatcgcacagcgcacaatatttgccagtgccggcatgagagcgacaccttagctaatgcatatgcaagcttcctcttccgagaacatggccctggtccaacaataatgtgaaagtactgcatctgttgatgcatggttaggtgcttgatgtggcttgtgtcttggcgtaatcctgagtttagttgccttcattaacgccaaaaaatctactcgatcgatctcactgattggataccatccccctgcatgatgcacggacagtcggcggaggtcactgctgttgagatggttctagcccaaccacaccacccatggggacaacatctcatatcgatctaatcagatcattaccacttcgtcattggtcacacccacacacatatattcccctgtagccgacgttgatatgacagtctaggaacatacaaaccctgatcctttcatcaccagtactaaccagctggtgtaccctctctcgtcacgttcccacttttcccaaagatgggagagaattgagaaaagagagaaaagaaaggaaaagaacaactagcttgatctgtcaatcagatggatctatcaaaccttttttcttaaagagagcacgaatttaggacgcaaaccatgtatatttcagtcttgtctttcttggatctgcagctcgcagccgtcgccgtcgtcgcgtttgcatgatcgagccgtggtacgcggtgccgcgcatgtgtggcgcttcgcgggcctctcggactacaccgcgcgcgccgccgggggcgtacgtcgtcgtcgtcgatggcgagtaaacgtcagagagagatacggaaaacgaacgcacgctgctctcgtcggtttcaccgtctcgttggctcgtcgtgaggcatacgttgcgttgttgttttttattttccccggcttgaaaggcacagcgcttgcagagggggaggcgagctagggagtcgatcgggccggccgggcgtacgactccgaaaagtcgcatttgcgttttggggcaacgtcgctgtgcggctgagtccacacaagtgggggggggggggggggggggaggcaaaaggtgaggaataatgagagatcgctgtcccgggaaggcaaatcacatcaggattgcagcagctgagggcaaccagaatggagcctttcagggcttaagctcaaagtttttttccttctttctcagatatatgcatgcatgtgtgcctgtttgtggcaaagcctgtgtcgggtctgtgctgttcacaccactggctggctgaatcttcaggagaaaaaaaaataaaaaaggtgcacatcttgtgttacttttatctcgcaacaacttgatgataattctgctctgatttgattcgggcctaactcgccagacacgctggcccacctgtcagtgatctagcacgtggtttgcagctgcaacgcgtaggacacaataacacaaatccctctctctgactgcccccaaacatgccattagagcacctcgctggaattcagagctagtaggatatggttgttggtgatgcctgtcagcgatcgagcttaattagtccaacgctggcacaccactgcttcctgaatggagcagcgaagtactccaagaagcatcacgagggagtagggacggccggggttttggcaactgggcatgcaccccagtttcccgggcgcgacaggcaacggctgtacgcacagcgaagcctgctgctgcaaggccgatctagctactcactacacaactgaccgtggccaatggatccatcgttaatgccgaattagatgtcggttctttgtcctgccgtggacgattgcaccgtacgttccctgtgcttctgctgtttttaacctttgccgagttgtaaaaaaaatccgtggtttgtacacgtgtcgtgaactgcaactgagaaagaacacaaacaaaggcccaagccaatgaagcaaggcccacttgatgcaagcccagattagcccacatcctgaagcccaatcataaccactgcctaaaaaaagctcaaacctatccgtatcagtatcatgattcatgagtacttctctaagaaaaatcagtatcatgagtatggtattgattgtcaatatttttggggccataactcaagaaacataactgaacttttgcaccatcattatatcatgctaagaaaagaatttgctgatacaccatcatcgtcacatcgatcgctgccatgtccatggaagcaaatgagtacacatatcatttctacatcacaaatatagcccagctagttctttgatccagtcgcggttggtgccgaggcagacggacagtactcgcagtcacaaccaactggaccgaagcaggtgccggtgcccttgtacatcctggagcagtccgcgttgcatttggcggcgctgcatgccttgcccggattcaggataactgaactacagttcggggttaaggcagatatgtctgcagatctcgccaccatcactgcagatacaagcgatagatttcttgcttaggagttgcgtgatctatgtttgcgaaatcaacggcgagagaaggtgcttaattacctgatgatagagacatgagggcaatggcgaccagcagcaactgaacagtcctcatcctttgtttggtgttggtgtcgaaagctagaattggaagactgatgagtgattttttcgcgaacgcactgatgagtgatgagatgagatgcgttgttgatctatatggcaaatgccatgattttatagtggatccatggggatgctctatttttagaatcacttccaagaaagacaacagattaatatggattacattacaatcaataggcttatatatgaattataatgcttctaaatacaaatcatctatttttggtagctttgatggctgtgattatatactactaattcccaacaatggatagggttatccggttcatatatgtgtcttgcattaatttttgcccatacctaaacgaggctagtaccggagagactacatgcaagaaccttcaaaaggcctaacttgtcataggcataggatggcagaatacaattcagaccatgccttgtccagagtcgggccaagctggttaactcatgctggagtcgtccggctttggaatcttgagaaagatgtcggtcctgtttggactttggagctggttaactatggataatcgtgggagctataattttagaagaaactgtagctgttaaaagctacagggaatgccactgcttctgctgaaagaaagtggcaagagtgaagtatcctaatttcccaccggttgcttgagcattcgtcactggaaaatgccatgcgccaattcactattcccttcattccaaaatataagttataaccacccttaatccaaagaccaagaaataattattatcatcttgtagtttggaacattctaataaatataatgcatgcatctaatagaattatataaggatttaaaatagtaataatttaatagagaaaatgtcataattaattgcatgcttgcatgcatgacttatattatagaacatctaagaaaagtggttgtgccttatattatggaatggagggagtatagtttctaatgtgctaaaaagacaactcaaaccattatttttatataaccttgagccaccttagcaggatttaaggttaaacaaatttttttgcttaatcaaaagtgtgcaccttcacaaaatatattttgcaatatatactgcagagcaagataccgcaatacgaggatcacaaatggattaattccatgctactgcttgatctctgctttgccacctacgatctcaaatctcaaattacgtttttgtacatctccatgcgcctgagctcagattcaacccaactcttcttgaagcccccctcaattctcaccaaagttgcgtggaggctctcgggcatggtggcgagctgctcatcggtgaagcgatcgaggaaccggtatcggtccggcatctcggtaatctgcctgactcgcaaaaagggctgcggcacgaggggcatcctgtcgccatagcccctcgccgccacagcggcctcatggcgctggcgcaccacggcgccgtcgctcgtcactgtggcctccaccttgagtcgcttgttcgcgcacgccgcctcgccctcgccgtcgctcgtcactgtatcctcccccttggggcgcttgttcacgctcacgcacgcctcctcctcctcctcgaggaggcttatccacggatctggggtcatccacgccatcgctctctattggaacttggaaggcgaaacctattagtaccagatttaattgcgaaagcaatctgtagatttgggtgaaaggggaacggaggacacggacatataaagtccggcccaacccaacctctatcgggtcggattctgtctcgcaggctgagctcggaacagcggccatcaatgattaggccggccgcaggccgatgataattttgacagccctaacctaatatcctttatgcacggccatgctgactgttcatgtgcttgactaattttgacagccttcctcgggagaattaattctgcttcactctacgtaattttaatttgagcaaaggtagcatgatgtaccaaattttacactagatttttagtacctcgtggtatctcctcaaaaaccatagaattgctcttttaatttaggttacatagttacatcattgataaaataggaattaagattgcaacgaagatgcggcataccgatgtggcattttcattggttttttttattaaaaaacacagtacaaacataaggctggattggatcggtatatctaaggttgacaaagtcaccatgaatgcatcgtctaccactgaaaaataattagatataaatgcgagcattgaattggatcggtatattttgagattgacgaagtctacataaacgtctcgtctaccactgataaaataattagccataaatgcaagggtaaattgattctatcacaagcaacctaatcagttgaactaagttcacttcgcacattttcgttgaatctagagactaatattgagctatatgataaattttgaagatttttttataatataaaatgttaggaactaaattgaggaccatattaactaaattcactctaaaagaaaatctgcaaaaacaaagcaactgaactctctcgtggccaacgctgtaatgaagcacatgagaccccccccccccccacacaccaaaaaaaaaacagagagaggttcacacagcgttctatttagcgctgctgaaaataggacaatcccatataaatagtctctttatttaatcatcaacatctctccaggcatcacaaaatttaacaatcgcacgcgtcacactgtatgtaaaatttaagcctgatcgacgcgtgagtgatgatcggcccctgtgcacacagtactgcacatcgtcgtcgatcgaccaccgatcgatcggccggccggccgggttattagttgctcgccggcgccggggaagcgcaggtgtagacgcacttgcactgcgtgccgatgcactggcccacgccgcctttgtactgccgcgggcaattggtcgcgcactcgccgctgtcgcacgacggggcgcccgggttcaacaccgccgagcaggtgtcctggaagtacttgggccccgctatcttggccgccatcacgcctgccatttcgttcaatttttttgaattttgaagcgatttcgttcaaggttcaaaccaagctgatcacaagccagagagagagagagagagagagagagagagagagagagagagagagagagagagtagtagctccgagtgttgtgtactacctgatgaagatgatgcgacgaggaccatggccaggaggaggagcagtgctgcgtggaaggccttcatctctgactctgacgccattggcttttttttttccttgtgacttctgctactgctaccggtgcttagctgcagctttgtttcttttaggtgtaccgaatgggagtgtggcgtttatagtgttgttgttcgtattatttttggaatcacttactacagtaagttgtatggatatggataacgggaacgggtttaatttcaggagtaattggcattgatactgctatattcgtttgtgctgatctttaggattatatagtggccttgtattaagggttgtaccaaattggtacctaatcaatagtaccaattaaaggtgatatttcggtgcattttaatttgtcaattttcacgagaaaaaaaaagcgcatatgctccgtatggcatggaaaatgtttagatgggtcatagtcaatccaaagcatatgttaaagatgttatagcccataatgcaagtagccagaacccaacagtcatagagaggtaatttctagccttaccaaataacgaagtgagattagggcgagaggtcaatcttgtactacgtactgattggaacgaggggaccgcaacaccaagctcaagccatgagctcctagacacgctgccccaacccgcaccctcatctcgcagctgcgccatgctccggggtgttgcgtcctttcttgtagaagagtcatgtctccttgcataaggacacaaggcgttgcttgtttggcctgattcctacaaggagtgccggggtacgtgacacgatggagcattggccatggactaattcaccaaatggataataataaaggaattgctacacttcagtcaacaaaaaacctacctctaaatcttgcaaattttagttcactggatgtgtttcgcaattcgtgctccagctgcttcttctccaactccgacgaactcctcttcttttccggtgccggcgacaacccaaactccggcgaagaattagggtcctggggtggggtggggtgggaagggtgggagggggaaggggaagaaagaagagttcgccgggcttaaagggatggccgggggaggcggcagcccggcggtgggcggcgaggcaccggcggcggcaccggattcgcggggctggaggacggcggtgggccggcgttggtggcgggggcatcttgccgccgacggctcgaggaggatggaggggggaggaggaggggaaggacgagggggaggaggctggccgaggggcctcgccggcgccgttgacgccctctggccagccggcgaggcgggcagcggcgcggtagggcggtggcggctgggaatcgcgtgcgagagacaggagtagcggtggcggcgcgatctggatgggggaggaggagaggagttagggttaaggggtctgcacgaatcttgaagcatatccaatgatctaaaatttgaaagataggaggtgggattttctgtcaacatatgtgtagatgcactcttataaaagacaataaacatcacctgatctatgattccttcaaaaaaaaaacttacttgaatgtaacagtcgacacttgacaccactctcataaacttgcttcattgagcagttggctcaaatgacgttctgacgttgataggcatgtgattgtttcattctcaattaagttgaatcaaataggccctttttccctttttgagtcaaacattcttagaaaaaccttccgcatgctttaatatcttgttggctaagtcgagcttctaatgagacatgcatacaattgtattactttgtttttttaatataagacatagttgtcattcacatgctccatggctcttggattgtcacggagtcgtcctagagctcgggtgagaaggagtgggtaactcacccaccacggtggcgacgagtttcccctgacagcggtggaggtgacctcggacgataaaactccagcagaggacctaggttttatagttttagggttagaagttggtgccatggtggagcagggtaggggttttggagggtggctttagagggatggatggggtggtggaaacatcttagtgggtgcagagacaggtaggtgacttgggtgctgcttgagccgtgaggatggaaggtgacggttggcggaggggatggatttagtggcgctagccgtcggagatgagaaaggaccgggacattgctggaatgggagaaaaaaaatcaaacaagagaggggtagaagggaggagttgaattgcatgcttggaaggggcatgccagagccattggcggcttccggtgccgacaaggctgagcggtggcgcactgggatgggtagtcagcagcgcagggtggggatgtagtgaaatcgtattgtgaaatcccttctttttcgtgcacgagaaattccgaatcattgaataagttgttatttttcttggttggtgtgattgtgtcatcttttcatgtacctttgtttatttctgtcgtgtttgagtttcaagccaaaaactttgtaataagtggatttagctttagttgaagcaaaggtcaagtttaatattaattattaaaaaaaggtatgttactatgaaaatataattattgtagccaatacttaggaggtcaaatggccttccacttgaggggtgaaacgactagctttcccatgcaaaccgatgtataccatgagaacgggaaccctttctttcatttatttgttcatcaaacgcctctccgagcataacaatactgacaacgcgcgggtcaccctgtactaaaacacaggagtaaatatattaatcctgattcaacctctgtaagctaagtacgtgacacgcgccgccgtgctttcccatcgtcgaccaaccggttagtttctcgccgtcgccggtggcggcggcggcggcaggaaggcgcaggagtagtcgcacttgcacttgttgccgacgcactggccaatgccgcccctgtactgccgctggcagttcgccacgcacaagccgctgtcgcacgtcgggtattcccggttgatcacctccgtgcaggtttccagctgcgccgtcacgccacctgccatttcgttcaacccaaccatgcagctgatcacaagctagcctcgatcaccaaaaaaaaccagagatggatacaagctagcgccaagtattgcgtacctggtggtgatgatgatgaagcgacgaggacgatggccaggatgagcagtgctgcgtggatggccttcatctctgacgctgttgatttttttttttcacttgtgctgatcgatgctactgctaacggtgctagctttgtttggtggttatagtgttgtttgcagttttatttttggaatcacttactcaaataggatatggatagcaggaattaatcgcggtgtaatcccaggagtaattagcattgatatggtatattcgtttgcgctgatctttttaaagggttgtatagtagtatcaactaatggtgatgtatcggtgcttatcgtcaattttcacaaggaatggaaagcgcatgtaccgcgtgacatggagaacgtttggaatataaatcatcgaagagataagtagtaggagtaaaggctgcgctcgttctgcctgtcaaccgaaatttgcggtggcagtcaaaaacaagataagtcactcatgtatgattaatccgatattaattgttataaactttaaaaataaatttgttttttataaaaacttttatataaagacttttgcacgaaatacactatttcgtggttgttaacgaccaaatttggtaatatcaacatcggaggtgaagatgggatcgagatcggctacgactagaatcggctaaatctgaatcagactgggttaggtgatatagccgattccagcaatatgactcgtatccaacattgggtttgagttgatatgcttcaagatgattgctgcacgtgcatagagtcctgaaaaggcaattgtatctattaattaggatgttttatgtaatttccttagagatatgcttagggcaaaagtctgccgcaaagacttatggtatcttagagtttgttagagataatagtcgtgtccgatatggacatatcttgtaattctcgggtataaatagaccctgagccctatgtaaaaaagacacacacgttcaatacaatttcggcgcatcgccatctttttgctttagttttatttcgacgagttcttgctttcgggttgagctgcatcggtttcgatcttcaacaagaggtaaaacttgttatgacggcttgtgttctcgggattagtgcttccatctttatgatactctaatcttgtttacgtaattcgtcgagttatcatatatcatacataatctctggcaatatcgctatctaacctataatcggctaacatctgttagtagagggcagccgattaggttagattttgatgttgatttagattatataagaaatctaccactctatgaaacttccagcggcttgattgtctagatattgttcttcttttcatacttaatgctgcatcagttgagtttgatctattaagtcgtgcttagaatatcaatctctagcctgccttctggttgccgattagggtagtatcggagtttcagcctatcttatttgatttaactatattcgctctatatgcttcaatgacatgttaaatccgccctttatgtcaaagatcttattatatttaagtatattaagcttttatttgatatattatacttgttttaatatcctgatatagagtagtatcggagtattagccgatacatgctagatctatatgatcggctatgctataaacatatatagtcctgttattaatatatatttcgatccaggtgatttatactgtctcggcatggcgaccgatctatcccaatcacttgatttaaatatatatcgatataagaactatatattggtaatatctacagccaatcgagtaggtttagttctttattatctatttatagtcgccgaacgattcacatatgacatcggctcaaagataaatgatatgtcatcggcacttagccgatcggctattatttatagaattaaccgcgatttctttatttctatttcttgttgattgcaggatcaaatcaactggcacgctaacacacccaaaggcaagctttggacctgcactggagttaagcaaatctcccaggcctcgtgttttacgtcaacagtggtttgggaaatgtgtttacgaagaacaagtaagctaccgtatctaagggtgtgttcggtagtatgggatgtgaagtaatccctcccgcacgaaaaacggagtggcccattaacacgtgattaattaagtattagctaatttattttttaaaaatggatcagtatgaatttttttaaacagctttcatatagattttttttaaaaaaatacaccgtttaacagtttgaaaaacgtgcgcgtgaaaaaagtggtgagtgggttcccaactcgttttggctaacacagcctaattaagtaccgtttagaatacaacttaagtaagtgacacgcgtacattttagtagcttccattttttatatagagtaaagtccatcaccggtccctaaacttgtaccgatgtgtcatcccggtccctaaactcgcaaatcaaccgttcaggtccttaaacttgttcgactgtgtcatcccggtccctaaactcgcagatcactcgtttaggtcctccaagttgttcagttgtgtcaccccggtccctaaacaggacagtctaaaaactttatatcaaaaaataattcataactttttcatgtgaactctaatgaagacaaactttatatcaaaattgtagccctcgacgcgacctacaactttgtagttgaaaagtttttgaattaaaactgtttagggtcccaaaatattgttgcatgtttatagattttgcaattttgattttaaaattacattttgggacaaaaaatgacttaaaataaaaaaaattcaactacaaagttgtagatcgtgttgagggctacaagtttgatataaagtttatcttcattagagttcacatgaaaaagttatgaattatttttaaatataaagtctttagaccgtcctatttgacccagatgatattcaaatccaaatttagggaccgaggtggcacaactgaacaagttggaggacctaaacgagtgatctataagtttagggatcgggatgacatagtcgaataagtttgaggacatgaacggtcgatttacgagtttagggaccaggatgacacagcggtacaagtttagggaccggtgatggactttactcttttatatatattgccccccaacactactgcacgcacagaccggagtcctaagggaatgacagtccaaccgaaaaccaccttatcccattggacggctcaggccaaaccgccatagcatatggatccggatcgtttacagtctgttcgtgtgaagggcagtgaattaatgccatgaacagtgatgctttactataactatagggtcgaaaatactgtagcgcatgacttgatccttccgttctcgatcggacggtttacagtatccctaatacgcagtactactcatcctctgcgttagtacccctctaatgcagaagatatatgaattccatagcatggcccaggtgcctgtgcaggttcattgctgcgtggaaagattggtaagattaaacacgaacaacttaaattaaaaacagtccatctgaatggagcggtaactctttgaaagaaagaaatgattcttattcatcaatcattatatatatatacaggcaaaacaaagcaaccagtagcatcatatagttcttcaaaacctgatcacatcacatgtctatgtgagacgatcagaagaagaagaagacacgaagttctaacaagcaaagcttgatgtgcagtagcacatggacatgtataaacgtcatttccatatcatatcagttcgctgggaggcgggggcgacgccttgggcggattaaagccgcagccaaaggcgcaactgcatgtgttctcgtcgaggcaggtgcctatcccgtccgagtacgagcgaatgcattccgagaagcaccgttggcacggcactttcagtatcttccgcccaatgcactcgtccgtattcacgccacctgcacaaatggaggatcaagcggctctcgctcagggctctgcccaacaatttccaataacttttttttttgcgatgaacaattctgagaaaaaaaaactatatacagagaaaaacatacacacgtgtgtgtatacttggtgtagagatgatcaaattaaagcgtcttaaaaaatagtactacctccgtttttaaaagggactttactttgttagatgaatatggataaatattcggggaataaattcttttttagacgcaggtaacatatatgtacgagactacctgaatctgaaggtgttgcttccgccgcaagaacgacagcaagagcaaagagcagtgctagtagttggctagtcttcatctccagcaaacgttggccgagcgttggatcagtagttgctatcctgaattttgcttgtgtctgatggtgctctacctccggtagtactatatacagtgtgtgtaatggaggtgttttatactgatgttgtgtttaccatatcggaatgttattatttttcatgggataagatataccatcaatactttgattctaataaagatctaaaacatatgtttatgccaaaataaggcatgctattttacaccttatttatttttggacataaggcgtgtgctacctcttaatttatgattaggatatcactttgtgatacttcacggaaatcttacctcgtcatatttccacttcatctaaccttacatcgaaattcatattgagttaacggatatcgtcaaaacaagacaatggtactgctgaaaccgaactttaacttgagtcttggaccttgtaatagttaagcctcatctcaagtgtgaacctttctccacccccacgaccagagctcgtccctagctctattttcctctaaaattattgggctttatttaccaagtgtcatttatcttgtctcagatactcaatcatttagtccgcgattataaatttagaggctccaataattggtgtgttgatttgcagggtcaattaagtctatcacttcgatcacaactattttaagaagcatgtggtgattagttagctggtgataatacaaaaagatgagcttcccaacttttaccttctagtttattttctgaattttataatacatactctcataatctgaataaaatcttggactgttgagagaattagagattctgaaagaagccacacctattataagacaaccccaaatagggcccatatactagtatatctgccatcaagatcaaggatattccaatggaggaagaatggtgatgtggtatgcatctttaaatccatagaagatggtcaattgttatatatgtttcttacactcaataacttatcatgctcaaggattttataaagagaaattttatggttcttgaaaaagtacttcgaggcatctaaattttacactaaattttatgtgcctcgaggtatcaaattttatactagaaaatatggcaactccggtacttttttaaggataaaaaaattacccttttataaaactaaggtccgcacatcaagtatgttccttaggttacttttgaatttacataccgtcatttttactttttctgtaatatcttagaagtttacgaattttaaaattttaataagtttttttttgtttctcaagtattgcctgtgtaacatcatttaatttgatgaatttaaggtaatctagttaatcttttttttttcgcgtcaatcgcttttcatggtctgtctgatcctttttctttttctttgaaaactcagtccgatccattcatcttcggtgttagtgctgaagaaaatgacaatcctaccactaccaagtttaattgcaggacatggtggtttgtccacgaaaccacacgatcgattgtttctttcatgtgcgagtccagatcataactttaaacctttcatgctacttcagagttcaaaaccctctttcaaataaacttcagagttcatcagaatcctctctcagtgacaaaaaaaaatcagagttcagaagcagtaagaacagaaaatgaaaacttcagcgttcgatctcccattcctggctggattcatgcggctacggcttgcagcagtaggagcacttgcacccttgctgagggaagcactggccttcgcctacgcccttgtacgccgcggcgcagtccgcgtatcacttggacggctcgcacgcgcccctgtagatgaacgcggtgcaggtgtactccggcgtgcacttggccagctggccgcgaatcctacacaaacattgcagatcacaaggtcattgcgcagaagaaattactactactacacttcattgttgagttg

SEQ ID NO: 72627 - DNA, 687 bp, Oryza sativa
actacaaagcattcggtttgcgacgaactaatctttacctaactcgggtacgcgaggtacgcaagcgaggggaattcgcccccaccgtgttactgggccaaagggagtatgggccaacttgtctaatgtcctgaaggccaggaggctggccctctttctttccttttttttttttttccaatcctcttccaatcgggagaaaatctgtgctgttattaaatctggcagctctcgatgtcttgattgggagcgactggggttaggaagagcaaaaggctcgatgcctcgattggcaggagtactaaaagaaaagtagtgcttagatatatatctaaactaagcacgatgacaattcaaaataaatatacttaaagaaaccaaccaatattttttttctttttcagagaccactattgatgcatctaactaatgaaagattcatggcgtatgtcgcacataactaatattaaatttcatattaaccttaatctaaacatattgatttcaatttaatagatggtgcaggttgttttttctctatatcctatccttgccctcccgatctcttccggtcttttcggttgaacacttctattcagttcccgatcgcttcccaacgctacctccgtcctttcgtggggcgtccgtgtgggaaccaacggttctctaaaaattcagttgcctcga

SEQ ID NO: 72628 - DNA, 1173 bp, Oryza sativa
gctcgcccggggcaacccgtcgagcaccttgcgcgcgtcctcccgggcgccgagcgcgaggtagagctcgacgagcctggcgagcaggaactcgttggagtcgaggccgtggacgcggaggtgcgcgtggacctggcgcgcgtgggcgagcgaccggcacgcggtgagcagcgcggcgaaggccgaggccgtggcggggacaccgcggtgggagaggtggtcgaggagggcgagcgcggaggggagcctcccgacgcgcgccagcctccggagctccgcggacagcgcgggcgcgttcttgagtccggccggagctccgcctgcgacgacgaagcgccccgcgcggccgcggcggcgccggcgtggagcgcgcgggagaggggcgtcgcgcgggtgaggggcttggggcaggagagcggcttggaggggaggagggggtggtttgcggcggcgagggaggaggacgccatcgccatggatggtggggcggaggttttcgggagggaaggagaaggggttaacggttgggaaggatggtggttgttgacgacagactaaagagatttttattagtttactttttcaatttctttgcattttctagagagtttgtttttgaatttcttgtgcatttttacgaataacattttaaattatgacaaagaaaaactccctagctataaagtcagctaatgctcccttagtagcatccattttgatgaaagaaaaatgtgttctctgcccaaacaacctaaaccgtaagaggccacgtgtctatccttacctatgagtatattgtatacactaattttgtattgagtcattgggatgagagattggggctgaacttggatggatgatagcattgaggttgcgaggataacggagaacgatagtaggtagagagtaactgtcagggttatggataccacatacctaatagtagttgactaaatctcggcaggacccactacataccatgtcttatacggaaacaaccttcggtataggaggagttccgcataaggaaggatgaatagagttctacatggaaacgacaaggactactcggattgtatcaatattggttttcctagttctacttggacaaggggatacctatgggtataaatacaatagatcaagacacaagatcaatatacaagccaacat

SEQ ID NO: 72629 - DNA, 689 bp, Oryza sativa
ccttctctaatgcttgccaattctccaatcctcgtgacctgcccgctagcacctctggttcaacatggcgtagcatatcctctaaatcaaaaccaccatcgaaatcatcactatcggtggaaacatcgacaaccattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaaatacaacaatacatgtaactagtatgtacaattgattacatgcaaaatttgcccatcaaaacatatattttgaagctagattttgcaaaaaatagttagaacaaaccttgtcaaaatattaaaaaaactcc

SEQ ID NO: 72630 - DNA, 5284 bp, Oryza sativa
cctccccgccaccgccgccgccgccgccgcgccctgaccaccaccaccgcctccttcccgcgcgcagatgtccagcttcaccgccggcgcaatgtgccgctcgtacgccgccgccagcttccccctcacctccttcagctccgcctcactccccccgccgttcgccgccgccgccgccgcgccaccaccaacatccccatcaccaccaccgccgctgatctgcggcgcgatacctgcacgagcaagaagagagagaaaaaaaaaaaccgcacgtgagaccgtgagctcgacaagtgtcccgccattgttcacaaaagatttggaggtgcaatacaatcatgagcgcgcgcggcgctgtcgggcgcggggaacgcaaatgcgccgcgccatgattgggcagctgctcgatcgatccatcgatcgagactcgagagtgcgccaagctaagtgtgtccccatccatgtcccctgatctccacccaactaagctattgcggctgccgatcgatgccggccggcatgccgctatcgctcgctcgccattgcgcacgcaatgtaatcaaacactaccgcgacacgaacgcgtgatggcgatcgatgatcaagtgtgagggctgttcagattaatgctattttaaaatatacattttttttaagttatcaaagatatgcatacatttattttttttaactttggtaaatatataagaaatccagctaaaatttcagcaatattattaacttactaaaattttggtactagtttattttgactataatctaaacagtctataagtattaagtattgctatcgtcaggggacccatggaacggcatgcgcgcaccgtatcaaggacacaatctctcaaacacgttggctcgtgcttctcttctcagtgctcaccaagctcaccctcctctctctatctctgcttatgcttttctttttctttacttattaaaaaatttatgagcccatggtatgtgtaagtataaattgtttgattattgctttatgttcacctttttgcaaggtggttaactgaacaactgtggggagaattatatattatgaacaagtgttgaaggatctgattcctctagcttttttatatgggacgaattgtacgggagaataatcctgtgaggccctgtttggaatgtggggaatttttcgttttctacaggaattgaaatgtttgcttgtgaaatttccgcaaaatccgtttatttgagggttaattagactctgtattttcttcagtggttggactctgtttgcagaaaggtaccctcacagaaacaacacatggtataattccaattccaaagtataaccaatgaaaaaaaatgctaataaaatggaatatgccatactgtgaattgagtccagttaaccacacatgtatgtgacacaaattcttatagggcgacctttcaagatcactgcattacttttcaagctcaggacttttagctgataatagtggtgactaagggctacgagcctatgatcaagtgtatggtacatgttctaaatgtcatggagatgccaagaactgatggttgcaatgcttgaaacgattttaaaaaaaaaggaattgatgttgttgccgccatgttgggaggcaaaggggagaatcctaatgacaaactactgaagggtgaaaatctacacggatgctcgtccatcgtttacttttcagcttataagtcgctggaaaaaaataaatattaaaaacttatttttagagttggttttgggaattttcatcatagtttatttttcaacttccgcttttatatcgctaagaacatttataaaagttttacctctaaattattctttgatcacttataaaccgttacgggcttataatcagctataggcgaaacgttgaaacacaaatgtgtatcatgatttttcgacgatataaataaaccttctaaaaatctatgatacaaattcttctgtggtaatttcgccgatttgttggacatatgacgtgagcgttaggaatagagtgtcagatgccaatatgccatgtgaattggagagcatcacaaaaagttagagagagagaggaagagaagatgaggaggaggagagggaataataatggcgatcgaggagtggggatcgatggcgtacgtaccgttggcgaggtcgagcatgaggtcagccgggttgagcgacagcggcgaggcgaagccgactgaggcgaagtaggagagcgcgtcagcggcgaggccgtagtagatggggcagccgtcggaggagaggaggaggaccttgtcgaacatgtggtagagcctcgacgacggctggtggatggtcaccaccacggtgcggccgccgccggcggccatgcggcggagcgtgccgacgatcctggcggcggtggtggagtcgagcccggaggtcggctcgtcgaggaggaggaggctggggtcgacgagcatctcgagcccgatgctgacgcgcttccgctcgccgccggacagcccgcgcacgccgcggacgccgccgatcatgctgtgcgccaccttgccgagcccgagctccagcatcacctcctccgcctgcgcgcgcttctcgccggcgccgagcgcgcgggggagacggagcagcgccgtgtaccagagcgtctcggcgacggtcaggtgggggtagagcacgtcgtgctgggtcacgaacccggtgcgccgcttcaccgcgccggagaacggctgcccgttgtaggtgatcttcccggacagcatcccccgcccgccgccgccgccgccgccgtgccggccgcccagagcagtcagcagcgtcgtcttgccgctccccgacggcccaagcatcgccagcatctcacccggccgcacaaccccggacatcccgctgatgatcgtcttctccttcgccactgccgccgcacccttcttcctcctcccctccccgccgccgccgatcgccgacgacatcctcgcgcaccaccccgccgccggcttgccgatcttcaccttgtacaccacctcctcgaactgcaccaattatcacaaaaaaaaaagcatggtcacgtctcatcaccaacctccctcatgcacatatgtcaacatgctcatgcacgtagctctacaagtacgtacgtacgtacatacatacatacccctccgtcccaaaaaaagatcaacctagattcgtaactaggaattcattttttttgacagagtagtatatatgtatatatacacaaatgtgtacttgtctactcaccttgaggacaagagggtaagagttggcggcggagtggtggccggaggcgacggaggggtgacttgaggtagtggggtggacgatggcggcgccggaggtgttggtggaagaggacgacgcggcggtggcggtgggagaattggtagaagaagaagaagaagaagaagaagaagaagaagtggttgaaggtggagaactgaagtcgcggtggtgaccgtcaccggcgccgcccccgccgctgccagcgggtgtctggtggtggtggtggcggccatgatcatcgccatgcaactcctgaggcggcatggcgatcgatcgatggatgaaaatctctctgtctctcgggtgtttttcacacacaagccactataccaacaccacagctagctaggctgtgggattggatgctatactactacagctgcagtagtggcagctagtagctagctagcttgatcgagctgagttgacacacaaccttgtgatgatggtgatgatgacgatgttgaaggagaagggatgaaggagagggctttgccttctcctactacttcaactaggctatctcactcccaagtgaagtgctgtctggtttttggcttggtgattgcaggtatatttatcatagctgaagaggagagagagagagagagagagagaatgtgaatgtgtttgtgtgtggagtgggggtgaattggcaaaggcaaagaaagaaagggagggggtaagatggacctaccaaatggggcaggggagcaacacttgttgctgtcactttttttattggctagctaggatggcaattggcaaaccctataaatttattgttagttactacccagtaatatatgtgtgtagttttttttagtgattttgtatatagttgattaacaatttgtgtggcgtattatctaaaaaaagaacaatttgtgtggtgtgcaaggtaacacaccactagatgcatatgctgatgatatccattagaagttacaaatggtggtggtagttattgttgaaacctgaaagggagtttatatcacccatatggtggttttgtagctctagcatggtgtggactgtggatcatctcactttcttttcaaagatattagagaaatattactgatgtggtgtagtgcgcataatgattaaactgggcagttggtttgcaaatgggatctaaatgtaaatctggttacaacttaccccaacaaacaaacattctagtaattaggtatatttacacgggatcggaaatgtttgcaagattgcaggaatagagatacaacttgtagcccacaatggcagccatacacaagacaacaatgattaagatggcaggaaagtgatgtgagttaaaatttttttagggaaatgacaaattacatacacccaagagaaagaaaggagagaaacaaaaatagtgcgatcttgaaggagagaggaggaacagagaaacttaaactagaaaaagaaaagggaagctctacttgttttatttgtgtacttgagactaatgaaagtcatgtgtggattcgcacttaatttgccaccaattttgctgcttaggcttcatcatgatgtcctgccattaattgttccatatttaaatagatatggtagcatcataactgtcacttatgctaacaacgttattaaggcttagttcgaactagattgttggctcggattttaaacagcacagtaaacaagatagcattagtattattgagtatttttcaaacttaaaaaatagatttatttatttttttaaaaaacttttatatagaaaatttttacacgaaacataccatttaattagcagtttgggaaacgtgctcatactaaggccgggtttagttcccaactttttcttcaaactttcaacttttttatcacgtcaaaactttcctacacatataaactttcaacttttttcttcaaacttacaattttaacgtagaactaaacacaccctaaacgagggagagaccaaacgaatagtgtcagagaagtggg

SEQ ID NO: 72631 - DNA, 19976 bp, Oryza sativa
acccctgagtcattacattcagagtctcagagacttgataatgcagtagtgtcctggtatgcgggaaggagacatgcagtgtagtactgaaatcagtgatacacaagctcacccacgtacgtccgcacgcacggccccaggaaaaacggggcacaagctagcagctgcataacgtggccagtatacaacgtccagtacagcagtagcatggactagtacagtagtagtactgtactgcaacaatctgactatttttttttggaactgaaatcatctgactgcgtcctccttttcatttcctttttctttaagccagaaagatctctgactgcctcttcgacaagaatgcaatgacgctattttctttgtgtgtttatttagctggtcaagtcgccgtcacacaaatgtaaaatactccctccgtccaaaaaaaaaaacaaaccctgattttcgtgtgtaatgtttgaccgtccgtcttatttaaaaaattataaaaaaattaaaaagataagtcacgtataaagtattaatcatgttttatcatctaacaataataaaaataccaaatataaaaaaatttcatataagacgaacggtcaaacgttgacacggaaatccagggtttgcttttttttttggacgaagggagtatacagtaacgtacgtacaagcgtcacacaaaggtaaaacatactgtaacgtacaagcaatatatgccccctacaagtgtccaaactgcagagaatctgcaaaactaattaattggtgcccagttcgccaatgtgccactgatcatgatttatatattgatgtaggagtactaaatgtgcatgctgtatcgggaaggaatcctatcgaaaaagataaaacaaaacatgccaagacactcgttatttggagtgtataattagggacaagctgggtgcatgaacgatttgtctcatccatgcatacgcgatcatatcagtatcatagtatcatgtggaacagggtcatgcatggcagagtgtgagcatgcacgtacgtacctctcactgcaacagtattcagcagagatcactgcgacaggggcccatgatgtgctccatcacagacacaggtggcccacacatagtactcggcgttgtgtgcccatactgccattgccattaacgccagctacgtacgcaagagataccatgctccccaaagccccccccccccccccctctattgttttcttgttgccctcctcctcctgagcttgtaaaccctagctaacacagctaatgctatagcagtgtgacaatttatgaggttttttacacacacatagctgctatattctcagtgatgcaaattttcccaaaccatacctatatacttcatccgttttatattataaatagtttgatttttttttcttagtcaaagtgctttaggtttgaccaagtttataggaaaaaaaagtagtaacatttacaatactaaattggtgccaaatctgtagttttgcaacattgtgttttgattctgaagtatataggccgagtttagttccaaactttttcttcaaacttccaactttttcatcacatcaaaactttactacacatacaaacttccaacttttccgttacatcattccaatttcaaccaaactttcaattttggcgtgaactaaacacacccataattttgtgatactctattttagatattaactggcgagagtttggttaaagtatttatactcatgtggaatttactatattcacaatgactacaactacacacactggtatatctctttctattcaccatgacacccatgagctagctagctactctgaggggttgtttagatggggctaaaactttttaatcattttcacatcggatgtttggacgctaatttggagtattaaacatagactaataaaaaactaatttcataaatgagagttaatccgcgagacgaattttttaagcctaaataatccataattattaaaagtttactgtagcatcacattgtcaaatcatggcgtaattaggctcaaaagattcatctcgcgaattagtctaaggttatgaaatgtgtgtaattagtctagtaataagtcccagttgagctctatggctggttagcgtatttaaggagggcagaggtgccatgtcgtcagggctactcccctcttttctctcctgtcacactcaagaagacttgtacgtcctggattatcagtggcctactgttgttggaaaagacatggggaaagaaatttgtcaccgcatgcagctgtgtgcgcttggatgcttgcatatgccacttgcccacaattatgcgcgcatcattccgcctagaagctcgaatgattgcatgataatgcgtattgtagaaaaacacttctcctctagctaggtactccttcccctcatatctagtaatctctcttcgttgccgatcaagaaaccatgcagggagatcaaagaatgacgaaacatacatttttgcaggtaagtagtaaaacccttactagttagttaacgctgcaagaacaaatgtatgcgtaattaatggatcagtagtgttagcatgttgatcaatcatcttcagactcccaagcaagttcgtgctgaattactacctgctgtctgaaactacgtactagctagctgacttgcaatctagacgaagacagatcgaagagctaactgcagagcaattgggcgtcgatctaaaactacctaataacctagcatgcggtagatcaattgtcaaacagtcaaagggatgaagccaagagaggcagagagcatatgttaagcttaccgtctgtcggcagtggattgttggacagtgtgaggtcgacgacgacgcgcggtgatcgatcgcaaagaagactagatcatcgaattgacaggacaatatgccgcatggttaaagggattgaagcctggtccgaggctccgagctcgccggaaattaggcgcctccagtaggaaaggagaaaccggagtcccggatgcctcgagccagacaacaaaccccttaacctaatccaagcaaatacacacacactacagatcgagacgccatggatgcatcggcttgcgaggaatgaagcctggtccgacgcttccacacgcccgagccggctcgatcgccggagaggaattaagatgtggatacctcgagccagccaacattccccacaagccaccatggccaatgaatttaatgaagaagagcacggacatggcgagccatgaaagagcagcagctagcagtgataccacatgctagcagcgcgttgcaatggatggatcgttgggcaagaaaggagaaggatgcgagggttttgaagaggagagggatcgatggggcagggaagcgaggacaggggcagtaatggcaatttatggtgacatgccccatttggcacagcgggtgccctaatgcccaataactgcgctactctacgtccagcccccggcctgtctttacgttgctcgagccagtgaagggctttgcagttctgctgctgcttgctagctgcgcgcatctctcactttcctcgctcagagagaggccacagctgactcactccactgctttgaattcccacaaaatgcctcgtgaagtgcaccccttctctccctagctctctctcgtctcttcagggcctggaatgtcttggacaagcttgtggtgaaaatttacttttcatctgaaattcagaattgaggaagtactcttctaaaaaaagttcagaagagatgaacggcaaaattcatattttcagaactgaggaaaagactactcttctaacaatgggctcacacgagatgaatgtcaaaattcggaaatgaaaagaaaaaaatggtatacttatatgcagtgatcaatacactttcaggacatgatcggtcggtgcttttaattctgatccgacctgagcatattcattctctttaagacagcattgaagtgcccttatatatatcaagagatgaggtatagctttacgatcttgtgtgtaatactacatatacagtactcctactgttcactgtttgtaagacagcattgaagtgcgatagcttaaaaaaagtgcattcatttacatttttttccccttaagacaagcagtgtatggagtccattttgcctcgtgaaatgaaccaatttagtgtaaattaaagtcagtggaatgtctgtgaaaggcttgtaggaagaaagccttcattaaaaccacaccaaatataacctcatctagtcacctgcgatctactagcccctcttccatgttttactgttctgcagttacctgccccaaaactaaaggtcttctacacacatacctctactagcagtagatagtagctcaaacttctaaacgttttccatcttggaaaggatggagaataggaatgagacttggatgacttgacgcaagcaagtgctacaagaatcaaaatgtcctttatgacaagctagctagctcgccagccaaaaagggcttgtaattgcatcaccgaaatgtcaacaccactccccgaaagagtattcaaaggctttctagctctgggttcttgggttcttcctgttcttgggttcttcctgtatatacacatgtatatgtctcagcttattcaaaaacatgtccatcaacacacggatacacagtgcacgcacgcatgcagtccacgcattttggaaaattcaaatttcaaaaatgaatgtgtactatatacatatacacataaactaatttgccaaatggtctgaagatcgacctggcctacattgtatattttgtatatacgtctagggctgtcaaaaaagtttgagactcacgagttgctcaagttctattcatcttaggctcgattcaagctcggctcgagctccagtcgagccgatcccaagcctctcttcaagctcacgagctttatcgagacgagctcaatcttccaacgagcatagcaatatattatttttattgtttatttaataaattatgtatcaaatatactatttgtaagtatcctataaaatgaagtattttgtattggcatcatatgtttattttattcattttctcttttattaatgtgatgaactaaaaataattaattttttaaacagattattcttgaaatatacatagttctacttacaaaccgaactcgatagtcaagctcgccccaagcctatctaaaagctggaaggtttcgtaggctcggctcgagcttaagcataggcaagcgagctcggcgccacgcctcggctcgttgacagccaatacacctaatactagcttgaaactgatcaagatgcctgtgtatatgaatgcatgtgcagttttgtaccacagtagcagttactctcagtcaaccttgcagtgttgaccaatgaccaccagcctattacacacaagtacacagtgcctttggcctcccacgtagcccgacagagcttgtgatgatcaccatcattacctgttgatttgctcagctcccactccctggcacgtgcctcgtgcgagagagccacagctacagctagggcctccacggcctgcagctagctagctagccactggctcgagcattctctgctttcctttaatatgagtgagaaacacgcgtgaatgacgctccggccccgtgccatcagcagtactcgcgcgctagcttgagactatatgcatgctacatgcaatgcttgcacgcttccgatctgcctaccttttgatctttttttgttctgaacgcttgcacatggtcaaagtgtacatgtacgctcagctggtacgacgtagctcccctattgatatcgttgctcatcacaagcaatgaaccaatcgtggctctccatgtatgtaaaaaaaaacaacgagaaaaaaacactatggcatttggcaggtgaacacgcgcgaggacaggcagagttacgttgcagatgcagacatatggaccggtgcggcggtgcgtcgttgccggctggtacgtacgtttgccttgcccgcgggaatgggcaaccgggcgcagcgcagcgctgcctccgcggattcgcaggggcgcgcggttccgtggcgcgcgcgcgcgcgtccgcgtccgcgtccgggaacgcgagagtgtgcctgcctcgcctgcgcggcgcgcggcgacacagcgggcagcgactggcattgtcggcgtggccggaggggtcggggcgcgcgcgcgcagcagcagcagcagcagcgccggggtgggccgggtcccgaggcacggcaccggccggacacgcccgttcggccgtggcatcacgcgttgcaggggcggtccagtggagagcagcagataccgtactgtgcgagataatagctgtatgtaaggtatgcctgcctgactgactgactgccttcaatccttgtaggtggtgtgacattatgtaatggactattccatttcttctcctggctagctagcttctcctcaaggaagaaaacatgcgtatgtccatcagtccatatgtctacacatgccatggaaccaacgctttctgatattagttgattagtattacaaaaacaatatccatttgaatatgttgttttcagaatttaccggtgttctttcctgcatgatgagcgcctcaaaatgtacgtagtgtagtaatattccccgtatttcgtggccaaaaagagagtgaacaaaaaatctggtgaatctggtgtgtttagttcgtgggtgtcacatcggatgtttgactgatgatggaaggggttttcgaacacaaataaaaaataactcgcctggaaactgcgagatgaatttattaagcctaattaatctatcattagtacatatgagttactgtaacactttatggctaatcatagactaattaagctccaaagatttgtctcgtgatttccatgcaaactgtgcaattagttctttttatctatatttaatgctccatgcaagtgtccaaaaatttgatgtgatgtttttggaagagattagctatataactgtcgataactttttagatgaaaaactttcaaatgtaactccactataattacaacgtagttacattgtaactagactatagttacaatgtaactggcacaaaaacgctcagaatcacgttgttgcttagttggttaacatatgcaccgtgagatcgtgggttcgatccatgccccaagtgtggatgtgatttttttaatctgcttgtgcgcatcttgatgtcgaataaggcctaactcgcaaaagaagtggacatcaatatgttagagaaaaaaaatgatgaatcaccgtccttggacggaaaatttagtccgttggacttggaggcgtccctcgcttacggagtcaacaaaaagttgatctcgagatccgcgtgcaacgtcgggtttgaacggccacgattaagtgacgatcacacgcgaccgaccggccctggcccacgcccacgcccacgcatggcgaattggcgatgcttgatgcttgcaagttggtgaaggattctcccggtcgtacgggctcttttcgcggtgaacgcgcgcgagaaaaagaaaagcaacggtttaactcttgtgcatggcttgtggaccatagaccacagtacacgtggccaacggctgttctactgctccagcatgtactagtgggtactactcctgccagtttcacatgcatgtgagcccctggtttcacccagaattttatcgagcagacggtgcacacttgttgggtgaactgatgatgaccagttgagtgtccattgtccatcaacttggacataaacatacacatgctgcataagagacaaaaaaaaggtgatcagtaaccagcttaccgagaagcgagtggttgcagcttgcaggttctgactctatcaacttgctaaaatgggggatcgattgaacgattccccttgtcatttcctgttccacgcacgcgcgcgctcgatcgttcgggccagctgctgcttgtatggttcaagccacatagccatgcaaagccaaagcaaacctctctgaactctgggtagatgtctccattatttttgctagctaggttaacagtggcgcataatgcagcaacgggacaaggaggtagccggaggagcccaagagagagacagagagggagagagttgagacagggtcatgtgcggcggtcagaagagccttggccgccgggtagactggcgctgtggcagcagcagcagctgcgcggcgcggccggtcaattatggacaaatgatggcgccggtgattaggtgaggggacgacgcgggccacaacgccagtacgtacgtcttcggcttcgatcagtcgcttcccgccgcgcgacgacgccacacggcgccagttaccagttggccgtttgggctttaggaaattaataattttatgattaagtttatttcgggcggtgtactgcttcctcttctcgcggccatcggctgctgaagtgctgatcatgtataagccccggcccgttgagaagttatgatgtacattgaatattctgggacggaaggaaaccgtggtactaaactcctcatcagtgacggaaattaaaccagcactactaaactttcggcactaccatccttaagcgtgtatataggaagacgcaaaacccctacttacttttcttcaagtccaatatacacattttgaaataattgatagaagttatcacggagcgaagatatgatatgaactcatggcgagtttacacggtgagtgcgcaaacttgtgacatgttcgcaatgttagcgcggagagaagtgaactatcgaagttagtggctcgtatatacgagaacttgaaattatcataaattttgacaatttgatcttttccgaaaactaattttacaaatgaaccgcggccaaaacttattttagaaataatcttttttatcagcaccaaatcgtatggcgctgaacgttattttttaaataagttttggccgcgatttatttataaaattagtttttggaaagggtcaaattgtcaaaatttgtgtgaaattatccgaatcgaagttaacagcggttagtcacctacatcgatctagatagtcggtgttgatctacatgtgcatactgactacaactttgtctcgttggttaattagctatccatccgcaatggataagcaaaagagtacgcaaggaggaaagaagtgagaggggttattaatttcgtctgcatccggtccagctagggcaatctaagcatggagatcggccaggtgaaacaagcagccggagtacagcccgtccaccgctgctcaccggtgcccaaagggagacgggcgtttgcgatgaagcggcacatgtacgcaggattggggacccacgcccacgcttgcgacatcgtcgtgcgcaaccggttcggcgtgtggtcacggcgaaaccaaaagtacatcaggaagacgcggtatttcaagttcgtcgcgctcggttcggcgatgtccaaggtgagacggaagctccaggagtggatcaagcagcacggcttgttaacgtgggctcagtactcggcgcggcgggaggagttggaggccgctgaggcaggtctgcagaagcttttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctaggcgaatccggaagccgcataggccgtcgcagggcccatccaaactccatcacgcccacccttgcctggatgcgtcggctagaggaaagctacactacaagcccagccgttgcccacgctggcttgtggtaagtacgaggaattcttccagggtttcccgcgaaccggtccttaattgccatgggcgcgaccatcaaaatcatgcacccacagcccaccatttaatatattttaattaagcaacaccagaacggtggcactaatccaatcattaacataaggacctacagtctatacattaatatgatttcccccattgtgtgctagttgaactaatcatggctaagcactccctagtccaatctctagtcatgttatatcccaagctaacaaaggaacatggtacaaaatagcatggctatgacagtaggtaaacattccacagtaatattataaaacaatgcagtatttgaagaaaaacaatagagcatttgcaatataggatcaacatgttcaagtgacaagcatgacttgccttgctctgctgctggaggaatctcgacgactatctcaaagtacaccggagcgtcgggagagccggaatctaagcgacatacaaagcaaataatacaaacaggctataagactactgaaacagagaacaaaaccatttttaatggattctacacatttttcttgatttactgagacttgaatggacttaaacggagctcggatgaattagttatgatttttagaagattctctgtgtttttactagtaaagaaaagtccttaatgaattattgcgcaataaagcatcccagggctgacgtcataggggggcaggcggcgccgacatgcgggccccacgggtcagcggctcgagagagagagggaggggcgccggcacgtgggccctactggcagtggcacaaggcgggagggggtgcggctggcaggcgggccctaccggtcgcggctccaaaaaggggggggtggcgagacgccggccgggcccgacatcaagccggccggcctgccatggcaagggcggcggagcgcgcgcgtcgccagcgacggcaaccggcggcggaagacggcggcgcgaaggcggcggcccgacccggctcggcgctaggagggagaggaaggggaaaagaggaggaggggcgcctcaccatgagttggccggcgcgggggaagacgacggcgaacggcgacggcgacgaccggggaaatgacggtgacggcggacgggctccgagacaccctaagagagaaaaagagacaggttagagggagagagggagtccatggcgagcgggaaccgtggccgacggcggcagctatggaaaggctcaccggcgcacggcggacggcggcctccgatggcggaattcgacggaggaggggtggacgaggtggagctcggccacgcgaacccgacggcggcgacggcgtggtgcggcggcgaccctagcggcggctagaggcggctggagcaatgaaaaaaaggcggcggcgggtgggagcacggtgcgggagcgatggggagcttgggagaggccgacggaaaaaaggaaaatgaggaggaggatgtggggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatgggcgctcctccccaaccaacatagcacctagccgctacgagtccatggccacgccgccatcctctccctgcgtgtctacgctacattgtagtcgtcatggttacatcgtggtgcccccctctctatttaagagagttgccgggttacagagtccaactctaactccacccctaacacctattacaactccaagtccaactgtaaccaaataggactagtatattcgacacctattctaacaaactccaccttggaaaatatacgtcacctagaagtagtagaatcaccatgccgatccacctgtcctccagacttggattatttccttttgcagcttcaccacgagccgcccgacgagcgtacaccagactcaccgtcttcaagagactccactctccctgtaatttcttcctcttgactccacctgcaacagcgctccgccttctcatctatcatcacggtcgtcttgccaagcgaaattggattccttcctagttgtcccatcatagactccccaaagaccatgttcacctccacattccgtctttgatttgattcaatctaatccatggccagataaccaatgtcatcactaaatagacaaatcaaactcaccaggcatgaagaactgaaccctttcttccttgttgtcttatgaaccaagctaacaaatccaacatccacgcttcttgcatctgtagactgaatccatgatattttgagaaaattcaccgtcgcctcgaatcacttgaagaattaccatgatagccttcgctcttactccttcagtgacgcagatttccatatatcccatcatgccgacccgcatattctggatatatcctgtactgccaaacagtatcgttgaccccatcaacgatatttgacccgatgttgcccgggacttctcgcatagcaaaccacccgtttgccactgccgcaccggtccaaccaatctgctacacggccggtctacctccgtcctgcttctggttcggtccggccaacactctagcatactccttgttcctgagccatacctcgccaccttgctgagcaacctcgtcaccgtgagactatctctacagagttcccaaggagccttctcgccaagtcactattttgcgccgatttctgccaattttgtgccatatcgaatcttcccaagccagcttttaccattgcccaagaaagtcccagtcaaactgaattccaaacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaagggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagcttgataaagcagattggtctagcacacacaataggatattttgtgaactatgcgtacaacaaattgaagacggcaataggcctatcgggataatgactactagatggtaccagatcatagccaaaaagtacttccaaaagacagggctaagacacaataagacacaactgaagaaccggtgggatgtgctgaaatccatgtacagcttttggcttggtctccttaacgacacagggcttggatgggatcatgcaaaaggaacagttgctgcacctgttgagtactggaaaaaagtcaccaaggtaataattcatgtctcatgtacatgattttcatgaaaatgttttaagtgcttgcaataattgaagatttgatgttttatttttagggacattctgaatggaagaagctacaacatggaccaccagaatgtttagaattgctggatgaaatgtttggtactattgctgttgatggttcttctgcttgtgcacctggagaaaatgctggaggggatgatgcaagtggtgatgtacaggaccttggcgacacaccagtagattgctcattgggtaaaaaaccagtgaagcgagggtcttccagcaccgccactagtccatacaagaaggttaagaaccccatggttaggataatgaggaatattcaaaccactatggataccaattgtgatattgccaacaaggtgatgcaaggtgaatttaggttcaattccattaaggaggtgatggatttggtggtggattgcggggcagcagaaggaagtgcggagcatttcatggctacaagattatttgtgaaagctgaacatcgtgatatgttcaagactcttaccaccaaggtgggaaggctctcttggttgcagagatggtgcgagaaggaagggcagcagtagaaaattgctaattatttatatgcatgaactagttatctctgtttttactttgtcagacaatatgtattagcaagattgctacttatttattcgcatgaacttatgtactgcctggccatgtaatatggcgccttaattttgattggatgaactactgtttagtgatccatcaacatggtctttctgtgactattgaggtgatatcatttgttgcattgtttgtagatgggcatgtatggaagtgatgatgacgatgaggaggaggatgaaactattattgttgctagcagacaactagatatgatgagaaaatttggaccggtgttgacatcatttggtatgttctacgctgaaaattatttgaacaagtccaagtatagaaaagctaatttagcgggtcatgcttgggttatgagaaaccttgaagttccacaagattgttatgacatgtttagaatgagtaggccactctttgagaggttacataatttgttggtctcatcttatggtctgaagtcaactagtaagatggattcagttgaagctttagaaatgtttttgtggaccattggggctccacaatcatttgttcaagttaagaaccgatttgagaggtcaaaaggaaaaattagtagaaaattcaatgaagtgttgcagagtatctatctcctttcaaaagatcttgtcaaacctagagacccaaacttcacaactattcacccaagactacttgatgatcggtttgagccccatttcaacaattgcataggtgcaatagatgggacacatataccagtagttgtgcccgcatcaaaggtggttcaacatgtgggtagaaataaatatccgacgcaaaatggcttggccatttgtgactttgacatgaggtttgcattaattgttgcggggtggcctggatcggcacatgatatgagggtgttcaatgatgctttgcgcaaatatgccgctatcttccctcatccaccacctggtaacttctcttatccgtttaatagtctcgtcgaactagcatcaattataaaataatgtctcatggtttatgtttatgctaacagggaaattttaccttgttgactcgggctatccaaatcgactaggatatctatctccatataaagggaccaaataccatttaccggaatttcgagagggtccacgtcctagtggcaagaaggaggtgttcaaccacttacattcatcgcttcgtaatgtgattgagcgctcttttggtgttttaaaaatgaaatggagaattctattggacttaccaagttatccaatgctcaagcaaacaaaaataatacatgcttgcatggcgctgcataattttattcgagatagcaaattgagtgatgaagagtttgatctgtgtgataatgatgaaaactacatgccgatgccttcatctcaagggaatgccagtcacatgggagacgaagatggggacgcaaatgccttccgtgatagtattgctgatgctttatttgctaggagataataatttggttttaagtctaatatatatgtggaagaaatattcatgaatgtataattataaatatttgtcaaatttttatttatctacatcaaatttatatctattgtataaagtcaccgaatgatgacaaaggcatccaaaaaaatagttgagggcattctagactttagccatgcaaactcaataatccaggtttccaataatctagagaaagaaacagctcacagcttattttcctctagcttataataatccagcttataataatctgactcaataagttggattataataatcctaagctgaaaaaaacagggccttaatctcagcactgtaacatgcagcttgtgcatatgcctgacgaccaccatgcactagccatcctatattttaatgcatgcagccatgatgattgtatacaaatcgtgccgcatgaaagtgtcttctccgatccatgcgatttgctcgactccgttcaagttgtacgcaaagaacagcatccgtactgttcgtctgtacctccgcacgcaccgcagtcgcagccctcgtgttcaccgtctacgaccccgtcatcatcggccatgcacgtccgccgcgccgcgccacgctcgccggcttcgcccttccatcactagcctccctgccgccgcggatccgcgatcgccgcgtgcgtcgggcgcgccgtccatggcgctacccctccgatctctccgaacgccttcggccacgcccggcctcgtcttccagtcacgctccgccatcgtcggtctgatcgcgagtgaggtcgtcgcctccgcaacgtcctcgttgtcgccatcgatctcatcgccatgactgacgatctcctgtcgatgcacgatcctcacctcgtgtttcctcctccacatgtcttctcgatccaatactgaaaccttctgctcgatgggt

SEQ ID NO: 72632 - DNA, 1540 bp, Oryza sativa
caggcgcttctagtgaagaaacatggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattaaccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcagtctgactgggacacgtttgttgcggatcatacaacagctgaagcattggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactaggtttgggcgcgcagcacaggtcaagtctcggatgagggagacatactattcgagactccagacatagaagaagtgactactaatttgcagcagatagtcgagaaagaaagatcaggacaattcgtcccacggagggagcgagatcagcttactgcggcgttggggacggctgaacactctggacgtgtaaggggtttgtcctcaaagacaagttggaaggtcgggtttccacaagacgcacccagttataagaagagagaccaatacaaagaaccactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcatccctgaggattacgcaagggtacaggtcgccaaggtccatagcgaccac

SEQ ID NO: 72633 - DNA, 579 bp, Oryza sativa
attaattttttttaataatggagcacgttggattaattctgaatatgttttgttttatctatggggttctctgaactacttgttccctgcttgattgagaaatgagaatggtaaagtctactcaacttagcttctctgaaatatcagtgttagtatggggccgttttaaattgggatttacttagattctagcagaaatttcagaatgtgtgctttacggaaataaaatatgagaagcagctctaaagcctgtttggattttattttcagattactgaatcaattcaaatatgcaacagtatgaattttgagctttcgaacttcttggctctacattttgaccttgtactagtatcaactgtggggtggggtctataggcctgtttagttcgcgaaaagaaaatttttgagtgtcacatcggatgtttgaccggatgtcagaaggagttttcggacacgaatgaaaaaactaattaatttcataactcgcttggaaaccgcgagacaaatcttttgagtctaattaatccgtcattagcacatgtgggttattgtagcacttatggctaatcatggact

SEQ ID NO: 72634 - DNA, 10258 bp, Oryza sativa
aagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaaccaacatgctaaatttattttattgcagcaagattaaataaaacagtgttgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaacctggctctgataccaacttgtcacgcccggaatttctatccaaaattccaaacgcttacatgtgtgtgaaccctcgtccaggaatcagccgaggcacacaataacaaattgataatagagtataaatattactctaattaataagcgaataaaatgtcattacagaggtagatagttcctctcaatcaataaaaatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttgataaaacagttaagcaattaaacaatattaatccaacgctatacaacataccctgttgtataggcccaaccattctgaacaaccatcccggctgcacagttctatctccaaaccaggaatgtaccattccaaaccaggagctaaacaaattattaccagtttaagcatcttttattatgatgagaggtgtgagactaatcacgaaagacattgttagacccgcccataaccgcgggcacggctattcgaatagttttactctgatcagaggtgtaccactgtacccacaatacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccaaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgactgaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttgggtggaccgggcgcacgggcggcggttcacacgaacggacggccgagatctaaccgatccaagatggacggccgagatcgatcgggtccacagcggctcacggcggacggacttgatggcgtcagcgatgacgtcaccccggcggcggcggctcggcggctgggacggctcaggcggcgcacgctcgccggcgaacggcggcgcgaggacgctaacaaagggcaccaacgggtaacggacggcgcggcgaactcaccgacgaccaaaacgacggcggagaaacaacggacggcgacggcgacgaggaggaagcggcgaagctcttcgggtcgacggcggcgatgacgctccggtggtctccgacggcggcgaagggacggacgaggacggcgacgacttggcgaccacgttgacgtccttcccgagcgacggcgactgctgaaacgacggcggcgcacggctggagcgacggcggcgaaggcaaagctagggcacacggcgctagggctactccggcgacgagaggcgaaagcgagggtggcggcgagaagagaagagcacggggatccttttaaaggggctcggaggcggcggcgaaggcccacggcgacagcaacggcgaaggaaactcgcggcttggagagaggaaagccgatccgattcgaactcgaatcaaactcattccaaaccgattgagccaaagattccaaaggagaaaaggtagaggagatcccggagattgtttcccctctaacaaatcggccggagaaggaaaggaacagccggattggaaggaaacagcggcggcggctcggcggcggcgcgctagggtttcggcccgaggaagacgacggctccgacaggcgggacccacctgtcagcgacagcgagggcgcgcgcgcgcggctgactgggccggctgggccgaggagagagaagagaggttttgggccgactttcggcccaaagccaaaagaagactttttaaaacctttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttatattttcttttcaagacttttataattatttctaaaaattccaattaaacaacaatttatatattttgaattttcagggtgtgacaaacctaccccccttaaacagaatctcgtcctcgagattcggaagaactggcgaacagatgcggatgagctgacttcaattcatcttctcgttcccaagttgactcttcttccgagtgattactccattgaactttgcagaaacggataactcgattcctggttcttctctcatttgtttccaagatatggattggtttctcaacataagtcaaatcctcttggacttctatctgctcaatattagcttcttcggtaggtatccttaaacactttttcaattgcgacacatggaacacattatggactcctgccaaagattgaggtaattctaactgataagcaacctctcctcttctactgacaatcttataaggtcccacaaaacgcggtgccaattttcccttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgatctttaccttttcttctgcttcccttaggatatccgtcccgaaaacctgacgttctcccgtttgatcccacaaaagcggagtgcgacacgcactccgcttccgaccatacagtgcttcgtaaggagccatctgaagactagcttgataactgttgttatacgagaattctgcatagggtagattcttatcccaacttccactgaaatctaaagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactatcttcttggggacgccatgcaaacacacaatccttgccatatacaattccgccaagcgacttccggaataggttgtctttaccggaataaaatgagccactttggtaagtctgtcgactatcacccaaatagagtcatggcccgatgacgttctgggcaaaccagtgataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcgtgagcttctttcagaattgcatctttcaaatctttgttgtcagggacacaaattctttcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaactgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaatttcccccttcctctctttgggccccttttcggcccaagtcttctttcctctcccgcggcccgcgcgccttctccctctctcgggccggctcccctctctcttggcccgctcacaaaagtctgttttgcgtcccttcttctctcccttcgccgacaggtgggacccgtggaccccacctgtcatccccttcctccggctccaaccgccgccatggccgcccgagcctccccacgtcgccgcaaaatccggcgccctcccgcacccgagctcgcatccaacgacgtggacacgaccccctccacgtcctccaccatttcccccactcaccccgcaagaaacggcgccggtttgacctccccacgagctccacttcacctccccacttcgccggccgattccgccacgtccggcctcgatcccgccttcccgagcccataaaaagcatccacgggctcccttctctcttttccccaatttccccgagctctcccgtgccacaaatcgcgctcgcaccgcgagcccgggcgccgccgctttccggcgagctccggccgtcgctcctctctgccctagccaccgccgcgtcgcgccgccgccgccgctagcatcgccatgccttgctctaccccggcccccactccatctccctcctccaccgccggaaccaccttcccatcgcgaggccgagccactaccgccacacaccgccttcagtcggccgcgtcgcgccgccgcgccgcaccatcgccgccgtcgcgctcaccgagcccgcccgcacctcggccgccgcttcattgccgcgaatcaccgccggagccttttttctcctcgcgcgccggtgagaccctctctcccctccgtctccggccggcaattcaagccgccagggtcgccttcccttccctaacccctctatgctctctcctagggtgccgccgccgcccgttcgcgcctcggcatcaccggtcgtcaccgccgttttctcccttcgcgccggccgccgtgttcgccggtgaggaatcccctctcctccttcctttcctctctctcccatgggcgccgccgtcctccgcgcgtgcgccgtcgtcttcggccgccgccgccgccttcgtaccggccgccgccgtctcccgcgctgccggtcaccgccggtgaccgcgcgtgccgccgccggtcgccatggccgccggtcggctttgaggccgagccgagcccggccggcgcctccctcgcctccccttgagccactgcccggtggggcccaccagccggtggaccacccctccctctcctttcccctatggagccgctgccagtggggcccgcttgccagccgcccctctccctttcttagtgccgctgacgtgtggggcccgcgtgtcggcgccggctgccccttgctgacgtcagcgagatacttttcctttgtaaaaataattaataattgcgcaataaatcgagtttaattctagaaattcattaaaatggctcaaaaccttctaaaattcatatctaattcattcgaactctgaattgagccattcaacttgcaaaattcatctaaaattgagctctacatgtttgtttactttttatgtactgtttgcttggtctttattagagtttttcctcgttttgcgtgccagcgtgtaatttccgccgtttcggaagattgcgttcgcaaggataagagttcagaagatccaagtgaagaagcaaggcaagtcacacattccccttgagcatgttgatcccaatttacaaatgttttactgtttgcaaataaatatgcatattttgctaattacatggggtcagggtattacctatctgctcgcttgtgccatgtttacttgatatctgttctttgtcaactttgggtaatgaatcgactagctcatgttacttatgtgacctagctagaactatatgcttagccatgcttaattaccactagctcagttgatgggataattgcagtattagacattctagtatcttgatgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcctgttcaacgtggtgtagcgttgatcagtggagattcaatattactttaattactcaacagttttactgtttcgctcaataaaatgttttacaaccgcctttatgcaaatagccacaaaccgtccttgtgttccccttgcacgtctgcatcgtcggtgtggcttgctgagtacggtggttgtactcagccttgctattattcccccttttcagaagtgtagtgcttctgagctgaagatggagttagaggaccaaggctcagaccccagttgagttctgcctgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatacacaaaatagtctggaaattcgggctaaatttctgggcgtgacaaagtggtatcagagccaactcgactgtaggttgagccaaatggtcaaaccctaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcattttttcaaggacaacagttcaaaggttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccgtgaggccaggtcaacagttcagcttagagaagtagcatcagggacgattgtagttcagacgaaagacttgtcaagcaggtttcctggaattacttgtcattcgagccaggaccagttcaagcggacgtaggaccaatgagttacaaatgccagatgcaagattcaagaacaactccatccttctctagccaacttggtgaactgtcaggttatcaagttgctagcattgacagttcgacccaagataagtaagttttatgagtacgggcagtcctagtctgcgtcagtttgagcagaaccaatcaattcaggtttgggaagcaacgggacaacagtgttgaatccagccagatcgctcgtataggtttcatcagctaatcggtcgtgttgggtaccagaactccagggatctaatccgatgaaaccagtcagtcagtcagttcgaatcagaaagaggcagcatgtgtcagcagatcagtcagaccgtccatcagcaccggctttctttctagccatcccagaatctcgggacgagattcctgtaaggggggtagatttgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatt

SEQ ID NO: 72635 - DNA, 1090 bp, Oryza sativa
aaggccgtggatcccgccgactccccgtcgaaaccggagaagagctccgcacctctctccgccgcctccgactagaaggatgacctcgacggcgcccgcctgagcagaggactcgtcgcctcgtcgccgtagccgcggagctcgagagggtggtggatctgtcgccgtagcccgtcgcctccaacaccctcctggcctcctcggcgccacccgttgcccgccgcgacctccccgcgttccgccgccggcccacgcgcgccgaccgcccgcccgccccagcacgccgccgcccgccgcccatcgccgccccccgccgtgcacgctctgagcctgagagagaggaaaaggaagaggaagaagggaatataatgcagggaaaagtccattctacaccctcgaagtcttgtgcttgtctaaaatacacccccgaactacaaaaccggatataatacactctcgaactgtcaataccggacgcttaacccccccgggctgttttcaccgtggtttttgccacgtcggatgccacatcggatgccacgtcagccctagccacatcagcgcaaaacattaacatgggccaagcccatattctctccccctctctctccctccccctcccctgttcattatcttctctcacggccgttggcgggcggcggcggcggcggcgcagagctacgagggcggtggcggcgcggagctgcgaaatcgacgactacggcggcagcggctgcgtggagctgtaagggcggcggctgcggcggcggcgtggagctgcgagggcagtggcggcggggagctggtgcgagggcggcagctgcggcatcggcggcgcggagctgcgaaatcgacagctacggcggcagcgtagagctgcgagggcggctgcggttgcgtggagctgcgagggcggcggctgcggtggcggcgtggagccgcgagggcggtggcggcggggagttggtgcgagggcggcgacgctgcgaatcacgagcttgttgcctcgctcagaagtggccgacctcgccggagccatacgcgcggggaggagtcatccctatgcgctcgcgccgccaccgcttggtcg

SEQ ID NO: 72636 - DNA, 49387 bp, Oryza sativa
ttttgaccatcaaagttcaaagagattttttgattctttgttaataagtggaaaggtggaatctaatttcaaagaataagctaactcttgtagaaatcttactgtatcaacaacatgttatctctttccataacatataattaatcatttactgtaaattaagggcatgttcaaattgtaaccaaaataaaccttaccaaattttggcattgtcaaaattttgacaattttacaatattgccaaattttggcatgatttcttatttatttactagagtttggtaagaaactaaatggatgcatatatttagcaactttaccaaaaaaatggtatggcttgaaatggcattaatctgaacaagccctaagataataatgttccctttgacatcactacctaggctgtgtttgattctactggttgggaactcattccttctgcacagaaaacggagcagttcattagcgtgtgattaattaagtatattagttttttttcaaaaatggatcaatatgattttttaagcaactttcgtatataaactttttgcaaaaaaaaacatatcatttagcagtttgaaagtatgcgcgcggaaaaagagagaagtgagttaggaaccatgggtatcgaactctgcctagtgttacatctacatcactactccttccgtaccgaaaaaaacgaatctaaaactagatgtgacatattctagtacaatgaatttggacagaattatgtccagattcgtaatactaggatgtgtcatagccagtactaggttggggcctcatcggatagaggtatgggctgaggcttttcagccaaagcccattgaattgcttattgggctgaggactttaagccgaattgcttattgggctgaagactttaggcctcattaagccaaataagctaatcaatggcttttctttagcttaagaagaaaaggcaactttggcttatcagtcaaagctctagaataaccgatgagggccttggttttttatgggacgaaggaagtacatggatatatactatatcaaagattagccatataatatccaatatatataatataatctttcatgttttccttactactaactgccaaatactgcaacagttagacacatcatacatgactactcgtgtactcagggataaatggctaacataatttatggtttcttactaatatatttttctaacctaaatgaaggaagaaaaacaaatagaacagtggtgagcagggtattgcaactagggacatataacgtggaaaccatcgaataattgaaaacccgtaaaaaccgaatctacaaatttgtgtaaattcatggaaaaaattgctactacctctattctaaaataattcaaactagataaaatgtgacatatttatttatccggatatattgttgtagaatagataatattactagggccctgtttaaattccaacttttttcttcaaacttttaacttttttcatcacatcgaactttcctacacacacaaacttctaacttttccatcacatcgtttcaatttcttcaaactttcaattttggcatggaattaaacacaacctagaaatagatatatgcatggatagattactagaaatagaaatacatatataccttccttgttggtatgaatgtatttcatgcatatatttatttctaataatctttttacgaactagaaaggtagccctcacacgtgcgtgggttaccttatttaatgtgcgtaaaattttattacgaatatctatgggtggatgactttgtattaaaatattcttttactatatctaaactaaaactaaacatattttaatgtgctctgaacgttggttacaattttcttctagttataaccttacaatacatatataaattctaaactaaaattacttgaaaccgtgcagtgttcaaaataaataaaatgccctaactaaagctccgttcccatgctgcaggcctgtttgacacagctccagctccagctccacccttcgtggagctgaagctcagccaaaaagtgtcagcttcattcaaaatggaagcggagctgggtggagttttctcacaaaataaactggagttgtggagctgggtttaggcagttccataactctactacagacccaacttctgaagctaaatttagaagttggagttgtaacaaacaggatatcaacgcgctaaggaactgtcattaggacgtgccgtcgagctgtctctttgagatggcaccggagcaaggagacactgaggaagcctttgtgagttgctaatattataaacagaaaatggcatacctcctgaactttctagaaacatagctggtaaatgttagtaaaagaaacatcgctgtaataaaatagaatccagaaactccccagatctcactactgaatagtataaaaatcaaactcaaaattccaaaaaaattctcaaaaagtggaggcgaccagttcatcctccgctcgctgcacacccgacccgctcaagtgcggagacccccccccccccccccccgcgtcgccgacggccgacggcgatggacggcgacgaccggcggaccccgctgctgggcggcgagggcggcagcacccgcccgccgtcgctgcggcgccgcgactcggcgcgctcgctgcggagcaccttcctgtcgcggctgcccgacaaggtgcgcggcggcggcgaccccgagcgccccgccgccgacgtcgacctcacccgcgccaaaggcctctcccaaggtagtacctgatttcctcgctaagctcgcgcttaatccatggaggaaagtcgcaaagctttgttctacacttctacttagtgaatagtagaagtgattgcttcttcccttgtgagtaggtgaaaaggagtactatgagaagcagttggctacactgaaaatcttcgaggaggtggaggcgctgtgcatgcccggcgaattcgagtcggatgccgaggtgctcgagctcgaggacaaggagcagaagcagagcgagtccgccatgaagatatcaaactacgccaatatcatcctcttggttttcaaggtgaattgattttgatttctcgcatcagggtagcggagtcaagagtcagagtgacaattgatcgttgggacacggatgcgaaaggttgagaagcacagtttgaatgatccgtttggttggcatatgcaggtttatgccacgatcaagacgggctccatggcgattgctgcatccacgcttgattccttgctggatttcttggctgggggtatcctttatttcacacatcttacaatgaagagtgtgaacatttacaagtatccgatcgggaaattgcgtgttcagcctgttgggatcatcgtcttcgcggccatcatggccactctaggtgtgagatccacctccattaggagactgatattagtcaactgcaatttgcacgctagaagtttagagttatgaatatctttgcattctttttaggtttccaagtcttgatccaagctattgaacaactggtggagaacaaggcgggagagaagatgacaccggagcagttgatatggttgtactcgatcatgctttcagcaactgtggtgaaacttgccctctacatatactgcagaagctcagggaatagcattgtccaggcatatgcaaaggtatacctgccttgactatataataatcaattttgaagcaattgcagaagagcgtcacttgatttattcgaacgcaagagtgaaactatgaattgccttattgaaccggtgaaaactttgctgctctaaaattcagttgcctttgtgccgctcaggaccattacttcgatgtcgtaaccaatgttgttggtttagtggctgctgtgcttggagataagttcttctggtggattgacccagtaggggctgtgctacttgctgtgtataccattgtgaattggtctggaactgtatacgaaaatgcaggtttgccctctagatttcttaatacttcgctcccctttttttaaaccagctcttttcgtttttttttaaccaagtgagattttttcattagcaaaagagtgaaactgaaacgactcataaaagaatgtgaaccacttaacaaggaaaatgatgtttagagtttaatggcagattgctcggcctcaattgcaccagttgtcaatagttttggcaccacaaatcttgacagtttgtggttgtaaatctttatgcagttacactggtgggtcagtgtgccccttcagatatgctgcagaaactgacatacctcgccatgaagcacgatccacgtgtgaggcgggttgacacggttcgagcttacagctttggagctctctactttgtcgaggtcagccattgcagctattcagaattacagattctgcaccaataagtttgttttttttttaatttttcgtgccactccatatcttcctcatgctagccaatacaacttaggatatttctgataatctgaatacacaggttgacatcgagctatctgaggatatgcgcttgggtgaggcgcactccattggtgaatcgctgcaggacaagatcgagaagcttccagaagttgagcgtgcttttgttcatgtggattttgagagcactcataagccggagcacagggttcggagcagattgccctctactgagccttgagcccttgacagctccagttttactcttgtgcagtgtactgaaattctggtactgtagtacagtcttccactggtttggtttgtcgctgaggcagcagaaggcttatggttacacgtacacggtgacggtaggtcggtagctggcttttgggtagaggaatctgtatgtctgagtgaaataatactggattcgccatttggtgcgtttccttttttgtttccttttggctggcctgctttcttgcttcgtaacttgaccaaaaagttctggccgtcgcaaagagctggaactgtgaatacattttctactgcataaaacgttacacgcatcatgcatcacctacacggttacacccgatagaattcggttacagttcaattacaaggcactcccgagtcccagaagctagcacgtcgagcagacaaaccctacagataaaatttctcctcgccatgcttttaagctttacgctaaccacatgcttataataataacgagcattgccgcgtcatttccagattgaagtggcagtgaagggcaacaaaatgatcatcaccttgctgaaattagtgggcagcagcaaccatagccgtgcgagcacccgtgaaagttgatatcagcgcccccagctgtaacttgtcattgcaagcaaagcttagccggtacctgcacacagacgccatgaacaacgtgccatcttaagggaaaaggccataaatggttatactacctacctttccaagaagactaaaggctaaaaatatttggaatatttcataatattaatcagttattatacttccataagtattccagatagccaaaggtcaactttaggtaattgcatcatgaaagcaacccaaagactcattttccccccaaatgcaaacattccacaaggcacaaataagcaattccaacatgtgaggtttgcttaacaactattgctttgcagtatgcaaccatttaactgtaatggctaaattgtgaaacacatacaataaagtatgttagctggtttaaattatttattattatttttcttacgtaagatactccatactagttatttgatgtgatgacataaatgactatcttgaagcatataatatgaataaatcagcaaaatgttccgtcaaagttttgaaaaaaaagggtactgagtagaaaatcagccaaaaatcacaaatgatttatgatcaaataaaatattatatgcaagttctaggtgaactaagcaaggcacactaaatttgacaagtaatcaactttacagctgaaaacaggacgtactcgatatcagccagatcattaatcagctttatgcgtacatcagatggcatctgtattttgaacacaaacctgcaagaaatttcttttgcgtattaggagaaggttttagaggatttgaggaataagaaggtttagagaaatatagggcatgaaagagggcatacatagtgacctcccgtatgatatcaaccaaggccagtccttttctcatcttcatatcagatatacctgaagcagataggacagtgttttcacaagactgacagcaaagaacaaattgcacaattcatgtttaaaccatgaattgtaattgttaggagtatgactttgataattaagaatacatttgaagctggttgaaaatgattcattcagcaaccagtatgctatctgttcaatgtctttcggcatggggtttcctgtgcaaaggtacacagcttcctctgttatttgcttagatgccatgtgtgttgactgcacataaaaggtaaagcaaatcagtgtaaaacatatatatatatatatatatatatcagttcattgtacaaaaacaattagtataacaaaacaggttttaatggtttggttgaataatttacaggcatctcacaagtaaatgatgtgatatcattgccaatatggcatggattagctaaatctagcatcacatgttcttgttatgaagtgagggataagtatggttcatccagatctatcttaacaggcaaaattttcttgtctattccaacacaacccccatgcacatgggcctttatgtttttcataaactaaatataatgattaatggttaaaaaaaagtaggtaaagaatgctcagcaaacgcttattcacacataacctgcaatatgttcaaagccttcctcatatcaccattacttaaccgcacaagggctgtcaaaccaccgtcatctacatcaagcctgcaagaacacaaagatgtggcaacaaaaatttagactaccacatgaagatagtgacacaatgatattatttcaaaacaaaaccaactgaattctcaagtctcaacagtcaacatgagcaagaaactttacaagagaaacatatcgaaggttctagtataatctgcaaaggagcattaagtgcttacccctcggattgtattatatgtttaagacgttccctaacatgagtgccatcaaggggtgcaaatctaaacctggtgcaccttgattgcagtgctggaatgattttgttcacatggttgcatatcagcgcaaaccttgtgctccttgtatgcttctcaatgactgtaagatgggggagattagaagatgtagctgaaagaaaaacacagcaatattgtggtgacacaatgagaaactctgaacaacagaccaacctcttcgcaatgcaaactgtgcatccttggtcatggcatctgcttcatccaatagaaccatcttaacagattgctttgctctacgcaagataaatatcagatatatgacaaaattgaattaaattgtataccagatctttagtaatgcaaattatgcaataccagtagctccaataaagcataagaaaacaagcataaaaaagatccatgagacaatatgcaacctccatgggattattggctcacaagatgactgcataatgcatgctaattacaacaaagtatgaccactcatacacaaacaacaggaatactctctcaacatgcatttccaaacccacgatagatcgtgtataggtaggtctaggaccaacaaagatcaaatctggtatatgctaaaacacgttcccccttattagaaagaaaatactactcaaatatcttcccaaaataataacatcaaaaaatgtaaagcatacccgaaagagagactgcgggcacttgcgaagtcttggatttgctgccttacaacatcaataccacgctcatctgatgcattgagttcaagaatcatgttgccatactgtgacccatacaacttccttgcaacggccagtattgtcgatgttttcccagtgcccggaggcccataaagcaacaaatgtggaagcctgttctcatttgtaagcctatcaactacaatataatgaaatgacacaaaatcatcagattagcttaatggtctaaatcagaaattaataaataggttgaaacagaaaaaaaaatcgctatttacttctaataatgtgtcaaaactcaacaacccaaaatatgtgacagcttacaataagctaaatttgggagagagagagagagagagagagagaaatatcagcaggtcattatatcacatactaaaacagttcctcactacctaaatggctaaatataatacagtcacacaaaacaagcagaaaacccaattgcatgactcaaatgaccccaggctcctaacaggatgcaacatagaggaacaactaagacaaatatggtgaaaactaaccatcacaattcatggcaccaagttaacaacagatcacaagctggagctcactagcacgaattgccaaatcccctgaaagaccaaatcaaccgccaaatcctaaatgtggagctggaggggagacatgagtgtagaaccacaaaatccccatcatgacactagcaaatagatagtgattattcacaaaaacaaaatagcgatactacctacagaaatcccgtgggctcgcaccacctcgccaataaaggcaaaacaacccccaaatcagtaacccaatcgagtcgctccgctcctaaaaccctaaaacgccgagcggcagccaccgactacgcagtagctcaatcatcggcgcaggcgaaaccaaaggggggagcggcggaagcttactggtgtcgacgatgtcgcggtgggcggcgacatcgccgagggattgggggcggtacttctcgacccagggcgcggccctaccgccgggagtggaggagagaggcgccttgcccttggcggccgcccccggcggcggcgcggcggcgtcgatgtccatcggagtggcggcggtggctcccgccatggcgtagcgcagagagaggcggaaaccctagagctggaggagggaatcggggggaatggttggcgccaattcgaaacccctctcgcggcctcgccttggcgaggggaagaaatggaagatggtcaacgtggtcagcgatgcggaggagggttgttatctgggccgattatgggcccagcccatttagccgctgcaactgggccttcgagagtagaattaggggaagaggttaattaaatttccaatcaccatatgtgaattcgaattgtcttattcaaaaacatgtgagttcaaatttgaagtgagtatagtcagtttagttcaaccgtttttaaattagcgaaaattggctattataactcatgattagtgcagtgcacaagctgaacagccacgctagaagccttatctgaacccatggtaaaagacgtgaacagccacgataggggaagctgaaagtgcagatgtgtgaagaataatctgtattcttttttatcttttctgcttttcggcaacatgtatatatacgggagtagacggccgctgccccgcaccgtcattagcgcagaaagcagctttagccgtccatcaacagccgaaagaagagagagacggtgccaggttctgaacggaaagtcaagaacgagattccatcttttctgtcctttattaatcttttccatgctatttcccatgtttgattaattaacatactgataacaaacggcacatttctgtcggtattgaggtgtttgtttatcaaatattctggtttggtatcggatcttcagtccttttctaaagaagtgtaccgcactacttggccactgttgccaacatgatttacatgccaggcttgtgctcactgataattaattaaggagaaaatgctctaaaaacgtttagcaaactgatctgggtacagtcaacgcagttagttaccaaactggtcgaaagttgcgatttgttcgtctgagaaaaaaataatatcgacttgattttgaactgttctttatttatagcacacaatagtgtgtcagtgtcacagtatgctgctgccattacatttacatccaagattaattgatactgtagttattaatgcctaatagctcaagacaccagagtccagacagtccgggctccaatgatcatgcagcaaaaatatcccctacctatcattttccatttttcctcttctccagcggtgaagccagtgatgagtagaagtaacagagtaactatactaaaatggagcatacatggctcggctaggtttcatccgtggaatgaaccgattcaaagttttgaacctgcacctgctaatcgatcgatcgattgatgatctttgcaaatttcattgctctcgtcggtgatctcggctcaccggcggcggttgacgagcgggaaccaccaatcttggaagcaagactggtaggagatgagcagcagcacgagcgccagcgccagcgcgacgccccacggcgaggagccgtcgcggcgctggtcgtaccagccgccgccgccgccgctgtgctcccctaccagcggcgccatgagcagcgacgagagccccgaccgccgcccgccgccgcccgcggccgccgcccagtactgcatcgcgagcaggagcagcagcggggacaggacgacgacgacccggacctggtcgaacaggctctccaccgcggactcgcaccgcgagtagagcgaggcggcgccgagcagcgacgcggtggcgaggaagatgaagaggtggaacgacgtccccgccccgtccgccgcctgccgcgcgtcgtagcggtaggacgacggcgcgccacggtcgtcgtagtagccaaggctcgccatgtctacaaggctacacctcctgctgcgctgctgttcttgccggcgatggacgaaagtccgaagctgcaagggagaagacgagatggctgctggtttatattggcgggagagaaaggaataacaacacttgcgagagagagagagagttgagctgcgctttacttggcgggagggggattccgcgattccttcacgagggaggtgaggtgaaacgcgagagcggacgaaccgcgcggcgacgcgtgtgccgccgccgaggcgtcgaccagtcagcttgggcttggaaagcgtcgcgcctctattgtcctactactacgagagcaggtacaatatcagcttataagcaagctccaaacatattttaaaaagataaaaaaaaagcaaagtagcgaactatagatctgtagctagctgcgcatgaactctaagatgtaatgtgtgtatggcaggtgggaccagattctaattttatagtaagcgactattatatgaattcaatattttattggttataaataatttggagctagtagtggactatagtcactatactattaaacttactctgaaaggatgtgcctttttgttttggaggcacttggcgagttggcgaaaaggatcttttgcgatgaggcgatgaccatgccacaatggcatagacggtgagggcaatggctggcaagttggaaagcttttggagaacggtgcgggtgactgggttgagtatggtgatgaggcctttgttgcctacgggttacactgtcacttgcacacttaactgtgaaaaagaacccaatggtccagtcatataatcaacgttaaagtacacaataacacatatataaaagttttacctaaaaatttatttttatttttggtttattagggaaaaagccaacgatgagagcctgaaagagaagtagtctcctatctacacccaagcaacaaagtgaagctttgctcaaggattagtacagcgctgcctatgaactacagtacataggacaacaccaggtgggcctttttttgttgaaaggccatcaggcagcagtttggttcctgcatggctgcaccggttgatttacgctggctttgtcagtggtcacccgagcgaggtaactgtgttggatgcgtagtactatggcctgtatggttcatgggcccggtattgtcggtgttactgcgtcccacccgactatcattttgctttcccagtatcaccatcactgttcttttttatatgatgttggttagtccatatatttaggatggagttagtaacatgccagaagaggtgcgcacttcaaggcaagaaaagggtatgcatgaaggtatcaccacatgccagcaataaaagatcatcatcctcatgttgcatcgcgaattctgtttattgaaccaaatgaaggcagggctggtatcaagtatgagcattgtatggaagtaaatggagcaggtatgatatgacaaagcaaacgtttgcatttccaaaaccaacgccggaccacaagaggcctgactattacattattactgaagcaagcatcccacaggaaaaacttacaaaaggttaactgatgatacaatcaatgtgattcactcacgcggaatatattcacaaaccgatgttctccccaagtgcaggatgggcagagccaatacatgttagtagatatatttggtaggggcaccagtgacaggagaatccaaaaacccattgcagcaattatggaagctctcagcacatcagcccaacaaggcctcacaactttgatcaaccggcgaatatacaagatgggaactaattcacactgcaacaggaaacctggtataaatctcttatcttacatacagacgtacccaagccagtcgcactactaataattaattagcctagagttatgatgttacgagccaatatatttggtgtcaaaatcctcaagatcatggccttgagactttttcagttttgccactagaacccacatgtttgcaagttcactttccaagaaggcttccttttgcttcgactcctcaattctcctttggagttctgcttccttttgttccttctccataagcacagcttctaatgccttttctctctcgtagcctgcgttgttgtctcttcttggagctggctcatgtcgtctactgatgctatccctccgagtacctctcagtccactgttggctctacgcggggttggacttctcaccgatgccaactcagaagcaagcttctcgttttggttcatgagcttggtgacttcttccgacaacgctttcaattcaactcccgcagccgaagccaagcctttcgcgtacgtgctttcctctagtagcttctggttgcgagtctctagttgagcttttacttcaatcagctcacacaccttctgcttcagctcatcaatctcaactgactgaaggacaccccccaaaagaagtaagttaaatgtgcaaaccaaccaagtcatagagaggcagcaccataatgaagagcaagattgcttagaacctcaaatggtacaagcagagatcattttgagtcatatggtgtaaaaataagaagctgcaataaatgtttttgaaatctacagtatgcaaagattatgagatagtgcttgcgtggaagtgcatgatcaatgatttgggataactgcctattggaacagatcagtttaaactgaaaatctgatcctcgctccataacacagggtcaactggccaagataaactttttgatcatactaaaacaatgttttcttcgatgtctgtgttgctgtggggaaatagaagtgtgcatagttgtgagggatacagtgacaatttggtgttaataagctattatatggcaagcagacatagattaactgaggaacttaaattttgaaggaggttctaagtggtctaggttctgatctgttggcccagttatgaaatgaaaggaaggcaaaagaaagaagatagaattaaacctgtggttcttttggcgacgtttcaccagggacctctctaggaactgatagttcttgatcagcatgattatcagtttcatggttaattcctgcattcttctgcatcataatgctatttgacagtgaatccttagcttgaagagtttggtaaagttgctctttcaggtgagcaacctcctcttgtaattccatgcattcagttgtctggcaacaaaagaaattcagagaagcaatacgaactgatttcagttatccaccattcaactttcagcaaaaaaaacaaattgattttctagcacatctaaccttttcattaagttggtcttgtattactctgttatctgctgccttcacctgcaataaaaaaaggggaaaatgaagcttcacagactaaacttgttgtgcgcattcacatgatagaaacaaatgcgctgttctgttcataacaaaccacacaaagctgtatctaattatgcacatgtatagcgaagggacaagaccaatcctgatctgaatttaaaccatcctaagtttgtgaggggagtaacaatttgtttgttcaccatatgttccatgacaatagagtaatattgcacaacaaagggaatactatggatgaaaaaactattacatacaattcgaatattatacagtcaataaaactaattgaaagttgtatattatctagcatagcacaataatctgctaccaaaaattggtgtgctagattcagttgcaataactttggaaggaatcaaggaactagttttaaaaattgggtattggctgataaaaggtttgcggcgatgactcctgttgcatgcaacgtagtggtgataattgagcttgaaacttgataatactggctgtgcatcataaatacctcataggaagtttacagttgataaaattcatatatataagtttctcttctctttttggttcatgactttttaataaacccttgtacaatacacatgaaagactgcaaagtgcacaaactttttcagtacctcgagatcaaaggatttctcgttgagttgctcaagcagttcagcataagactgaaaaaccaataataaaaccatcaaattgtttaatagaatacttggaacaaaacaacatgaactgaagcgaatgcaggatgttaccggagtaagttctaacttgtcagccatcccttgattatttgagatggaatgaggtatctgcctttctaaagacgctatctgatgcttctttcccttaatttcatcattaaccttcttcatttccatcttcatatgtaaagaagatagagtttcaaggtgaaaagcttttagcaacatacgaaactgaatatcaggtaaggtatagagtacctgaatcttctcattatttgggctccttccagcttcctcggtaaggcgctttaggacacttgtatgaagtgcaacctcccctgacaaaatcttcaattgctctctcagtaagtcaacgtgatctattgtttttctgctggcctgtcaacatatcacgtatcaaaatatgccaaaaagaagtccatagtaagacatcatgctgtttatattacatcactaggatttgcaactatattaatcttctacctgtgtctataaagaagtccacactagtaaatatttgagcggtttagttgtcttggtaatgctaaaaatgtatcatgtaccccacaccatgtgccatccatgtatagcacttcaaaatttaaattatgctcttagttaatacacgttagccaacaaaatatactacaacaaacaaacttcagctgttggctatgagttcaaaaataacacattataaaccagtaagccaatcatgactcattagtcgatcaaagattgtttaaaagtggattgctggtttaaaactttaactaagtcatccttttctgctttagatgtatttgtttagctgatatttcacatccgacaaatttcggcctttaattaccaacaatgcatgttacctaccagaggtgtttcttctccatgaaggctgtcagtagcgaactccccatggccaatgctaaagagatcaaccgatgcactctcaccaaccaaagaatttgatattcttggttcggaaggaaaattaacactctccccaataggtgttgaaggagcagttgatttagtcaaactggacttgtcaccttctgaacttgtcagaatagaagctccaccttcacgtttctggacaatagaaccatgggaaaatgttcgtgtgaatcaattattatttcaattttaaaatcaggattggtgcacatgagttcatctatattgtaacaattcatgacgattgcacttgcatctatgtaaaagataaatcaaaagaattgaataaatggactattaagaattgcccaatttaactatacccgaagtttaaaccaattaagaattcctttccgattctttttctcctccttcgaatcttcaagtgtcatgccaagtccttcaacaggagaaagtaattcattgctttcattatccaacacgatatcacgtcttttgtaaggtaggtacgcaagctgcaatttgaacaagcaaactttatcatacaggaagttacccatactaactataatgaggaaaaaaataaagtagtaactcaaattttctgcaaacacactaaaacagagtctgccgatttattgccaaaagtatctcagtaacaaaagcaaactacattatcgaaaaaacaaaagcaaactaaggtcaaagtgtaacatgtgtttgacatcataaccatacctcctcttccccaaaagaatgtcttcttcttggtccaggatgtggagaaaatctagaagtttgtgtcgccttagtggagaccaagataagctttgtgagacgctgtatccttgcaagcaaagcagctttagcttcctcctcttgttcgagcctagactgcagcttgacgttaccatcttctagcttttcatatgataaacaaactccagttaggatgatacattcatacaccggcaaagtgaacatgcaacattatataacttgtaagtataatattattaatctacagcacagttcaagcagacaggagtagctgaagacaaatctgtaaacaactcagttaatagcatagcagatctcgcatacatacagttaagcataatgtgagcagcaaaggggcaattgctataagacaataaatattccaccttttgtttccaaaggatgatattatcttctccggcatccttcactggagtgccagtaataatacccattttcagctgttctagttcttcctttaatctgcgaatctcattctggtatttctttattaaagatttttcatctataatctgcccaacataaagaaagattcaggagaatatgtcagaaatacttcatatgatatttggcacaaaaataatggttaagaattcctgctaacataacctactttgttttgtgatgcttggacctcaatgcgttttgcacggtgggcaaatttcagtgtattatgagtctcttctgagttgctcgatgctggagtcactgtacagatcagctgcaaagtataatagaatgaagttgtcagacatccaaatcacattgaatattaaaagaaatacattagctttaaccaccatcccaactgataatgaacaacttactgaaacacgtccttgaccactcaaggatgactgaagtagacgtgttagttttgaatcacgaaatggaatatgtgtagcttttccgtcagtaagtttcgatatcacctggaatacaaaagggaaaaaagcttcttaacttccaacctatgatgataacctctataacagatttcatggatcatgacttgcggcattattttatatgtaaattgaattcatttaactggataataaatgcaaacatatcaacagaaagtcaagcagtgcaacagaacacattggaacttggaacatattatgtcgaatgaatagcaaaacagatacaaccacccattatgccaggatgcaaagatcttctgatgtacagccaatgactggacagtaatcatgagacttacagttccaagtgttagcaagcttttattgatataagatccttctttccggcgtactccagtagtttctgcccttgagctctcggaacctgccagatcgatgaggttctgcaaatgagtgagacaactaaataatcaatacatgattttggcagtatggtcaagagataactgaaaacctaaaacccaccagttgtgagaaggtaactgcctcgccttcattagactcaccacaagggctgctctctacagtctgtcagataacaaaacgaaatgaaaagggagaaggaccatatcctgatatctaatgttcttccactagtgagaagtatattttgcatgcaatttataatcttgcaatacagcagtgcaaaggaaatatcaatgtttcgaagttatataaagatatctaaaaggattaccagtgtgaaaattgtatgacttctgctactaagtagattgaagttagtggatccaacatgtctatgctctgcaaaggaaatatgaaggatctccattagtgaaagaaaactttaaaccatgatcatttttattactcacgatcctgataggttgcttctgcaaataactaaatgttaatcatgctaaaaatgaatggcacagctggaatagtgaacaagttgaaagattctaaaagatggtaatcacaagaagaccttctccagcagcaatgagggatagggcatgtgcaggagataatactacttcttctttgataccctcaacaaatgttccctgaaaaagtaaatgtagatgaaggaactatcagtcaactgtataaaaatgatgctttaaattcattcaaaattctataaagtttaagaatgaacttcaaagcatgctactatatggggtatgaagtatcaaaagatacatttcccacacaggggaacaaatgaacaatgcatggcaccattgtctctaatgactaagcacatgcatgacaatgtttacacttaactttacactgtttttttactctacacatttgaagaacaagacatagccatattaagtgaaaatgcacatgttacctgaggatcctctctaattcgtaagttctgtccagctggattgagcagatcattgacaacctagattcaacgaacccttaattagagcagcacaaaacatgaatatgtgaacgatgcaatgatacaaatatgattgcaatgacaaacctcattgtaaatttccaagtatgatacacggagaagaaactcgcgatttggtgtctacaatggtcagacagtgacataagtgtacagtgcataattgcatgttagtttatttgtatatacatgatgggtccatgtttaaaattacctcttgtataatgctaaatgcgtctttgacagccaaaggtatgatccctggggatctttgatctccctggcccaaaagaacatgtgcatcaagatatagatgaacatttgaaatataaaggaaccaacctatattgcacaatataagcctagccacatataaaaacgaaaagtaaacttcaacatgagtaaattgcaaataatatgctgcagatgggaaatggaagctgcctatctctgtgaatggtaaccacaatacatttaaaaaattacatggtgataatatcatattatcagtagcatttaacatgtgacactttgattccctgtcttatttgctggacttgggacttagagagggtcagataaggctgagtttttattagaaaagaggaacacataaccaacaagcagttataataacttgactgcttcgttttttttttcctggatgcacaatatggttatactctgaagccagtaaaatctatgattaaaagattaatagaaacatgaagctgtaagtgttctcacatgcattgtgtgggtcttcccgctgcttgtaacaccatatgcaaatattgtacctgtggcaataaaaaacagaaacatttatacatcaatctttgcttgaaaccaaaaaaaaaaaagaatccaccaccacattctatcaatgaatggtgtgcaacaataaatagcttatgaaccaaaccgcatatatctgtatcgctataatgtttagaagatatctcatagccatagtatcatggcattctgtaaatacaacccaagcctttcttttcttgaaaagttagcttgaaacagtaaacaagctgttatcatggccctatataaggatagtaaagatcaattaccatttactccctccatggcaccgctgacaacatgttgagcagcaacatcatatacctgacgggttgtagtagttggtgcaaaaacccgatctgaacagcatactatattagtctctgatcaagtaaatttgaagggggataaaacaatatactgatagccttagaatagccccttaaataatattctctcttttcatgagatggcatacatactcgcttgactagctcattttatagaagaatatattgtttttcattcataggctagtatatggaaacaaggtatgcagaaactcttttattccaaacaacaattttggtgccttaaccagaaaatgtcaacaactgattcccaaaaatggagagtattgtgcaaagttatatatgttaaagtaaactattgaagtccttcacgcatctgtacatgtgtcgattcacatttttataagaaaaattatgaataagactccgttccattaacatgacatactgccagtgcaaaacctcttataattagcacaactctagcaagtccaacagtgatgagccattgaagtacaaactcaatattcgtttgtacatgaatagaacaagttatattaccatgttaacacttgtttttacaaatagcctgtatggagccacagaatacaaatcagcgtacagattatgtgttagtacaggaacagcaggtctgcaaacataatttactcccaagtgtcccagtacaccagttggcaaaactactatattgaaatgagaaataaatataattgatgaagtgatattgagaatcccaacaagtaaaccgaacacttagcagaattgagcataatcttttaggcctttctttctattgcactgctaagaacagctgtaggtccaagtcgcaatacagatttgagaagcatttccgggacactaatttgagtgatacaatcaaactggcacgagataatttcaggcatccaaggtacccacaaaaaaacaaggaagtatcacgttcacagaactccttctagaatctagatataggctagaggactcacaccaatctcacctaatactccagccttatgagaacagcgatcgtttggacagaactcaactaaattcgcatatgccaaacgaggtgatgatcagaattcagccagcagagcgccaatgtcaatgccaccaaaagcaggcacgtaccgtaagcataagcaacgctgggattctgctcgctcctcacgaccgtgtcgccgtccgcataccatgccacctcctccccttgccgaatctcgcgggggcttcacaagcgaaaaccaaaacccaaatcaaactgcattcccccaaaatccaagcgcgaccaaacgaaacaccaccaccaccataagcaaagcgagacgaacctcagcggccggaaacggacggtgacggtgacattctccttgggcgccgggtcctcgtcaagcccggcgaacagcggcgacgcgggcccgtcgagcgagagctccggcgtgagccgcgacgaggacgtggtggtggtcgtcgtcgacgtcggcgaccccgactgcggtatcggcagttgctgctgctgctgctgctgcggctgcggcgaactcctcaccaccgccaccgccgccgccgccgaagacgccctccgctgccgcgaagccggccgcgtcgccattgcctccacagcccgagatctagcagcacgcggcggcaccaccaccaccacccgccattggatccaatccaagtatccaccaagctaatcgcccccccccccccccccccgccgctttatgcgggatttttcctagggctccccttttccctttccgtctggctcactcccccccttcactcgtgggtggcggctttcggatggctttcgcactcacgcctttttgcttccgtcggaagcgatgcgggaggaagaggaggaggaggaggacgcggacgccgctgcaaaatgtagaagaaaagaaatcctccctctctccccctctctctctctctctctcttctctccaactggctcttttggtgggtttattacgccacgggagggagcaggacggggtgggtgggtggggaagaggaggctgacaggtggggagggcgctgatgggtccacatgtaggtgagtggatgttgactcgtcggagtcactggggtaggggtttccgtggattttgattggttgtgggcgttggggtggtacggaacggaaggagaggcctctctcttctcttccaactgttgcgtagggggaggcgacggtttactccggtttgatgatgatcatctagcgagattgctgtttttcgagtcagtggtctcattaagaaaacgtactagcaagtttatcatggtagagtagtagtagactagtagtttgatgaatcaaataatgtagtactaccaaaaatatggtagtactatcataagccttgttttgcaaaatttcataggaatttaatctggccctgctcggctgtcatgttggcagctgtgacaggcccattacctgtttcaccccaaaattaagacgtgtgatgcgaacgttaattcttcactttaaatgcacaatggcgatggttgtttctgtaagtcgctgttagtagatcgcactgttatggtggtggttgcggttgtgctggacgagtggactcctggaccagtaacatcattctccctcacagccaatcgatactccttttgcgcccatttctagttggtgcaataatctccatatatgggaacctaatacatatgctcctctcttaatgcgtcacttacactgtggcacaccgaaaataacacctcttgtcccgtatccaggcaccacgcgccgatcccatctcctgtacccatcagcgttgtctttgtcgcgcgcgtacgtagctagagtagtagctacggcctacggcctgggcgcgtcgcgcaccagcgcgagcgggcgcgggcagacaggacgaacgtatcacggcgcgcggtcccggttggatggatcccgccgatcgagcgacaacagtgccaggcgcgccgcgcgcccgcgcgtcccgtccccccatcatccgtgtgcccgcgcggccggtcgttttccaacagcgcggcgctagctcggccgcatcccccggcgcccggtcctcgccatcacacgcccgcgtcggggcacgggaccgcgcgccaagcgccaaacgcgcgtgctccgagggcgtttgcaaatgcaaatatgcaacaacgcccgtgagccgccgtgtggccggcgagtgctcggcgctcgccaccaccatggcaccataggcggacgaccttcccgggcgtcacagacggagcacgggcaagagacaaacccgaccttcccaggtggctcgatcgtctcacagacggaacacgggaagcgacaagtcgacaacccggggcgccactgtttgggatacaaattatatgatgctgcagctcgcagctctctgcaggtgcgtgctgctactgtgctcggtcctctggtgccggatttctttcgagagaaaatgccgtggaaatggaatagtttccgtcacttcggtcagctgagttgcacactcgcaccacatgcgttcgcccagtttgttttgactactggacaatggacatggcgatttggcgagaccgtcagtagtggccgacgtatagtagtactagtagacgagacgcacatggctcaacgtgacaaaggcaacgagtgctagctgcttgttgcactggttcagtaagaaaaacgaagtcaaatatgatttgaagtgtattaaactcctccgtgtaagctcgtagtctaatggactatcccatcatggaaatgagtggacatggtgcccttggacgtacgcagtagcttggatggtatagagtactacggtatgattatgtcctgcacttagcatagattcgattcgcaggtggagcaattagggcacccacaatggttatctataagctatctacaagagatccatgtcagcatattttcctacttgaaagatattaaatgaagagagagagcaaagctatctactagcttagagatagtctatagagaaaaacgagacagtgcatgagagagctatagatacctatgtagacatactattgaggtggtttactattaatctagtctattgctgagatgtacatgttttatagagagcaccatactttaccattgcgggtgctcttagcatgctactataagatgattgtcaggattctattgtcatcattagggctcatgctctgctccatttcttttacagctaggagatgctctgcaaccttggactgactagtgttttttcctgaatgtcctaaattgcaggcaattgaaaaagaaatttcttgtcagggatcagaattcagaagtactccatccgattatctgaacttgtttcagggaaaaacaaacttagaagcatgaactagcagaacctgccatcgtcacactatctgtattttagtaggaggaccgctcaggctactcctacttcacaagtcctttgcagcacatctccagaagatgcagtcatccaatgagacatacgcctgaaatagtagcccatgcaccaaacaaaaatctgcgtgattgagacacttaatcgcgtgcaacgacgagaaagaaaccgattaaaaatactgagtagctgggctggtgattcatctgcctttgtttactggcataatgccattccgctccaaggcaggcagggtcctaccagactatcaaccatcgagattaagataatcgattccttgcaccttacagaataataattgtccggtcgcatgcctgctctcccagaataatacaccactaacattacgaatcattagccatggaaaagctctcagacaagacaaaaagacccaatccataccgtataaattataatcatattccagtgatcaattcatccactgcaagcactattcagtcttcacacaaacaaaaggaaacgaaaacgataactccggagacgtcgaagcgaggggtgaattgactgttgttgccttatcaggtgtgtgtatagtgtatactcctgtgagaggaagcgtgacttgtgcgtgccgccgacaggagcccagtgccctccctcgtttgcttgcaaccacggcgggtctgacgagctgatgggcacgcgagacccatcgagaacgtgacggcaacaacaacagcaacaaccaactatttaagccaggctgttgctgtcgagcgcgacttgcgttgcatcgcgggcagcatccatgctctctgtgccacgacaacgcgacggcgaaagctgcactggatctctctctccaacatgcgacagatcgccgcaacggcgtacaacgtgcgaaggcacggcagcgaacggaagtgcgacgaaagcgaaaaggggcctcacgggccaaggggccgaaacgcgcgacaccggtgtggatttggagcaatggcccagtatgcgttggcgactccggagctccaaacttgggccgagttgctaggcctggagagcccaagacgaactggaggaggaggaatgcaacgttgtgggcttggtaggccatgaagtggataccgttctttctgaccgggcaatcaatctataacgtgggcttgttgcgtctaaaaattgtgaaagtctggtgtgtcgatagtagatcgatggttacctctcgataattccctatgatggaacatttatatttctatttataaattcagtctataactgcgaatgcgaattcgtagacttatcttggaaaaatactatcctgacattgcaagtctgttggactttgcaaatatatccatcacaagggagaaagaagagactggtttctctgggcataattagcgagatgaccaaggtggcggtgaaaagggcaacaggcaagcctagtaggaaaaaaaaacggacagacggttaaaaccaaaaaaccagaatcagcatccttgacggttttgttcgctcacaagaccgtccctgtaattgatccagagtgaaatggttgaatggtctagcttttcatactatgatggcaaggtagtggtggtgctaccgtggccatcaacggatccagaaatttgatacatcggtattataatatgttgattgtgcttaaaccgtggtgttatcttctacaaaataagtattttagtagtaggtttgccaaaaatcgtgggcgtcacttgaccataactattacactgcagatccacccctggcattgggggtcaaaggaggtagtgggtaaggttgaagatggaggcttaaaatctgaagtggttagtcagtggagctgttgaaaacaaggaagaaggtgaggcgggggcatgccgttgccgctcggaggagaggcggttgggttagggggaggggagtagggcactagggcaggtcccaccaatggtgacggttgagtagaactatagaggaggatggtatgagtgttgcaatctaggataaggagtggctgacatacctcaaagggaaggagaggagatcgagaataagttttcatattaatgtagcagcacgaatcttttgatgcgatgaaccgtccaaaataattaaatgacaaaaaattatgggtattttcatgtgacaaaagctaaacacccaagtagaataacatataggactacatatttgtgatttactttggtacacgttttgtgtacacgcatgtgtttgtttgggtgggggtgttatatttttgtcgttaggtaggagtacttgtgagtggtgagctgatgatgctatatgcagtgtccctgtgtcagcacgagtggaccacgcagctgtcacgaacataggagtatgagactgagatgcagcaaaaccttttctagcattacatggtgagcaaccagtaaacccagcttttctttctactagtggagatgttaccacgcagcgatgcaccccgaaggagcaatgttgaagctataggttcgttgtttgcccctgcgccgctctgagcactgtgtatggcgcagtgaatcatcaccgctctgccctagctcagaattgtttctcgtgtcagattgattgtacttgtacagttataatctcgtccctttcctggcaacaccaagtacagccaacactgctggtcaatagattctcctattgtcgtcgttcattcataaaaacaacgaagtcctaagacctagctaggctacaacctctgattatatatggctctatcatatgacatgcgtatccaaatgcacctaacttcaataatgatgatcaggcctttatatagtatatttatgcggctaaattcgtctgtcgcttttcgcatcagcaagtaattaacagttcacagagatatatcgatcgcgttgaaacactggtactctctccgtcccaaaaaaaagacaaaccctggtttccgtgtccaacgtttgaccgtccgtcttatttgaaaaaaattattaaaaaaaatttaaaacggccaggttccaaattaaaatattattatggtttattattttacaacaataaaaatccaattattaaaaaattttaaattaaaccggccattaaaatttgaaccggaaaacccagggtttgccttttttttttgggacggagggagtatcttgctagaaaaagttcatgcatgttgacgtcgaaagattgagagatcagcgggtagaatctttcagtcaccgtactgtgacagattcatgatctaaaatgatgcatgcacgatgcatgatgcaggtctggggataatattacgaccatatactacttcatactgttagtatatatgagtagtgcatttcaattaacagtatgaagttaaaattccccggagaagccaatcattttctgcttaacgacgtcccaccctatgcaaacatacaattcatatcttgatgggcagtactgcagtgggtacccatgattttcaccttaaaaaccgtgccaatcacagcatgcatgcaaatggagaccagatcattcattagggcggatgcatatgcatgcatctcgtgtcagatcggtaggtcgatcgatccatatgcatcgatcgatctgctgcagccagtaagtatatatagcctgcccccaccgcattgcatcatccagtcggagtacgtaggcagcagcagccgatctgtctccgattggcgccggccggccgcctgcccgcctcggcccggcccatgtctgctgccttggtgtcggaagcagagcttcgctcgcgtcgtcgtcgtcgtcagctagcaactgatcaacagttgcgctagctgcaacgtacgacgagcgcgatgagatgagcaaactcgccgtacgttacagctagcgtctcgtactgctccggccagcgcgcggccggccggctgcccggatcggagtaccaccaactctcgcccactcgcattccgatgcggttaaggctgcacatgctagcgcgcgcgcccggtacgtatagtagtacagtacatgcttacaaacagcggcaagaacgaagagcaaagaaatctgagaaagatcaatgcgtcgtcgtcgtggtggtgcaggggaagcacatggattgaatcagtatatagccttagctgctgaggcgaagacgcgaggtgagatcgtgatcagatcggtgatgagtgggcggcagtagctgaactactggccgatctgtgcatctacatggcttcgctctgctgggcacaagtacagctgcatgctgcatgcgcgcgtcttctctgggcgctggtcctgcattcatgcatgcccggcaaccactgcatgcgacgcggtggtggtggtggtggtggtggtactgactactggctgctgctgttgccttctgctggagctggacgcatatgtcatatgtgcatgcagtactaccaccgctgcagagcaaaccaattggcatgattcagtgccccctatttagatctgtggagagtctcttgatgctgtgtgtagtagtactgatcatcgctgcatgcaccttgctggccagcagtgacctgtagctttctatagcttcggtgtgtgtatgatcctatatatcgtgcgtcatgacatagcagtatatagaaatagttagctgcatctggcagcagcatcagcttgatagctagtatgcggtgcgcgcaggcctatcgccgatctcattgtttgtctctgtccttggcctgctttcttgcttgcctctcctctccccctcaaaattgcatattgtgcttttctgtacatgggacatccatgcatagagcgcagatcagttctctctgctcttctttatttgtaatggaatgataattgaggtgtttttcgccggagaaattaatcatcaattccgcatgcatgttccagtttctgtccctaagaccaaactttattgccaaaccagtgactttgtatctgaatgttgtctgtcctgatgcgttttaattatctatggctatagtatacacatctgaaagaacaaaatggttgcataataagtagttgagagcatgcatgaattgacggagatgatcgacttcggctttttttgcagcatctctttgagctttgctggctagctcagtaccggcttccggcacagcatgcatgcagccgtgcatattggagtaaaagcatactataggagtaaaattaataacgatcgaagcactgcagactatgtcaggctgctgtgccaccaaatgacgacaagaacgtcgaccgaaattgaatttcgtaaagtacgggggccgtacgatgatcgatgtgcaatgcaatgcaatgatctattagctgttctgaaaattcatgacgtgtggccggtggttacatatgtacttgatgagattaattcaggctatttaatcaaactatgtacacgtacaccacgaggaaatccgtggttttgtgatctcaattacgtacgcgtatagatggtcagtagatccagtaaatgtttgtactgtactgtgtgttcctaggctattagcccagaatgtttatgtatgacaggctgcattttctcccgatgtattgattagacttagaagtagtactagctaatggaattagcagctggtcgtacgtacatgtgtaagtacatctcatgtctcgatttatatggcgctgaatgattatcatctatagtagttcatatttcttcatgacatttgagacccagaacttttttttatactagaaaaatgatgagctaatcacacagtagcgcattccattttttattttacgggtccaattttctgtctcggaccctgtgaatactctttattgattctttttcctcctctatcaatataaagtggtaaagcttttgcttttccttaaaaaaattattgttcactaatatgatgctagctactatacttttgtcccattaattcgatcatcgcgcaggggtataaacaaacggaaagttatcctccgggattgtctattagggtttagctaggtagaaaaatcagactgactaaaattctatggagaggtgggtcaataccgtaacgtaactagtcgccaatctatatattgcacagactattatatatactgatactacaaataataaaattctaaagttatgctaaacatgttgattacctttttgaattattgtagctacttatattaaaagaacaagtcacatatcagtttcaacttactaattaatttaattttgaactttagttagaatatattaacttaataaaataataaaatagagattgcaatctaggtaccatatcacatatattaattacaaatttttagattattaaattagagccatgctattttcaattgcacaatttattaaacatgtactatgcatggtcacgataattaatacgatgcatcaaatcaatggccagagtttatggttaatatgagagctttcttgaattatccagttagtccatgagaccatagggaaatcattactagctagttaaaacaaatcatatgtgtgctatgaaattcttttctatgtgcgcttttaatttatgaaaatcaattaatacaccctcatgtccgtacaatattaattgcacgaggaacaattgtattttgcattttaatttcttgttatatatcagcagccttttccttcacgtgccaatctgccatcagtaaattattatattactgatcatctataagaggaaggccagaaagtacatgaaatacacctggctttggcagatggagcacatgctcaaaagagccatctctgaacaaagcaattcagatggacgtataattgggccatggggtggaggaaaagaaaggtcatgtacactatatacatacgggcccatgtacgacagtgttggatccacacattttcaatctactgctgcgtgctggaaccgttcttccacacacatgcatacatttctgtgggtaaattaattattcctgtttattcaagcaaattaattaatttaatttcctgtttattcaagcaaattaattaatggactagttttttcttctgtgttttctttgacttttcaagccaatattgatatccataacaagtgcatcttttgccgttttggaattgattttttttaactgatctttgcaattcgaaggattttctttttctttgcctggtaaaaataaagtggcaacacaagctaggtagctagctaaacttggatccggacaaggcaaaaagagtagattatttaagctatgagaattaacataccctttcttgcgactgctaatccacaagaagaaaacctaattagacatggattacaaatggaggtccaagctgacaccctccttctgccccaattcacacctacctagcatctccggcgacgtcgacgagcacgacgacaacgaaggcgacgaggacagcaagctcatcggcaccatctcgtccttgcatgccacctcccccgccgccggcgtgcccgccaccgtagtagccagcttgtcagcgccctgcctgccggccgtgctgccgaaattctccgtcggcggcggcacgctccacagcccggcctgcacggggctaccgttgatgggctgcgccatggaacctggcccggcgaaggcgcccggggcggcgctcgtccacatcgggtagtgcgccggcggtggcggcggcggcggcggcggcgggtggtggtcgaagcggccgccgatgtggtggtggtagttgaagaggccgtacatgtgccccggcatgtagcggtgcatggcgagggaggcctggaggtgagctcgcttggcgtgctgccgctccctcttgtgcgcgttctggtggccgcccagcgcctgcgacgtcgggaagttgcggcagcagtagtggcactcgaacttgcgctccgccgccgccgtcgcggcgccgccgttcttggtgccgccgtcgccgccgttgctgccctctgacgtgaccgtgctgccgttggccgcgtcgggggagcctgcaccggcctccgtgggccgcagctgcaggtcgttggagaattcgcagccgaacagccggattgtgtcccgcgcctgctgctgcggcggcggcgccggccggatgaacggcagctgcgagaacgagtcgacgctgcgcatgtcctgcggcttcgccatggccgtctaaccaaccaaccaagctatctgcttctacgtgaaccaaaaccaagaattaaccacccaactcggggcaattcttgctagctgctgctatatcttgcgtctccgcgctgaagaaattggctacgagttggtgtggttttaaggggatatgggagttgtaagctggggcggaggagagggggacgaagagggggaccatgcaagaagtaagagcagagggggactaccaagcttaaagctcccccctctctcatcaccaagtacaaatgcagctgcagtggcagttgctgttgctgcttgtgccctccctgcctagctaagctactgctagtgcaagctatcgcctcatcagtctcacacacaatgacacaaaacattaaccccggcccatttctttcttggcaaatatgggactagtacatatacgtactcacacaagtgcagctatagctagactggttaggtatagctagctacagagagaaattaaaatctggtagtgtttattttctttcaaacttctaaaaattctaacacatcagatgcttaacacatgtatggagcattaatgtggacgaaaaaaaccaattgcatactttacatgtaaattgcgagacgaatcttttaagcctaattacgcgatgatttgacaatgtgatgctacagtaaaatttgctaatgatggattaattaggcttaataaatttatctcgcagtttacatacggaatttgtaatttattttattattagtctacgtttaatacttcaaatatatgtccgtatactttaaaaaagtttagcacacgaactaaacacggtctctctgatgatttttttttttgccctgtccagctttcatgcatctgtagctatcagtgggcatcaagtggggggagatgggtagtgtgactccgtctatccgtcgctctctccctcccctctgctgcctctgggattggctgtagccgggggttctttatgggaggttggcttctttacaacatgagagaccgcaggtggtcctcctggggacggcgacgtgctcgatcgcattctgcttgcttgcttgcttgcttgcaatattgctctctccctccctgttcatgctgctgctcctgttgctgcagatgcatgattactgcatgccggccggccggtagtgcagcagtcatgcatgcatcgtttgcatgcgagtttttatctctttatagctttgcgcggtggtactgctgctaccatcgtttgtagatcgatcgatcgatgttctatggatggcatggcatggcagcaagctgcttcaattcgttcgtttctctccgtttctccgcctgtcgatcgatatggtggtatctttttgacagcgcggttataataatcgtgggcgcgcgtacgtacgtgttcgatcgatggcgcgcgctgcgtcgatagctgggatccacatgcatgcttgattgctggatcgaaagctagctaattgagatagccagctgagtgctgcagttttgagatcatgtcgatctctacatacactccatggctgctacagtagcttttttttcccctcctctctttttctgcaggcttttgtagaccttttctttttacggaattccatgcatgcattcagcgatttttcgcctgcttgttgtagtagtgatatggaaaaagggtaatttcattggagttgtttcagagagatactacgtgaaaagttgtcaatgtcagtaactcactctcctccaggacgtctggtttcatatggcttctgaattaatgacccctatctaccacaaatggaattggccgtagttgagacttgagagatatactactgtcgttgttgtccatctagctagctagctgttcgagtagaaaaccaaacatctcctacacaggtagtatagatcagtcgatccagtctctccaacttgtgatgaacattaatgctcgataggacaagaaaacattttcaagcctcatgggcgcgtaaggccgtagagtgaccgtgtgccaaccgcgatgctatttgaacttgtgttatctctttaagaggtactcgtctggataagtacatcgccaacatcgaaacagtgcacgcatgtgtctctcgacaagtacataatgatgacaccaatgaaatctccatcttaatttcatctgtggtacagacatcgcatatgcatgtcttttttttctttttttaatttcttcatgtccatgaattaagattgtttgtgttacaatatttctactgcctaaattaacggcggctcccaggatagagggacacatggaaaagctgagtgaaaacgcaagctcgactgggactcatgatctcagtaacattttctgacacttacgtgtatgacagatatcaatatcgaccagaacgagctcatcctaatcataatgaccactcagagatccacgtttatttcaagttgagaaatcgttccaaatgatcaaaattccttactacgatttggacagtttttcactggtttaattaacctggcgcaaaaacgaagaataatcaaggaaggaccaccgtgtagctgtcagtagtatgagagccatctatctgaaaacacgaaaatgggaacgctcagagaaaataggagtagaaacaaagcgttgatgcgacacgcaaaagtagcaacatttatgtacatcgacgtgcatctggtcatcagtactcatatgccctgcttgttgctgccttgcttttcttttttttcttctctgcccctgtactggtacatgtcgtcgtacgagttagctagcgggcaacagttgtagccacagcttcgccgacggcgactccgaacccctgcaggtgcaggtgggtgcacgccgctttcacggcgacgtcgcggccgcgcgctcgccactcgacctgccggtcgcgccagatctcgcaggcgtcgccaaatattctcgacatggacttccatttgtgtgttgtagtagtatcatcgatccatcgatcgattgtctcacgcgtttttcaccttttgccccctctccttgtccaaattgacaccgtgttcagttccaaatattttcttcaaactttcaacttttttatcgcatcaaaattttcctacgcacacaaactttcaatttttccatcatatcgttccaatttcaacaaaaacttttaattttaacgtgaactaaacacaccgtgaataagcttcttcttctccttctcatcaggttgcagtaatttattggcagatccaactcccccgatccatccaccacacagttttcctcgtaaatgccgtggccgtacgatagatatattgatggtaggctcgagctagccgtcgataagacacaaacgcttgtcaggctggaaaggatttgacagggaaaaggtacgggtacttggtgcaaataattccgtgccggttaggctgctgttattaccgtgggcaagtttctcacccacgcacacaccgatcgaccgatggatccgtacacttttgcacgcgtgagccgtgtggaaaagtcgactcgcagcgggcagagacgacggtgcggccgcggcggcggtagcatcagcaacgtgatggtcgtcgtaactgccggaaaaggacgccgcttgcatgttattttcggtaggaagcgatcgagatcagcgcgagacgagagctagctagctgcaattctgcggctctgcccaacccaaccatgcgaattgcagtgcatcatcaccgatcgctcgctcgctgtctctctcgctctccttttcgctttcgctgcttccaacgaggggcaaagcacgcatatggatgtgcaggtacggagacgactagtatgcatgctggtatacgtgcttttcaccgcgctagctagctaactctagttgcaggacatgacagccttaccactgctcgaccagagtactacctcccctctctcccacaatagttgtcactttgacttttttttaatatttaatcattcgttttatttgtaaaattagtgcaaatataaaaaaaaataagtcacttaaagtacttttgataataaaacaagtcataaataaaataaataataatttcaaatttttttaataagacgaatgatcaaattttacaaacaaaaactaaaagcgacaagtaatatgggacggaggtagtactctcttcacattttgttttggatttttggtgggaggctagttggttggagaactacctcatatcaggtactacataccaaggatatggatattcatctcttgagatgatatccctcgttacttacatgtcacctaaatagttataaagaatacgaaaacacgataacatagtgacggagcgtggggctcctcaccgggagaccgcgcaggcccccctttgccggttcggccgggggccctgggtgagattctaagctcctagtctgtgtgtggaaggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctctttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccgggaccaacgtgccatctccaggagctaacacgccggctccggctagggacgagtgcttggaggctctcatcctgacgggatagggcgaggcgtgcgtcagaccgcctgtcgccatctaacccacgatctgatcggtctgtgactggtcactgaccggataaacaagcgcgctgcactgcgttacatgcggcgtgacgcgctcgtccaaaccgcaataaatgtggttaggtgagccccgctatgctcacctacccaatatacgcggcgcaaaacccacaaggggtcggtgcgcctcggccctcggggccgagacgggagcggtccgacccctcggggagacaaagagaagggcggccgtatcacccttgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgtgagaaacgaggagccgggcacaacgttggcaagggtataaagtcgccgaggaagagatttgcttccttcctctcgccattattccccttgtcttcgccgcttgcgccctaactccttatttcctgtgccctaccttcgccacacgcgctcgctctcaaacatctcttcttccggcgtcatggcacggggctccgctccgcttgacggtagcgtgctgccgccttcccgcatcgtgagcgagagacaggccggtctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatctcttcggctgttccggtggttcttcaccgtacagccggtgtcgccgccgtcagtgattggtggttgctacttccagccgcgggggccggtgctgaaccgctacattccctgcgtcttccgcaagaagtgggatgactggaagagcgactggttctacacccccctcgccgacgaagcgcgcctccgacttccgagccagcctccagcgcaggcctccaactggcgggcgccgatagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggctcctgaggacttcaagatagtggtccaacgggtgctgaatctcagctccgtggaggcatccctcattcctcaaggagtcctccccctctgcagcgatccagatcgcgccaacatcctgaccatcatgcaggcggtaggggtgtcggaggagcgggctcctcgaggccacgatggcacgggcgggagccgcaggggggaacaatctaccccgggagggggtcgtgcttctgggccccgcgacgggggcccggggagcggccgccctgccgacgcccgggggaagaggaagcaggaaggaacccctcccccgtctcctccccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggctcggaggcgggaatctgaccggcgagaagccgtggatcgcctacgggaagccgaggaggccgcccaggtggccgtccgagctcgccaagctgaagaagccgctcgggaggaggccagacttcgccaggccgaggcgacgacatcctccgaggcgacctgtgaaactgaccggcaagaggccgcggatcgccttcgagaagccgaggaagctgctcaggtggccgtccgagctcgccaagctgaagaagccgctcgggaggaggccagacttcgccaggccgaggcgacgacgacttccgaagcagctcgcgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcaggccttggccgtcgcaaacaccacggtgttggacgggttaagtgcccagatggaggccttgcaagcagagcgggtggagctcgacgccgcatgggcatgtgtcgaagaggggtgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacttggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgtggccgcggcgcaacggctggcggacagcctgtccctccgcgaggcagtgcgggaggagcaggcgcgccgtaatctggaagatgcccgcgccgagagggccgcgctgaaccagcgggccgctgagctcgaggcgcgggagaaggagctggacgcgagggcgcgcagtggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgtgccggccggcaggcgggcctctggggcgggcggactgcgaagtacgccgccaaccaggggggcctcgcccagcgcctctcggagatagccgggactctccaacagctccccgaggagctcgagaggacgattaagtcatcctcgagggacctcgcccgaggagcggtggagctcgtactggcgagttaccaagccagggatcccgatttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgggcgcatcggagtgagcccccaggcccccgccaatctttaaatagtttcttcttttcttcttccgaggccttcgggcccccttcttgtatagactaatttaatatgcaatcaaataaagaggaaatttttttgtgtcaattctatttgttgtgtgtatgagacgaggatgcctgtgccgcggttcttttgtgtcttggcttgagcaagggctcgtgcccaggtcctagtcctcaaatggctcgggtcggggctagtgcctggggagatccacatgtcgagactggctaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaatacgagtgacctatttcaagtcaagatccttcaaaaggaaacaacagcacatatacagcctttaggaaatcgaaaatgcttttattgaaatacagatataagagaaataagaatctgcatatgtggtagcccccggccagccctgcacgcccgaggggggtgcggggttggccagagcccgaaacctgacacccgatccccctttaggggtagaagcgacgaaggtgttcgatgttccacgggttaggcaactctgtgccgtcgcccgtggccagccgaacggagcccggccgggggacgccgatcactcgatacagaccctcccacattggtgagagcttgctcaatccagcacgcgtttggacgcggcgcaggacgaggtcgtcgacgcagagtgctcgggcccggacgtggcgctgatggtagcgccgcaggctctgctggtagcgcgcggctcggagggccgcgcgccgccttcgctcttccaagtagtcgaggtcatctctgcgaagctgatcttcatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttctcgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttattgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctaggccggctgatggatttgcttggcgtggaattgacacgctctgcatcgccggaccaggtcgactgcatcattgagagctgttggccaatagaaaccttgacgagaggctttgccaaccaaggtgcgcaaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtttgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaagcgaaccaaatatctgaggacctctccgctcggcgaggtcaacgtgacccccgcaccggcgccctgaagagacagggagccgttgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagttccctctcgattatgcaagatttggccgagggggtaagacgtaaccaccgtgacccgatgtgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggtgctctttgtccaagcggcctcacggggtgcactcgtcctctgtgccgacgacctcggggtcggaggacgacaggggcggccttcccacagtggcctcggggccgtcctgggggtcgggggctcctggcgtcgtcggacaagcgggcaaagggccaactccggtggtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctcccggctctctcccgggccaagccagcacagggtgggggtgcgcggaatgaggattgtcctcatcgcgctccacaaccaacgccacactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagagccttctctcccagcctcgatatgaaccgacttagggcggccatgcaaccggtgacgcattgcacatccctaagtttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttctgctagatccgagagtaaggtctcttggttgcgcgtctttacaaccaagtcatcgacataagcctcaacattacgtcctatttggctacctaaagaaattcgagtagtacgttgaaaagtaggacctgcattctttaactcgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcactgcgagacggtgctcaatcacctccctggggaccccgggcatatccgccggtctccatgcgaagacgtcagcgtttgcccacaggaaagagacgagcgcgtcttcctatttgccgtccagaagaccaccgatccgtgtggtcttggacgggccgtcgcccagggcaacctccttgaccgggacctcgtcgcatgtgactatccgctgcctcgggacggcgggggcggaggtgccaagcctctcgtcgcctcccttgggcttggacgcggcggcgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtaaccgggaggtcgatatgacctagcggccaagtgtgacccggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcccccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcatgaagggaggtgttgtggacgatgcaccacatgccggttgggcgctccctactgagagcgccggcctccttcttttggtcgctcgcaggcctcccctttcgggtggcccacggagcgccctcgacggcgaggacatgaccctcgtcgtcagaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccccctgaacgcgtagatcaccgcgtgtgcagggatgcatggtatggtgttgcggacttgacagaaccgctgaatgtaggagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccctggcggcctcgatcccggtcgtgtagacctggagaaactcggcggggttgacgctcccgtcatatttttcggcgatgtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccaaccaacgttgggctggagactccgggtcagggacaatgggcgggtgacgtaggagcgcgccctggggcgtgctgccgtcgccgtagacaaggaggcgacgctccccatctcgccgcccttccccatcacccgtggatgtcgaagtcgcggatccttcgaccctctcgagcgcctcctcctgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtgtgtggagggttcgcgggagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctttttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaacaatctgcatgttcgcccttcttcata

SEQ ID NO: 72637 - DNA, 31782 bp, Oryza sativa
gggggggttgtgtgggtgttaattctccaagagtaaattgcatcggcgatacacgaacttgtcagttatgtaaaatctagtgtatgaacttgcaaaatgctcattttggtgcatgaactaattatcttgtgcgtgcaaaataaagtcaaaaggacattacatgactaattttgttgatttatgtgctgattaggatactacgtaaacatatatacgagaatgttgctacttggacatacacctgttcaataaaaagatagaatgagatatagtgattgtagagaaatatataaaaaaccaagcaatgatataagggttagaaacatacgaaattcaagataaagtagaaaacaaatttataaatatagcatgtttttatgcgtaattactatacgtattcacgctacatcctaatcaatatcagctaggtggaattaaccttgccaagccattttggacctagtttgcacggattagataagttcgtgtaccaaaacgaatattttacaaattcatgtactaaattgcacccacctaacaagtttatgtatcaccaatacaatttactcattctccaacctcctttagactttttttcttttttttaaaaaaaaaggcaaaaggggcatatgcagcaaatcaaggccaaccctgccaccatgtcaatgtcatgggtcggtgtagccttgtcaaaaaggtaaaaaaatcgaggtataggggttcggagtttttatctctgaaccctcgagtcggtatttttcctttttaagtcccaaaataggtcagtaaatgttttgtttttactcgcggaagcagtatacttggtttttatataggcctgtaattttttttatggaggcctgtgaaaaattgaaagtgtaggtggtaggagttttcatctctgaccctccttatttggtgtttttttggtctaaggccgagtttagtttctaactttttcttcaaattttcaactgtttcatcacatcaaaatttttgtacatacataaactttcaacttttttcttcaaacttttaattttagttaaacttctatttttggcgtggaactaaacacagcctaaattgtccttccaaatacattggcttctgctgcgcaacaattcagcccacttttgcggaacggcccaagatggcacctgcagtaggtgcactggcccgtagccaagttttcccagcccagccatgactcccttgagggatttagggggttcggagtttcagtctctgaaccttattgagtaaatatttttccctttttggagcccaaaataggtcagtatatgagttgttttactcacaaaaacaatattagctttctttggcctgattttttttcctgatggagaggcctgtaaaaattgaaggggattgtcggagtttcaatttccgacccttttatcagtggaaaaagtacaccggaggtccctcaacttgtcaccgagttacaaaatcgtcccccaaccgcaaaaccagatatccggcgtccctcaacttccaaaaccgttcggtccttcggtgtttttggctccggttttagcctacgtggcgactgagtcagcgtgggccctacatgtcagtgtgtccacgtcatcactccctctttttcccatctctcatcctctcttatcccgtactactcagttactcttttgggcaggccgaacccgccggcgcaaggtggggagagggagggcggccggcggtggccgacgctggtgcggcgacgacggcggcggcggcggccgatgctggggcggtggcgactggcggtggccgacacgggagaagccgagacgatggcttctcctaccgcgggcgcgaggcgggtgggagggcggccgatggtggtcgacgttgggggcggcggcggccggcgatggccgacgcaggagaaggggacacgacggctcctcctaccgcgggcgtgaggcgggagaaagagggagggcggccggcggcggtggccgatgctagggcggcgatggcggtcgacgctagggcggcggcggctccggcttcgatttcctccgctctctcctccgccgcatcctcccgtcctccccgcccgcctccctccatccctccgtccgcctcctcacctccctttcctccgtccgccttcctgcgcgggccctccctcatccaaaacaagcccaggtgccgccgcccgatgacggccacagccccaccgtttcccaccattgccctcgttggctctgggtcctcatcccaccttcggccacggcgacctcctccgcctcgccctcccagctgcgagcgggatggccagcgactcggcgagggagtggggagtccggcggcgagcgcgcacaaggaggaaagaggcggggaggcctctttatccgcacggccgccgcccgtcggccctatccctgccgcccccgctcctccgccgtcgcctacagcctctgcgccgccggcctcctccccaaccggcctgctcccgcgtcgtcgccgccgccgccgcgtcgcctgtcgccagccgtcgggccttctctcctctcccttcttgccccggcgacctcctcacgacccactggccggcctggtagaggagaaaagcgagagacagagagaaagaggaggaagtgaaaggagggaaggagagagagggtggtacgtggcatactgacaggtggggcccgcgtgggtcccgcactgactcagccgccacgtatttcaaaaccggaatcaaaaccaccgaaggacctaaagtaaacggttttggaagttgagggactccggatatctggttttgcggtttggggacgattttgtaactcgatgacaagttgagggacctccggtgtactttttcctatatcagttatactatatgtttgggcccaaatcgtccttccgaaacggcccataatacagcggcttctgctgcgcaacaaggaaaaagtacaccgaaggtccctcaacttttcatcaggttacaagaacgtcctcgaaccgcaaaaacagatatacggggtcccttaactatacaaaaccggtcacaataggtccctcggtggttttggtcccggttttatcctacgtgactgttgagtcagcgtgagacccacgtgggacccacatgtcagcctgtccaggtcagcttctctttctttcccctcttctctcccttcctcttccagtcttccctctctctcactcttctctctagggctctgggcaggccggcggaccgacgaggcgaggcgggagaggaggtccggcggccggtggcggcggcggagacgacgcgggagcaggggagcaagtcggcgacggcggcgagatgcccatggcgaggtactggaggcggagctccgtcgggacggggagcgggacgatggcggcggacggcgggcacggatcgcgtcgcccgcccgtggcgacgccagcgccggcatcgcccgcccgcacgcgatctcccccaccgccgatctaatgatcagcactatgcactacatggcaaccattggtggtagtgtggtactagtcgtggctaactaactggaggatttcctcatcattcctgtaagtaaacagcagcagtcaattcacaacaatggcatctcaccgtcaccttgaacacataacaggtgctgaagggtttggtagtgacgatggggtcatgcagtgttgttgccactgcccactggtgaaggctttcaccatcgattgctgcggcatttgcttcaagagattcctcaacgtccatagaatcgacttctgtctcatcagactccattggcacttcaaagaattctctcttttctgaatctgaagaagaccaattagatgccgtggcaatttgtggtggcgtccaaggaactaaagccaagaagttgctgcacccaggagatttgtcctccagcccgtgatagttcctttgcataaaaacctgatctgaaagatgagaaagaaaatggtgagaagcaatttcaaggtatggatgataatcctgtcctgacatacaggagatcttggtgggactcgatgaggaggagggccgagggcaccagcacgcattgcggcgagccgcatggcgccgggcggtaggaggcggaggcggtcaggttgaacggcgacgaggcggcgcgtctggccgctgacaggggagaagcgcaatggtggcgctctgcccctcgctgtcacctccccggtcccatctttggccgccgtggagccccactgcggccgccaccgccgccgccgtcgccggccatcgtcacggcgccgccctcctcctcttccgccttgccccaccgagctccgggccggccgccacccttcatcgccagagtcacgaccaccatcgcctcgccagttcgccgcgccgagcaacaggaagagaggcaagaaaagaggggaacagagaagatgacgtgtcatactgacatttggggcccacgtgggtcccacgctgactcagcagccacgtaggataaaaccgggattaaagccatcgagggacctattgtgaccgattttgtatagttaagggacctcgtatattggttttgcgatttgaggatgtttttttatcccgatgacaaattgaggtaccttcggtgcactttttccgcgcaacaatggggaccattaccgcggaccggcccaagttggcccaagtgcactagcccagccacgagtcaatcggtgtcactgaacagcgggccccagggagaacggcgcgttctgggccccaccctgcagcgactccggctcgctcgagcgagacagcagccaaaccctccactcctcgcttctccggtggttctcttctcttctcttatcccccggagacgccgctgcggcgccaccccctcctcgccgtggacctcggggtgggagcgtggcggcctgcacagccggagctcagctcgcccgccgcgtcggatggacgccgcctcctgctgccgcgtaagcgcgggcgcgctcccccgatttccgttctcgcttctcgaacgttctagagccttctacggtgggggatccgtgtggtgtgacccatcgtcgcttctctcgctctcgcaggtcttctcgacgcagagatgccgcttcccgctgcggaggctggcgccgccgatttcgcggcggccgttcggcacggagtcgacgagtgagctgttcgccgcgtcgacctcgaagcggcgctcccgggggcccgtcatggcggcgaagaaggccgccgagggtgagtcgacttgatcccattgctgtactgttcttatttttggttcaggttgagggtttggtgagggttttagtagggggattggtgtctatatgttggtatttcagtgatgtgagttttggctgtggagtaggtgcattaggcgtccgatttttcttgggattactctgtgtctgtggtcaatgtatatcgtacttgctctgtggattgtggggatgccagccatttttgtctggtgaggcgttggaggttgaagctggtctatggcctggagattttcgttcttgctgttcacgttttgatgggattgatcacagggtgaggcacatgattacagatattgaactcgtgtgacgtacagcttaaactggttggttaatttaggttcaaatatgtgattgtagtttccacttctgcaattgctataattattttcagcttaagcacgtagggcttattaaactcattaccaaacttgttttactgcagttttctgttacatttgtacttttatgattgatgtgtgttacttaggctcaatctgcttggtttagccttaagtatgctatgacctgggatttttgtaattggtgtacttttcagatttaagaatgtacacacctattggacttctcagttcgcaccaaaatgcacttattaggtctcaagcaccatggttggaagattattattgttttgcgtatcagattaagcttaattctcattttctccatttggagtagcatcaactagtgctcgaaagtcgaaacttgatgcttatgcttgttaggatgaaagctgtttaagcttaaatgtgttttgtatacccagaattcggtaatcagattgatttttgaaaataactttgttatctggtgttagttgaaactttgttatttcagtacattccattgagattcaaatgcagtgagaccctctgcttacttagtaggtgtcaatactgaagcttttactggcaaaagttatggtgtattttgtaatgaaaatctcgtagagacatgtaattaattttatctggctgttttataatgaatagtagttggtagtttgacaggttgagtcccagtttcaatttagtactgcttgcagagttaaattcattaagatataattatatatttagcttcttgattctggctaggtgctaaacaagaagaggggaaatacaaacacacggtggatctaccaaagacaacttttggcttgagagctaattctgttgtgcgggagccggagctccagaagttgtgggaggagaaccaggtgctcaagagggtatcagaaaggaacactggggtgagtatttcttcgagtaaagctaaaagtaaaattaaaatttacctgactttgttggttttcttgactgttggattaggctacatttgttctccatgatggtcctccttatgctaatggtgatcttcatatgggccatgcactgaataaaatcctcaaagatattataaaccgttacaaggtatcgtttactcttcaatctaatctgagtatttttctttaaaaaccattgatgtatttttcagggcaattactgatgcagtcatagtatgttgtcttattcagttcaatccataggatattctctgttctgagatcaatgttactgtacggatgattggtgcatagattttattgtcttttccaatgcagtgcaatttctgtcatttctttatcttaacatgtagagctctttagtgtagttgattgtgtacgagatttggatgattaatgaactttttgctaattctagtagttttttcctgataactctcttcgctgaaatgtctttaactttttttggctggatgactatgctttttatgttggtccaaaccaaaattgggaacataaatcaactgacaccaaaatttgcttttcttctgtgtgcagctgcttcagaatcacaaagtttcttttattcctggatgggattgccatggccttccaatcgaattaaaaggcaagttcatctttatatccaatggaaacaccctatgtttacaagaagttaggtaggggttggttttaacacaatgcttgcatgtgttagaccagccaagtaattattgaatatccttccaaatgtaaccattgactatttgctgcagttctaaagtcactggacaaggaaacattgaatgctctgacacctataaaattaaggcagaaggctgcaaaatttgctaaagcgacggttactacacaaatgaattctttcaaggtaaccatttctttattttaaagtactttagtggtgacatgatctaatagcaagttgcccttatctatgttttgtggtatttcctggtatgattgctgacttgcagtcatctaatatctggaattctgtctcatgttagcctttagtttcatatttctataattgtattaaccaatgacattgtgcctgcagcggtttggtgtatgggcagattgggacaacccttatctaactctgtcaccagagtatgaagctgctcaggtctgatcctattgtttatagtaattttgccattgcatcaaaacttatttatccatttcacatgaatgaaagcttggaggtttggaattaccttagttagatcattgatatcatcttggtcacattatagctgctagctctaataaaaaaaatagagctgtttactttcagttccttttagtccatttaccatcgttgatataaaatatataacgtgtatgcaaattttatgctgcgagaataaatactgatgttttctttttcatccttatcatatgtttttaatcaaggctaaccgtaacaactcttgttctccattttgatatgccagctagaagttttcggccaaatggttatgaaaggatatatctaccgcgggcgaaaacctgttcattggagtccgtcatcacgtacagctttagcagaagctgagttggaggtatgcttgaactttctacttgatgctattaatttgctgtcaaaggctttgttgtgcattaatttttaagtgactattaaatattcgaataaaaaattgacaattccgatttgtttcctgtttaatttcaataattttcttgtgcttcagtatgtcttctcagtgaaaagccactagatgtgtcacttatttcttcctgttaatattaggcctacactgctgcagaaaaactaccgagcttttttcatgaagtcctttcatgtttaagaacacttctcttactaaccaaccataagagcgctttatgtgtcttattacataaagcacattacttcgtacatgtagtctttcacttaattcatgattggtgatcttttattttttttctcccttttcatttatgttctttagatttcttttgaatttgattcctcatatcatcacatgcattccttctgttcttccagtattcagaaaatcatatttccaaaagcatgtatgctgcattcaagatcaccaatctgtctaagcctgggttgctggaggaatttctccctaatttatgcctagccatatggaccactactccatggacgattcctgctaatgctggtgaggtgatgccttgattgctttaatgtattcagtgagtgtcactcttataattggatttcatcagagccaacgtaattaatttcaaaatatgtggctaattttgaagctatatgcgtctgtacatggaaaatagcatattaagaaacagaaaacttcacatgttttgtagttcctagaacctgtaattcctagaaggctagaacttgattaagaaatactaagtaatatctacgttacagtgatataacatagtttgattgtaaatcatggcacacatcttgcttccaataaaaaaaagaaagctctttgccgatttatccctccatagcaagaagatgcttcatttcaagtatgggtaagatcgaataggtgatactggtatgctacacagcatttcatgtttttgtttcaccagcagaaacagtgtcttattgtctcagctattctggaattgtagtagatagcattatgtccctgtctattcttatgtgtctgctgcgcatactgtatggattcgcttcaactctttggtattctctacatattaacttgtctaagaagccctttcttctttaaccagctgttgctgtgaaccctgagctcacttatgtagtagttgagctgcaatctgtactagaaagtgaatcaacatctggtggaaatcaacgaaagcttgggagtattttgagccctgggagtcagaaaccatttatcatcgtggctgctgatcttgtctcagctctagagtccaagtggggtacaaagcttataatccagaaatcatttcctgggtcagccttggagcactgcaggtattttgtttagcacttctcacttcattatgattgtgcttgacctatttattgttttgtgtttatttacattatatttggtgttttcaggtatattcatcctgtgaatggcaatgaatgttctgttgttcttggaggagattacataacaactgaatctggcactggccttgttcatactgcccctggccatggtcaggaagactacataacaggtttgaaatatgggcttcctattgtgtctcctgtggatgatgaaggaaacttcactgctgaagctggacaattcagtggtttatctgttctgggagctggtaatgccgcggttgtgaattatctggatgaacagtgttctctcattttagaggagccttacagtgagtagattgacaataacctccacaatctggtttcacttgtgaatacgaaaaaccttattaagtttgtcttccaattgtatctcttggttcacagaacacaagtacccctatgactggcggtctaaagaaccaacaatattccgagcaactgaacaatggtttgcctcggtggatggtttccgtaatgctgcaatggatgcaattaggcgagtatcttggattccttctcaggtttgtaactgctatactttattttcctttactcttactgtttcactgaacttcccagtttgaacttttgttctctttagtggcgacaaagttcagtagaacacaaactgctatctgatagtgtttagcatttttgttcagtgctatttctcttctgcactggtacatgaaattctctatgctaatcttgcttttttttttgttgctttggatcctggaaacgtttgcttgatttcacatattatggtcaagcaattgcatatttgcatgtctggttcatgtaataatattgatagatatccttttagacccttgtaagttgtaagttatagtttcatgctgatatggaatgacctaattgtactgtctgctagtttcggtacatcatcttatgtaacttgataataactgagtttgtgttaatattcccaggctgaaaataggattgtggccatgacttcaagccgttctgactggtgtatttcgcggcagagaacttggggggttcctattccggtcttctatcatgtagactcgaatgaacctcttataactgaagaaactattgaacacatcaagggtatgtctacgcttgtgatttttactggttgaaaccatcgagtacttgaacattactgtggctcaccttctgccaaacaagcatgtagttctaacgtcggtagtatctagttcttgtcacattatgggtttgcagcatggttgtatccgagctatttaagcaatataaaattcttgtttctaataaaaagaataaaaagtgaattagaatgagatgccatcttttaaagttgtcgcatctaagtgtgttctctgatttgtatttccacaatgaggttttagaaaatttctgttctaggaaaaagcctgaagttattgtatccaataagtgatccttttagataatggaagctttattacgactcagtcaattacaccaagatggtacaatccaactgagcccacccccggcctctgcattgaatgcacacagccaaaaaagaaccataaaaaaccccatcccaagcacaggagtgtgaaggaaacataaaattagtggttatcaatccgtagactagactgccacccgtgctcctgggtaaaaaactcctgcgccacctggtccaaacgtcgtgataccatttgtcatgaagctgttaaccatttatgtttgcacttttctgaattagcataggataagccttatgcttgacaatgcttcccaggaatttaatttcattggcccagttatctctttattttgtgtgtgcataatagaatttctgggttattttcctctgcttggattttagaatcccaaaacatatgttaataaatatagtttgcttgttactcaggtatagtgtcaaagaaagggagtgatgcctggtggtatatgacaattgaggaacttcttcctgaaaaatatcgtgataaagcatctgagtatcgcaagggaactgatacaatggacgtttggtttgactctggtaggattatgttttcattcttcctctattaatggttttgttaacaaagctcaatgtttgatgctggtcacaatgcccaaaatcaatgttcttaggagaattccatcttgtcttgctctgctctccctctttgaaccttggcagttttcagatgtttgtagttttaactgctttaaccttcaaattgaaccaaactgcccaagccatgtgctataattctctcttttttatactgtggtagtgtaccgtttgctttgattttggccatacgtatgtcacagtgtggcgccgcttaggaaattaactatttttaaggtgtagcaatagacacttttagtagggataagattaaactctaaaacatcaaatgaaaaagactggaggtaattacttgttattgagtcgtcatgcattgtatagtttgccatatagtttttgtttacagacctcaacttttatttattgactctattaagggctcaaggcgtgcatattgtcatgattttctgggcgaagatagagctttgcatagtgtcacaatgttctaggaaaagatagagctttgctatagtgttttcttaattattttgccatcttttcttgtgtccttgactttttacttctgcatattttcctaatttaggctcctcatgggctgctgttttggcacaaagagatggccttaattttccagcggatatataccttgaaggttcagaccaacaccgtggatggtttcagagctcattgttaaccagcattgctactacaggtaattgtgggctagaaactcgaatgaaaatcccttttttgaaaaagcaagttgttttgcaacattaattgcccaaatcatggttcatccatgatgttatttattctagatatataagatgttttttgagccatattcggtttagtgtctgacatttcaaccactagttgtgcaaatggtgaaaatttttctgtaggcaaaggcaatagaacaatattgcttgatatagttgcataatctgaaaccacatgtgtgttttctcttgatatatttggaacattatattctgctggtggacacaataggttttctatttataatttttccattaaaaaacaggaaaggctccatattctagtgttataacccatggttttgtactggacgaaaagggtttcaagatgagcaaatctcttggtaatgtggttgatcctgagaaagtaattgttggtggtaaaaattcaaaggtacgttcctagaaaagcttccgttctttctggacttctagttttgcctaatgaaatatcaatcaaccttttgtagcaagaacctggctatggagcagacgttcttcggctatgggtttctagtgttgattacactggagatgtgttggttggtccacaaattttgcgccaaatgtctgacatgtaccgaaagctacgaggcacaatgcgattcctattgtcgaatctccatgattggaaagtatgttcagttcaacaactaaaatttatttaggttttggataaggaagattcagtaccaggcagcagaggccattttatatgttttcaatatttcaaacccatatcaaaatgccatcttttactagttttacattttgcttaactttctattggctttattctttcctttatcgatgcaaagcactgaagctatttctgtttagataacatattgcagtgaatttaatattttatacagcctagttgaatacttttgctgcacataattttaatctcttaattatctatctgttttcccttcttatgttttgtttgcacattcgtttcaatgatcatttattgctctttattcttatcatccttttctctctttcctgtcaatagccagaaaattctgtgcgctacagtgatctaccgaaaattgacaagtatgcacttttccaactggaaaatgttgtgacttccatgaaggatagctacgagaactaccaattctataaaatataccaggtgggttaagagtttgttgtgcttcattactttcattttacaatgtgtgtgatctcttctatactttttgagattgtgtgatcgtagttggtgtatgttggtcaatggtcatctttctgagaaatgggaagtgcgcttcatgattatgatttagtgaataagagtttgatggtcaaaagtgaaaacttttagcttgaaagtggaatgttcattttctaattactgtccttttctgttctccattctggatcttgaatgatatgtttattggattctcaaatcacatgcacattgaatgattatatcatgccatttatatgctcagaatggtatgatatgcatacattattaaaagcaaatcctattgctaaatctctatccatgattggcaaagagctgcattatcatcatctctagataacggcatgcctgctgcatcatttgtttgtcctcttcacacttttgtaacaagagattattgacttgtgtttctatttcagatcctccaaagatttgctattgttgatctctccaatttctatttggatgttgcaaaggatcgactctatgttgggtatggctttgatatcttgttcattggccatctgattacgtttcgttacactgaaagctcagtcaatgtcatttattaatttagcttgccagcttcacaactttgtttttatcttcttatcagtggccgagttagctttacaaggaaaagctgtcagacagtcctcagtgcgcatctgctctatcttgttagagccattgcccccattatgccacatctagctgaggatgtatggcagaacctaccgtttcaacacacactggatgatggatctgttgctgagtttgtttttaatctaaaatggccagttaagaatgaagaatggctctcggttccaaaggatgatgttgattttctgagtgttatcctcgaggtatgcactgtttctgcataactttgaagcgttcacttatgacaacctcataggttatatagctttgcagtttttttcctataggtcgaatatcaaacttacgttaaaaaataaaactctgccttcaacttggagacgtgcaactcagacaagatttcttgtatacacgagtaactactacttatgatctgaaatagcatcatttctgctaaattacctgatcctatagtttataggacattgcggctattcttgatttcatggtgatgagcgaacttgcatttatgatttcgtattaagattaatttcatgattaaaaaattccattacttggcaacagttgagatcagaggtgaacaaaattttggagagtgctcgaacaggaaagctgataggctctagcttagaggcaaaagtttatctccacgcggaaaatgctaacacagtgtccaaactaaaggagctggtttcggcaaccaatgacgctgatgctctgcaccgcctgtttatcacatctgaggtaaattcaaaactagaggctgcccttctgcattcaagttttttttttacaccatctttctttgtttctgcaggtggagatccttccttccgtaagctccgaaactacatctggtgtatcctacactggaacttttagcagtgagcgcaccggcaacatctggattggtgtgactcgcgccgatggcgaaaaatgtgagaggtgctggaattatacccgagacgttggatctttccttgaccatcctactctttgtgcccggtgccacggtgtcattgatctgccaccagttcctgctgccgcggctgtcagctgaggctgctcgagagtgacaaggaccactatcagcttcatttgaagattataggtggaattaattgtttttgttctacaattttgttcccctctgaccgatgatgctagaggaaggggaaacttgaagagggtttcggaaacttagtttctaacttcatttgttgcgtacaataagttgtaccttgatttttgaccattgcttggcttcctggagctgtaattgtatatttgtattgcagaactcacacggattaaagatggaaacagttttgcacacgaactcgcatctccttacttgacgtaatgtcagagcgctagcaaacgaaggggcatttttatacaaaaatcaggaaccaaacgaacgagacggtccgaaattccgaatcacgttaccaaatactactcctagcgacccaaacgagagttttgtttctctacagaacgtatcggctcctgtattgggcttagctacaaagttataatgaagatgacgagtttatgaaggctgtatacgataggcttgagacaataattatgtaactttttatcaattatggttggagattcacaaatagatttcaataatgtgttcttcttatcttagatgagttattttttattttaaatgcttgttctcaatgatttattgaactacactcttttttgagtgtaactttgtaataaattggaaaggctgggatattctattcctctataaaaaacgagttttgtttggtaaaagtcaatcggaggggataacgcagggtgcgagaattatggccgttggatctttagatctccaagtctaggccattccccctctcgtggccggtcgccggagatccatcacccgccgtcgcccgctctccccggcgatcctccccgagccgcgcgctcgcttcccccgttgtcaccaacctccacgcaggatccgcaccgccgcttcttctctgcccccaaccgcccaatcccctatccctcgcgagactttgcacgcttaagccttaagcttctactaccatttggatccggagaccgggagaagttggagggcacggactccggaggcgtcacccgcgggaggtcccctctgcaccggccggctgcgggcgcggctctgatggcgcacgagcgtggcggcgccgcgtcgtccgccgcggctcccgccaccgaggaggatgcgctgtgagtctgtgttgcccaaatccctaggtccgtgtattcctagtagacgtttcagtcacgcttctggtgtcacttgatctgaaggccgtggcgattgcagcgaaattcagggtccttctcttgttagtgtcgtgatgcgttcagtgtagtcgaaaatttggtggttcacttgggctctggcattgcgatgtagtactaaattttgggcgtatgcagggaattgagactttgagagaagggaagagaagagcacaggtgatgtttgcttgtggtatccctccagttggtattaattcataaaattggccgtgtacatccaaaccggatgtagaggccaggttttaatccatcttctagtagaaaatttaattcataaaatgaggagtataagcaagggtgacatggtgtccattaaggcattaatacagggtcacttagttgagctgacttagcattcacatgattcttctatgacattgttctaatgttgatttgtctcgatgccttcaggatgtataattcttctttcatgtaggtttattgacttgctacatgaagctcctctctctggtcatcgagagcctagaagcattgttggtggcaccttgtactgtatcttgttggttagtgcaaatttcttaattacccattgtttttatttgtgattatgcctgaaaattatttcaaatgtatgagttcatttgataaattatctacaacagctaaaacatatgtatctctttctatcgctaaacgccattgccttatggtactgtcattacccaacaagtccttgttttgcttcctttgtccattttgtaatagctgtattttatttctctctctaggcaggttatgctgctgtggcagtgtcagccccatggatattttaccttgtaccagacatgatccccccattgctatgcagctccaatgttatcattctgattctaacaggttctctttgagatcagatgtggcatgtttctgttgctgttttctgtttgctactctatttagttattttgttggttcatgttttatcacttactatgacttatggtttgcatggaacataacataggtatttttcaacaatattgggttcaccaggtcagaaaagtgagattgcaggtatttaaatgaaacaactgccttttgttttacttcaattggactctgttaacaccaaaatttgatacaattctttagtggactcttactttaaactttgcatattaactagcacatttctgctttggatgcaggggtattacgattttagtgagaaattgaagcgccttgctcaacttccatttgccaccgttgctagtggtaagtatagcaccaaataaatttgcccgatgctgtaatactagtgcgttcttcattttttttaatgtttataacaagtatgtcctacttaactgcacttgtttcaacatgattaaactattgtctttggtatttatttaaggatctgttaaggaattgagattttgagaggttcatatgtaaaatatttttttggcattgaaatgacccattgtccatattctttttgttcttttggcaggcgttgcttcaatgctcttaatcatagtctggcaacctctagtacacatactatcggtttctttattgctaaggtacacctttgtaattgcagctaacctctgcaaatttctctgttatgtcttgaacggaagttgaggtttatccggcatcttttggcatgaggtttggtctgcggattcccaaacaagtttgggaacatgaattattctcttctcatcctttcagtgcatgtataatttctttcatttactattatgcaggattgctattgtggttgaagctatatgtgctggatgtttcatgagcttatacttatgtgagtcaagtactcaagtcatttgtgtccttgttagatagttcatcttgacttctacaattgcagcagttatgcttcccccaagcagatcctcagccatgcaggacaaaccttgcatgctggagggttcaaagccttgtcatcatgagtttcgatctcgtcattctttttttttttttgctcccactaagaacagtgttgcttttccttagaaatgaaagtttcaagcccgattatttgttttttctaagatataatgcccactcggttctttttacagggcatatccacaagtacaactctctgaatgggcaccctgatattttgcggtccttatattctgcactccaactccaaccatctagttctttggaagaacgaaggtacaacataagggtgtacattaaatgcattgaacttttccttcttaatttacaataaaatactacctccgttttttaatagatgacgccgttgactttttctcacatgtttgaccattcgtcttattcaaaaaaattacgtaattataatttattttgttatgagttgttttatcactcatagtactttaagtgtgatttatatcttatacatttgcataaaatttctgaataagacgaatggtcaaacatgtgagaaaaagtcaacggcgtcatctattaaaaaatggagggagtagtgtttgaagacacgtataaacatgtactatgcacagtttctaccacttcaggcttggcgtttgattttctggcagtttggaaaagcattctttagtccatgtttatcagaaacatctgtattgaacctatatctagaaggatgtgccttcacatgagttacaagtgttgatatgttgccgaatatgtcatatgtgtacttggcatactgccagtagagtttcacaagttatttttcttttcaccaggtattatgatggtcgtttttctgaccagcaaatggctctgcttcagtaccaaagggagaatattcattacctgagtgaggaggtacttggaagatcaatgcagtatatccattttaaaatttgattatgttagattgtgttattatttaaatatttgtacaagacaacagtagattactagcattactatttcatggaggaattagctgatccttgtatttagttctacattaacttaattggccagttctgtagtcagtgctgaagttctcaataataatatgttggaacttccagaaaatttcttgttgaataaccaaaccttttattttcctgaaaggtgctccgcttgcaagaatgcttaagcaaataccagagaactgatgttgggagcactcctcaggtctgcacaacactgattgattgtgttgcattaattaactgaccagcttcgtaggtgcaaaattagagaaaggaactttgtagctattatgtttatgtgaattgatggacttgcatcaacccccttttaattctacaggccgatcttgctcatctattagcatcgcgtgatcaagaacttagagcactctccgctgaggtaattaaacctatattgtaatgctataatgcctctgatcacaaaacataattaacttgcctgcttacactccagtccttgttattttgaccgcgttgttatcttaagccaagcaattttctatattctggccaggcaggtctccaaaatctcacctgtctttggcctactttttatgaactcttgcaaaagctattactatagatgtttatagcacgataatttcttaaaattatattatagctcaactttgtagctgtaaatgataagttgagaaccatctatttgagttgttcatctttagcaccataactaaaggtgtaaagtctttattaaaattttcatcttctactaataccatactaattgaattcacagatgaatcaagtgcattcagagcttcaacttgcacgtagtctgattgatgaaaaggactcagagatccagcgcattcgtgtgagcaataatcaggtattttcacaagtaaccatcaagaggtttagcttagcacgtggatcatgcttattttacttatatcgtcttccaaactgttcctgcttgattacaaacatgttggatgcagtatattgaagaaaatgatagactcagagccattcttggagaatggagcgctcgagcagcaaaggtacactggctaaagttctgttgtgggttgagttgtactagcattatctctcattgttttgcatgtgttcaacagcttgaaagagcactggaggcagagcaaatatcgagcattgaattacggaagaacattgcaaaactccgagggcagacttacaaggatcaaaacacctgatctcccttgttttcaggatatattcacctatggcgatgtttgagcaggtttatcaactcttcagctgctaaaggtgccacctgtgatatccttgaattccaaacctctagtgataagaagagtgccaacacagtccagtttcgctaacaacaaagcaaggtacaagatcatcactcaatctgatatgcatcaaggaaaggaaaaatgcctttgctacacctctctcgtgaatgtacagattgatgtttgtaaatgttgttcgagagtatggtgcagcactggttttttgtgcttctacctgatgcttctacaatgacatcttatcatggcaagagttgtgcattgttttctgagcacttgcgaaatgaaaagtgagcatttgtgcctaagctcccccaaaaaggtatatcagacttctaatttcttctgagttgagagtatcaaatctgtactgcagtctgagatgctttgctaccctttgattcagtttgctttgctatcttagattcagttggctagttctttttcacagtttagtagctttatattacatatgtcttgggcaatgaagctcatgaccaacaaccaatgtgcaaaagcgttcttctccctccttttccttttggacaactggtagagggagaaagttaacaccgacaagtcaatacagaaccaaggaatgttcctgagaataattttgctaaaattctacctcgagttgtcccattctttattaatctacttgcaaattgtaaggtggaattccacatgtcgttaggacgttaggccggtaggcccccatccttgactattgttgacactgctatgcttgatgctgtcttctttaatctctagaaagaaacttgtggggcctttggttgttgaaaatgcaacaacaaacgaccctgaacaaccaggtgcttcaaatgaatagggacatttgagcaaatatcacatacttcgtgcacgagtccaatttgttataattttcaccatacaaaattttgtagttctgcatctgaacaacttctgaagttgcctcaagcaataagcaatttgctgcgtctgaaatacggcaagcactgattattgaaggattactgaagcgcctttttcaaactcacggtaggattgacctcatctggaccgtccgatcgagatccagcggctatattcctcccaaaaaaataaaaataaaaaacgcgccgggttccaaccgtacgagccacgaatcctctctttcccggccaccttcctctcgcgttccactgcatccttcctttccttcctcgaatcgaatcgaagctccgcctgctccgcttcgcttcgccgacgactccggccgccaccgcaaccgcacgcggcggcagccttaccggatcctccacccccacccgaacccgcgaacccgcgtgcccgtgcttcacgcgcattaaagcggcagcaaggccacctcctcgcacctcgctcaccgcacggcacacgcgcccgggggatttggaaattggaaatttcagatcccagatctcgtctcgccgatctcgccctccgctaaggtacggatcccccgcgatcgctgcttgcaagttcagaaatgttgcggccgcggctgctcagcgccggatctgttgtgttttcctgtggtttttaggtgtttgggattttttttcattttgttgtgcaatgtatggagtgtgagattacttgtggaaactgattagtgcaatgattttgcagccatgggttcggttgtggatgctccaacagttgtggctggacaggaggtacgcataatgctattggtgtactaatttagtaataattttccctactgtttattggttgagcttaatgaactgctagatagtttcctatattatttgagtatgtttttagaacacaactgttatctgagaatgtgcaacatgttttccttgaggcatcagagattataaattagatttcctgatcctttggctgtgagtttcgctacagtcaagggctggagcttgaaatcttgcttcctttctgtttataaatttaaaaaccatttatttaggctagaatatgtcgatgtatttctgttgtgtatgattcatttaatcttcatgtatactattataccaatataaattttgactccttgagtcacaacgtaagctcatttatttgtttattcagttcatatccttgcctcatactgtactataatttatgccatccatagcttgtcttatgggtgaaatctgcccctcatgcaggaggtcactgacaacatgttgggtgacaagaaagttacagttgtatttgttctaggtaactgcttaccttctactttatgtttgattataatgtaagtctcatatgagaggaaacgaacttataggaaactttagatatgcaatgaattgacatgataaaatttaagtacttacatagttatatattatatataaataaagagatatattatcttctgtttctaaccaaaaatttacacaggtggtcctgggagtggaaagggcacacagtgtgccaacattgttgaacactttggattcattcatcttagtgctggagaccttttgcgtgcagagatcaaatctggctctgagaacgggtatcttattttcattccataagaaacccaactgtttccttttgtttggaacaagcttttccaaaattcaatttggttatgtttcctcctttgttcaatttctgtctgttactactaaatatttattgttacacttccatgttttatagaactatgatcgagaacatgataaaggagggaaagattgttccatctgaggtaactataaaactcttgcaggaagccatgattaaaagtggaaatgataagttccttattgatggatttccaaggaacgaagagaatcgtgctgcatttgagaacgttgtaagcacatcttctccttgtacttcaaaattttagatcacttcactcttgggtagcaaacagtcatgactccttagtagaacgttcttcaggggccactcgcagcctgtgtacacacacacacaatgacaatgcactaatagcattaatgtgtcaaatgtttcagacaaaaataactcctgcgtttgtgctattcttcgattgttctgaggaagagatggaaagacgtcttttgggacgcaatcaggttttcctcatcacttaagtgtattctccattccattttaaaccttaccaccttatcgccacatgaataacctgttttctgcttccaactttttcttttgcagggaagagttgacgataacattgagactatcaggaaaaggttcaaagtttttgttgaatccagtttgcctgtcattgagtactataatgcaaaggacaaggttaaaaaggtactattgctctttgaatgatgcaaaaacaacaaaaaggatggatagcaataggtattagatgctatacattcgaagtggaagtagtaggagtataataatatgaaagactattctaccatgatattaaagtttcccatgatcattatgagtttctgaccacgattttctttgcacacttacatgaattactgcctacttattttctaatgacttttgacacctattgtaaaacttgttatcttatcagattgatgctgcaaaaccaattcctgaggtgtttgaagatgtcaaagccattttcgctccatatgcgccaaatgtatgtttccacttttctggtttgttatgttccttttgcgtgtatcacataatcattgcctattttcattttgcacctcacattatgatcttatctatcaggccgcttagagcaatagaaaggaccacatgagtgataaattgcaccaactttagaaaaggtactctctctgtcccataatataagaagttttagagttggacacggttatcaagaaagtaggtagaagtgagtggtggagggttatgattggacgagtagtagagataggtgggaaaagtgaatggtggaggcttgtgattggttaggaagagtatgttggtgtagaagttgttatattttgggacaaatcctaagagctaaaagttattatattttgggatggagggagtacatcttctttctctgcacctctatgccggttagcatatctgatcataatatgcaaaatgaaataatgataaacacaaaccatgccaattaattcctagtatgttgattcttttccttttgtttttggtcaaagcaatcttatgtgaattgcttgcatttagtcaaatgataatacttagaaccacaggtgctaaaacgagcccctgctatgccagtttttctgttggcaatgaacaagctcttctgctatgccatttctgaaccacattcaatcttcccctgttctgttattacttacaccatgtaatatatctgttgcaggctttgctctcaggtgtgactacaaatctgtgattacgaaaccgttgatatagaagagagttttggctcatatgagctacctgcatacccgtaggcaatttgatttgttacttgcaataattaattttgatccccatttcctgctagattaacttttacgagagttggcgtatcgtatgtaatgctgtacttgtaccaatgtatcatttacctcatggacgatgaaactttgtcctcccgccagtttctggtggtataatacagaaagtggaacttccgaatttttttttggttagtttctaaaacaatgttcactgaacagctaataattattcaatttgttattgacaagcctttgcagactgtgttaacttgattgcacattgtaatatgatagtatccatatttccttgtttcatctctttgcagtattgaccagatttttgtttgtttggtcagcttaatgagtgtaagcaccagagtcaagattatttctgttcggtgtatgttatgtaactattctctcgttttctctctttttaaaatctgaggtcaacgttgatccggtcgagaaatcaacttctttttttcacctcataaacagttgcagcatgtccataagaaaatgactcctttttttgtcctcatttcaccttcccgctatttgcagtttttttggccaggttcaatgaatatagttatttgctatgagacaaagcagaggatgccatgccatcaggcttctacctcttggggcccttttcagtgatttggaacctgcaagcttgattgatggttaccccatgcagagggaagagagcaagtgaacaaacaatgacaagcactacaaggcaaatgcaaaatatgtgtattctttttttaaaaagaatatcctagcgacaacagtttcatgtccagggacagggaagaacaaagcaaagaagcgtccccggttcatccctttctttttctcttgcctttttcgtctggggcctggaagcgtcacaattataggcttcaacgagatagttaggcatgtggcattgcaagatggttggcaagtaatccatgtgagcggcaacgaaccacgcgctgtcatgctcacattcacgcaactagccaggatagcattaccagctggagtagcaggttgcaggtagcagttggcaggcaccagcgccggcacaccggccatcctgattccgccggcttccgccctttccaccgccatcctctcgccggccggcctaccgccaagaaagtcatggccatggaggagcttttgccttttagcagctgttcttgtaagtttgtagtttctttaaacaattcagattctaagaatctatatagtcctacgtagaatatagaacatgaactataactcataattttataccagctagtatcaccggttatttctaagaatctcctgctctcttaaacaggattgagacgccgagctatccggtttcactatggctgtgtttagatccaaagtttggatccaaacttcaatccttttctattacatcaacctgtcatacatacaaccaacttttcagttacatcatctccaatttcaaccaaaatccaaactttacgctgaactaaacacagcctatgtaagttcacatgatttttggtttttgaaataaaatcacatgatcagaaggttgctatggtccccagtttacatccagtggtcacatactcacattgtacccctactgtatgttgggcgacttcaggataggatccgttccgttgatcgaatcatggatcaccccccccccccccccccccacaacacaagcccgtgcaatgcatgccaccaaatacgaagagacacaattagtacagttctagatttgccagacaagggccctttcagcatcttgttcctaatctccgcgtcagacatacacattctgttattcttatatcttaatcagacagggcgcagatgggattgcatcatttcgattagttaatttgcaacgattacgactcaggcactactgttgactacagttggttaattttgttgaaaaataataataatttggctggctgttaacactgttttatcgtccttcatgttgggcttgactgaaaacgtgaaacatgatggttttaactggtgtatgctaaaaaataaaaaagcagatgggccgtacagagaaaaacagagcgggaatgaagaaaatttcagagttcggcggccggccgtgcgctcgcgtcaacacgttgtactggccgttgattctgcagattccgcgaatcgtgcggatgctcgccggcgcaacccacctccgccggaatctgcagcatcaacggccagtagcgctccacgtccgaccaaaagcagcatattccacggttcccccgggtcgagatgcccagctggtaggcctattttcttgacaaatttgaattttctggagcacgtcattgtcaagtctcatggacacacaggacatttgaaaaatactaccacaacataactaaatttataaaagaaaatcatattttttgatatactattcttgttgacacaagctcattttttaactttggatgaaaaataaaaagcgtctaaaattgcgtagtaataaccttttcgtcgacgaggcataaatcggctgcacgtgttgctcgccttcgcacgggcggaagcggaaggagacccgcgccgtgtttagttgggggagagaaggagagagagagagggcgagtaaatacggaaacgaagccgcttgctttcggtttcctcctcccccatttccttggattttgcgaggtttcctcttcctccacgctctcgaatccgagcagagaagaagcaccagccggggaaggcacgggaaccctaggttggctgcgccgccgcacgcacgcacccgctccctttcgtgctgctgctgctgctgttgttgccgccgcctgcatcgtccccgatccgccggccagccagctagctagcgagggaggccaggtgaggcgctctcggcgttcgttgcgcgtgtggtgaagtcttcgggtggtggggatcgcgaatgcgggtgggtttgggggaatttctgtgagggtggtggggatgggtttgggggaatttgggtgctgcattgggggttggtttggtgctctgcgtgaatctggtggggatagtgagatcgtggtttgttttggtgctaattcgggagttccgggtcgagtttttaggtgattttctgagctgggggtgaggctttgatgatgggaaataaaagtataagcaactagtgtgttcgatcgctacttttgttggcaatattgagatcataccatgtttctctctctctttttgtgtgtgtgagtttcagtttgtgaacgcctgctaaggagaaaaaaggacttcagagttctcacggttgttttcagatgattatttatcgtgtcactatatgaactaatgtaaatagcttagggagtagaaatcagaatttatgtaaaaactgtttttagcaacacatcctagcagacaagttggagattgacttttacatatttgtcttagtagcaaacgtctccaggagtaaaaatcgatgcaaaatcattattgagtaatttattagtactgtcttcttattcggttactttgttctattggcaggttatactgggctttcctcctgataaactcgttctaaagacattcggtgttgccatagttttccaagtgaactcactatgaaaccggactggtcaattttctccaagtttgaccacaatggagggtacctgcataaattcccaatagattctccaatatctcatgatattggattaggattgatatcacattttggaaccttagtcgagagttcctttcagcatccaaggcatatatgttctacagggaatggagcagttcaggaagcattcagttgcttcaacaagtttgctggtgctttctatttctggctttctagagcatcaaatcccaagattttccacaggttgtcagctattgcaggctcaagttcaagagcctgccagtcgcaaataaagcaagtgacttcttgcatgcagcatttggccggattgcgttttggttctcaagttagagaagagcacgctatacaaattcttttagcaaagcttgctaatgcaacatttgggcgactgtggaacgaggtggaggagcgccatgcctgtaacattcttatgttagctgctgctactgtaccaccatttgaaaacatgtaggttcttctatttatattgtttttgtacttccaatgcctgttccatttggctaattcctgtattttggttttcattctatgtgtactttatcgactgctcatttcttgcatggacaagatcgccgaagatgcttgcagactcaatgacattgggaagagataatggtcgtaccagagaacctgttgatcagcattctttggaggaaaaccattcaggctgtacttgtgttgctgtgccaagaataattttaccagaagacgcaactgaaccaaaaactgggataaagttccctactcttctcgaggataattcaaatccaacttcagaggtatttttcaatcttgtatataattgatctgttctttttttttccttattcatgaatgctgataaatagcttcttgacattgtgttagcaacttagtatttcgaaaataataccacaatgttttattccaaatccataatgttgcttgatcttgacccccttaggcccttaacgagttcaactaacggttaaatttacaggtgctcgtcgggatgggctttagaagcatgcgaataatgagggtcaaaaacctgaatctctatgcctttggattatgtgagtataataaaatgtcatgtttaatattattacttatgaaccttttagcataccacataaacgatgtttctttaggttactaatgttgtattcttgtagatatacaaccagattctatttgcaaaaggctgagcccaaagtatgcttctgttccagtttctgaactgaaggaccacccagatttctatgaagatcttttgaggtgtgcatgctctattcatcttttatgcagatctttcccaggttctggcacttaacacatactatgcagtacttgtgtaacgccaggtgttcatttagtaatttggcagaaattatatggatcattaaaagtattggctgttttatgctagaggttaatgggactattccaaacctgcaatcatttgatgtgcttttgaggacttcatttgagtagttttttgtattctgcataagaaacaagaggaatcttaatttttgccccatctgcattcctttcgctctgatctaacaggtttgtgttgtacctgtcatgttgtacagggaaaatattcatatgacagtcaggctgatagttagctacaatggtcttagcattggcacagtgcgggagtatgtattttagttttcttgtgctaatatcagcacattcttatctttagctgtagttcagaagatacaatctctcaatatgcaagctaatcattttctttaacactcttttcagtgcatttgagaagtccctttgcttccgattgcagaaggtacttgttaattcggcagctaaaaatattcttggctaattatataggtctaaaataatttctctgtaccatttcaaaccagatgaatcctaatactgattatcattgcttgaagacgtttggttcttattttagtgaagatatttgtatacctgcggtaagttccaatattacgtctggcctaacttggtacttctcatcataagatactgaagtcaatatgactgcagggtacaaagatcgacttccggcaaacctctgatggccagctcataactgaaagttagtatcgtatgcctgattggttctgcatggttagaatttttacacctgacaaaaatgttgacatggaacgtctttgtgcagttgatggcaaacaaattggtgctgtccagagcaaagatctttgcagtaagtatatatattcgttctttctaacttccagaaaaaaaaaaagacagaattactgttatctgtcattatttatttggcaaattccttatgctgtctttatgaacaggggctttcttcgatatgtatattggtgatccacctgtttcagtcgagaccaaacaagacattgcacagaatgttggtggactcattagaagatgttattgaaaggcataattaaacgacagactggtcggaattatttcattcttcgatacaaggatactagggtgagggggaagcatatacaaagacaggactaggaggagaggatgaactgtatgtatagtgatagatcaacctgtaaactaaacagagccttagcatctttctccggagcaattgcctccatgctttt

SEQ ID NO: 72638 - DNA, 1473 bp, Oryza sativa
aaatccaaacaagccataacaaggttgttgtacagcagctcattctggtattcttgaggtatgcgaaggaagaggctttcagcttcagaaatgccatgaactttagctgtgaactccaggagatatgagtaatctagctcactaagcttgtagggcctctctctcatgatccattccatgacctgtggcaataaaaaaacaggagatgcactttcacttcctgaacagcgaagccatggtaaaagaaaaactttagaatctacaagtaatcaacatccattcatcgtgttatattaaatgaagagaagcttgatttcaccatgattaggtaagcaataatccaatcaaaaagtacaaacagaacatattaccagtcaattactcgatgtcaatttcgttcatctctaaatctttatacagacaagcacaaaatatgcaacaagaatgtaggtttatctatctatcaccttcattcagaataacacagatcacaaatctctctaaaaaaacagatcacaattgacacagatgaaatgcagcttcgatagttgatgccaatctcaagcaaagcacagattgcggagacaacggcggcgaagataaatctttgatgggatatatctcagttctcggcctaactcacatcaatcacgaagcgagccgctcatatgggagatttcattggatccgagccaagaacggggactgcgacaagaggtggaagagacgagagagagacctggagggcggcgcggtggaggcggcggcggcggaggcggtgacggcgtggaagacgtgcccgcggtgcacggcgcggccgtcgcccatccacccccggatggcggcgcacaccgacgccgaccgctccacccgctgcgccagcgacccctcccgctccgcctcgtctgccgcaggacggggaggaggaggagggagagctatacgggcgcctcctgagctcgcaaagaaggttgcaacggcgaccgcgaccgcggcggaggggatcggcggccgccgccggcggagcagcgcgcgcagcatggtttggttgcggtgcggcaattcgtcgagcagctgccgttgttctggtgcgcgtcggctcgcccagcgcgctctgtagccgtcggatcgggaatcaacgcgccgaatggcgtcctaccattgaagtcgtcagatcttgttgggcttgctgttttgtgcgtcggaataagttcactgaaggtccctcaacttaacagcgagattttttaaggtgccttaaccacaaaaccagaaatcttcaccactaaactatacaaaaccgtctaatttaggtcccaaggcagtatagatgcatgttttgctgacgtggcatcctagtcagcaaaaataataaaataaatatgtggggcccacatgttattgagagaaaatgatgtgggccccgcatccatttttttcttttatttttctcttctcttctcaacttctcac

SEQ ID NO: 72639 - DNA, 1159 bp, Oryza sativa
agttacaattttgcaataatggtctggcaatgagttttattctcttgataagagatttggctaaaccattctgagtgtgaacatacggtacggaatgttggacttcaattcctaaagccatacaataatcattgaaagctttggaagaaaattctgcagcgttgtctaatttgattgattttatatggtgttcaggttgatttgctctaagtctgatgacttgtgcaatcaattttgcaaaggcatggttccgtgtcgataagagacacacatgggaccatcttgtggatgcgtctattagaaccatgaaatacctgaatggtccagacaatggttgaatagggccacaaatgtctccttgaatgcgttcaagaaactttagtggctcagcctttattttgagatatgagggtctcaaaattaatttccccgttgcacatgaggtgcacacaaaatctgatgattttgggaattttctgtcgctcataccatgtccatgtgaattgctcatgatttttctcatcatgccgatgccgggatggccaaggcgatcatgccaagttttaaatgcatccacattgtgaaaaatcactttatatgcaacatgtggtacaagtttgatgtatgtgtagtacaatccagacgggagagaaggcaccttttcaattgtttgtttgccatatccagtatctttggtcaagaggagaaactcctcattgttttcttcatatgtttccacatgaattccattattccggatatctctataacttagtagggtacgtgttgaatcgggatacaataatgcctcctcgatatttatttgtgtacccattggaagtatgatagtggcccttccggaaccgacaatcatagcatcgcgtcccgcgatggtcaaaacttgtccttccctcttagtgagagtttggaaaattttgacttccctaagtatagtgttagtggtacaactgtccactaggcacatctcttcttccatcggattgattcccgtaataatctatataatgcgaaacttaaattcataagaataaaagaaaaatatagaaaacacacataaatatatgtgattattacgtgtataaatggggtagcaacatcatgtcttttattacaatggttactcatgcaaaattaaaca

SEQ ID NO: 72640 - DNA, 2001 bp, Oryza sativa
aagcagtttgactttgaccaaagtcaaaacatcttataacgtgaaacggaaggaatattaattgatatatccaatcaaattgaaacttcatttattatgcatatatcaaggccttatatgcagagtacatttgtatacacacaagcttcaaatttcaagatcctaggctagaatatgatgatgtcatatatcaagtttatgaccaaaagttgcatacatcatcagatatcttacaatcttcttctactccatgtccgtgcattgggcgaatcaatcttgtctagtactaaaaatatagtgttcgatgtcaaaaaaagacatcctcctagtgtagcaagccagagtgtgcgtgaactttgggagcataaaaatagggaggtcttatcccgattaatatagatgcagtagatatatccaatctcccaaagaactcttcgtatcaaatctgcatccggatcccccagtcgaggcatatccttggatggaagtaatgtctacctgaaagcaagtgggttttagggaaaattaacacagcactctataagttaatttcatacaagggaaaaatcagcactggaagatgccacaagtgtaggccaaaacaaatcattcaagccaatcaaaaagtttgcaagttaatttgcaacagtgatcaggatataaaaagaaattaaactttcccaagaaagaaattagaataaagtagtaacgcaaattagccatgccatgccacggtccaaaccccaatcgcaagcgttaaaccttcttcaacacatcattgcatcgtgagaaaccttggcagacaggtgtaatataaatatgtaaaatctaacacatgcctcatgaagcaatcaattacagaatactcttatcatacatctgaatttaaatttgctgtcgtcttcttgcttggtacacaacatacaaagtgtgcaattaaacccgacaaaaccggaccgaatcacatgaagactcacaaaccacagtgactactctgtctcctcagcttacaaggcatagctccttggctccacgaaatcgaactacaacttaattatgtggaaaccctaggtgctgaggaagtgcaagttcttagcctggctagtagtcaaaatagagtttggacatcggatcgactagctgctaggggacttaagagttttccaacacaaggcgctcacggttatcggcttcttcaaaggaagaagcgaggacctaggcacttgcagacaaggtgactactagaggttttactgaaaattatattaattcccttagtcttatttaagtagtccgtacctagggctgtaaatctctcttccttattcaatgaaataggcacatgctcgtgccaattcgttgaaacccaaaaaaaaaaggtactcagcgaacatctgatcagcttttgaatattgtttatccacccatttgaatatttgatgattgaacagggttaatcatacttggttcttgaatctcggctaatgtggctgacatcgcactatctacttgttgcagcaaaatagcatccatatctctttgtctatcacttaggaaattatgcaatactactacttcctccgtttcaaaatgtaagactttctagcattgtccacattcattaacatctatatgaatgtgggcaatgctagaaagtcttacattatgaaacggagggagtatgcgataaaaggacgttccaaggtccaagagctagtaaaataccctatattgatcttatatatgcctaatagcactgggagcagcacacaaattaaacctcatagtcataggtatggcactatactggtattgcacatcagataattcatttaagacaaatcgaaacaggcaaagtctaccaagaacacaaaagtggcttatactactcaaaatcttaatgaaagaaattgcaacataaaattcccaatattaaaattaagcccttgtcatcactagctagcttttttttttctttttcattaaaattaagcccaagat

SEQ ID NO: 72641 - DNA, 5299 bp, Oryza sativa
ttgtatattcccagctagcaattctgtgcgccatgccagaagcatcaaacctcggcaagcttggccttgagctccatgcaccgttcatccaagttggggaactcgtggatgatgggctgcaggagggcgagcttgtcgtccctgtagtagaggaagttgatgagggcgctgaggacttgcacgaggcggcgcgggtcggggcggaggaggtcgcggagcgtgaacccggggaactggatggactcgaggaaagcgctggccctcttgtggaggcggagtacccggatgccctccatgtagtgctccgggttgtcgagcgacgccagcgcgtcgaatcctagctgcccgtcgaggtcgtcggcgctgcaaaatctccacccaacaattacaaacaccgagcgggcggcgccggcgagaggggggagggggaggcgcgcgcacgcacccggtggggtcgacgacggtggcgaggaagttggagatgacggcggggaggagatccggctgcgggttggcgatgtcctccgcgcggaggttggcggtgggggcgaggccgtaggtgtgcagcgcctccgcgatctgctccggcgtcaacggagggaaggagaagttggacgccatcttcttcttcgccgccgccgctctctcgccgccgacgcctttcccccaaatgagaggaatttcgaaggcaaaaaaaaaaaaaagaagaaatgggaggtatttgcccggtttcccgcttcgttttcccgctttgcggaagcggaaaactcgggagcagatgcggcgcttggggagagttctgggcccaaagcccatactcgtgtctaatcttctcgataaaattcggcccagcccaagatgaggcagccagtttccactttccagcccgtgggcatcgcgtcgattggaccagcccaccgaagcaaaattttaggaaattttctggaattttcaggtaaggatgttcgaatctgtccattttagcctgtccacagtgctttgcttctttccacctgtcctgatataattaaaggctagaacattgactaaatggacaagcatgatgggtcctttttggaacaaaaatttccaagaacactttgtattataccccacctattataaagtgactttgtattatatccacctattacaaagtggagttgtcatgtcaacaagcccctgattcattttttgtacagaattacttaaatatattggtcacgtcataacaaagtaacaacagaaacatggaatttatgcagatatgagtacagatgggctgatggtgtacagataaagaagccgatagaagtgtcagcgccaaaatatgtggagttcctaatggactggattgaaggccaacttgatgatgaatctatatttccccaaaagcttggtaatcattgtttgtcacaaacatttgatgttggaatggtcatgtgtaccttagaaatagtgcaggcactactcatatatttgtccaattttgacacaactcatgacactgatatgggtttaattcctttaccaggcacaccattcccgccaaacttcaaggaggttgtaaagacaattttcaagcgcttgtttcgtgtttatgcccacatatatcactccagttttcagaagattgtcagcctcaaggaggaggcccatcttaacacgtgcttcaagcacttcattctgtttacaactgtaagtctcttttgtttgtagattgtaaactcattaccaggattgtttacatttatctcatatttgctcttggttcatagaaatctggggaaagcaaaattcatttgtttccggccttttggtatgtggtgcaggaatttggcctgattgacaagaaggagctggctccactccaggagctcatcgaatcgattattccatactgagaagaatacagggacggaacggatagcgagttctttacatggacgatcgaggaatcagactacttgaaacactgtattactggcatagtagaccttactgttccagatatcagacatagaaaaggacatttgacattgctaatgctatgtttgtgtgtaccgatgttcgttcgtcctgattcggtattgcctttgtacgcgtgcttgtaatgtaataacaggatttgtggattgggatatattgcaaagaaagatctgttaatccaatcgtgagttgcaattgttgcttccttttcccagtaccaacgattcaattgtgtgtgatttcttgtttgttatacacatcaatcaagattggggggaatgaaatgtttgggttaattttatcatggtttagagttggcactaatccaatcaaaatgtaataactgatacaatgaagacgccatagatcatactaactgggagaatggcatcagaatctgagatactatcttgcataccatacacagcccgcaacaatcgagataggggaatgaaatgtttggattaatttaccatgattttagagtttgtactaatccaatcaaaatgccatggttcataaacatcatagtctcatagatcataccgactgggagaagaacaacatcataaatttcagataataagaacacaagatggcaccgatcactgactcatcaggcagcggtttgaaatgaactgtcgatgcaagcaccacgaggcgtggcagatggaagcagaggagaagctgttcctacttaaaacacatacaagctactagaactttctggaagcggatcggtcgatcgggtgttggtgctagagctagacgcggccctcccagaggcacggctggtcgtcggagcagacggcgatgacggcgggcggcggggcgaggccgagcgcggcggcgcggcgccagcgctgggcgcgggtgaggccgaggcagggcccgtaccgcatgtccatgtcgaactcccgagccatcctctcccgcccctcctcctcctccgcctcctcgacgtgcctcctcgcgtcgtcgacggcgcgatctggcgtcgctgcaaaaaaaccgaacaatcgaatcagcggagacgcaatcgatcgaacagtttcgggggcgggagaaaccgggaggagaaaagcaccctgcgacgcgggcttgtggtggtggcggggcagcgccgccttcttggagacgccgccggtgggcttgacgccgccggcggcgtgggccttctgctgccggaagaaggacctgacgtcgccgccgctcctcatggctccggtggactcctctctcgatgatctctatggattgtcgcggcggcgcggcaaggtagggtggatttgggggaaggggaatggatgggaaggggaggggagagagggggagtttatatatggagaggtggtggtgagagggagttgcggccgttgtgacggcgattcgaattttgaaatttgaaaattgggcgtctcgtttcggggtgctaaatccaaccgtccatcccatccatgtcgtgtggaaggctggaaccgtgttcgtttgaacaggttcttggggtgcaaaacgtctgtgccaatgtgccatgaaaccgtgcgtgcattcacacgtagggataaaaaagggtcaggaaacacgctaaaccatttccctattcatattatttttcggaaacggaataaaaacggtaggccggaaacggagatatatcgaaaacataattatttacatgacggtataaattgaaagccgataattcatgtcagaggcaacgaactataacatcacacatttagatagcaatctagcatggttgcatgagacaaattcatcctcactctattcaacacaaatacgtacaaacatgtataatagattgataaatgataatatgatcaagtattcgacaatagttataacttcaatgacatataattgtaagtctataaagcatattaatacgaactaacggtgtgaggaactaccaactaggagcagctctatggtttagcgttatcacaacctcgtgggacactgggactggtatattcaggctaagggaatgggccattggagataacttgggccagagatatttataaaaaaggtaatttaccgaaatatgtaaatggtaattaccaaaaaaaatacaataaccgacaaaacggttggtaaatcaccaaccatttccgataccgtttctgtattttttacaattttcgtttctaggaattaccatttccgtattgtctgatcagtaaacttcagaaacgaccgtccggttggttggtaattactgctaccattttcatccctatttacacaaatagtagtatagtagatatatcatttgtttggttttcaaagatttctagaaaggttctactttttgatttttttttctttgcgaaacacaatgcaagcgcagacaattataaaaacacacacacacactttattttataatcacgtatgaagaccatgctattttccataacattaaactgaacctatgatataacttatattaacctccacgatagaagagaaaactccatctattgcaaagcgcattaccgcttagattgacctaaggaagtacaccttatgttccataaataaacagcttttgaggataaacctgtgtctaaggttgtgctcgagagaagagaaaaggagaagattgaaaagatacgcaaaataaggtgaactattagcgtatgattaattgtgtattaaatattttatgattattaaatattttatgattaattgtgtattaaatattttatgattaattgtgtattaaatattttagacttaaaaattaatttttgagagaagagaaaaggagaagattgaacagatgcgcaaaacaaggtgaacgattaactatgattatttgtttactaattattccaaacttaaaaaaacaaattaatatgatttattaaatcaactttttaaaaaacacaatgttgaatagtttaggaaacgtgcgtgcgaaaaacaaaacaattttctctctttggtgttgctgccaaacgcagccttagatgttttagcccaatatctaaatagcagctttctagtaaatgcttgttctacagttatattttcctaatgcggtagaaatcagccccttcctgtaaaaccaaacatgtagcctctcccaactattaaaatcaatcaaaatacttcgtaatggcactcaaacctttattttaaggagataactaacccgttttgatagtgttgtatttatctgcaataaggaatgaaagaggattataaaccaatatgaaaaactcttttgccatctcactaatataactaggtgatatggtaataagggcatccacag

SEQ ID NO: 72642 - DNA, 2967 bp, Oryza sativa
agtttttacttggcaacttgacaccagcatttccatatcagagtgattcaaggcatttttacataactgcgcgcaatcattcgatgaagtattctcagtcaccgatttggtcagacgaggttcaaacagaccataaggtccataactgtcaccagtgataacaaaaacatatcaattccaaatttacagctgtggcataaaacaaaataggctatcttctccaagtggctatcctcttttcagggagcggggctgcaggagttttctgccattcacaacaaggagagatgagtttcattaggattacagcgcagcaagaaagcaaggtattgcaaaactgccgtctaccaaaattagcttgtaatgctacaataacagctgaaatgttgttaactgcaacaagaaagtgggtgtcattgctggatgacctaacctttctccatctacaatgttgcagatgtgtccaatggctccacagcttgacgatctaaactttctaaagtttctttgctcacctcatcaacttgttccaagaaagacttaaaattatccttgtagcaagtaaactgaagaaggattatattagcaaccaacaattttatcaatgattataggaaatagtcctctaataaaaacataccgcatgtccaatttgttgaaatttagcatatatcagctgtagttcttctgcagcatcagtccttgttgaatcaacttccgcacatagtttagtagcctgtaatgacagaaaaatatgtcaagtatagttgaaataggatcatagtattaacaaataagataatataatctacaggctttagcatattagggagatagtcaggccggtcagcatatgttcctggaccaatactagcgcatacaatgaagcctctttggaacattagattgtattaggtggcatgtggcatgtgaacaccagaaatcaatgattcagagggaaaaagaagttttcaaagacattgagtttgaaccacacaaaatttcaggacgaaatcatcacctttgcaattgtttcctctactttcctttcacgaggttcaagacacttgagtttccattcaacttcagaactcaaagcagccagcttctgattttcgtctgctactatttgatccttttttttttctttagctttaacatgctcctccatttcatgcactaatcaaaaaggtattcatgcaataacgtgaggaaaagagtatttcagaatggaaagagcatacacaaattcagcaatactacaaaaggtaagtacagtttgacaacctttcccatcccattcaataatctttgtgtcagggccataatttcaacactttcatcactaatcttagttttgcgcgctttgacttctttctcaagggctttagttgcagtaacctaacagcaataataaataagagagttactagggtttcatcttaagattaatccaactccataatgaaaaactagcattgcagatgtccatacctgttcttgtaaagcctggattttagtagaatgcttcgacaatttttcataaccctgcaaaatggagacagcatctgcagttattaatggatcagtaggtcaagcatcacaaggaacagtagtaagtagccaagtgccactcttgcaacaagtcagccccaacaaccgcaacaaacagatgatccaaacaatacagtggaatatcaggaaattgaatcaatatgaaacagatgaagtaaccctatatttgctagatattgttacggccaatcggcaaatacaagttaccttctaccttcggtgttttgtaatgaagagtggaacaagactaccttactgtatatctccaaagtggcagttttctcttgtacactttgcgttgctatcttctcagcattctttaattcagcacgagctgttttcttctcttcaagggccctctgtaatacagaataaaatccaaaattagtgatgcaagcttataaagataatttatatgctgttagaagaacaaagtgttgatctgattgattcaaatatatgcatatatttccaaatagcagttgaatagaagcgaggagtattaaactagtgaaagtgtgtcctcgagaatcaagacagagcatctggcaataactgcaactttttaatgaacaaataatatacagagtaaatacgaagttctacggcattggaagaatgtcagttgtgcatgcaaaaataatagtatttacattgtttttcaatttctcacaaactttttgaagagtttagaatggtaaatatccaaatgtccctttaataccagattatgtgaaaaaaaaaacctagatcagcactaaaaactaaacatatagaggacaaaaaccattgcacacgatcactacaaaccatctatgattgtggtgaagtaattcaggtatttaaacaagactgaccatcctgccagcggcaatagagaaaaaagaggaacagatcgaacctgaagcttttctggggactcaacaatttttggcaataacttggaattttcttgtgctagtttcaccaactcaaaatcatttttggcaatctgtataaagaaaataacaaggcgtttagtgagaaatcgtcttttctgcatatctaaaatttcagcatgtcagcgagaaccatttcagtgtagcttaacatatgtcaagagtaaatgatagtgtgttacaatgtaaatgggttttccaaactatttttcaatccaattatacacaaagatcgtcttgtccaaatggcaaagctgcaaaccttctgggttctatccctatttgacctggacgcttctgacatttctaaccaacacaatatacaactggcagttatataatgaccaccaaaagtcggacactcagacctagaagagaatttggcctaatactacagggccaggtgaaacctggtagcaccatatattcaaaagcgcaagtaggattgcaatgt

SEQ ID NO: 72643 - DNA, 56892 bp, Oryza sativa
cggggggcgcctcgccaccgtatatgagccagcggcgcgggtggccgtcgtagtgcgggtggtaaggctgcgggaagaagtgtggcgggggcggcgcggggcgcggcggcgggtcgatctcgtggaggaacctgccgaagcagcgcgggcagaagacgtcggtggacgggtaggagatgatgcggatggcgcggccgcactggtagcaccagtacatgcggcacgtccggtggtgccgcacgccgccctgcgccggcatcgtcgacgacatggcgtggatcgatcgatcacacagctaagctataaccacttggatcgctcgaattctgtacgggaaaatcttgcgtggggtatgcatcttgcatgggcacggcgccggttttaagggcacgcgcgctattgcgccatggagagggagagctcgacggttgattgggtcggcgcgcgcgcggggaaattaagcgagtgcacgggtgggaagggatggctttgcgaggtggacgaaagcgattccgcggtcgcggcggcgtgtggcgtggtgaggcgacggcgtacgtagtagagaagggcgcgtgcagtgttgggcgcgggtgacttgtgcgtggtgcaaaagcgcgcggcttgcttgccggccaggaggaagaggaggacattggcgctcgcgggaagtaactgtgtcggttgggccatgcgggcagcaaggcccataggatcggcatgtgaatgtgggcctattctggagagaatcaggcaggattcgaataaccgtggacctggaatgctgtcgggcccaaagaggtcaggctggtgactggtcccgtcccgtcgggtggagcggatgggcgggcggaataatgctgcccgtgccggtcacgaatattcacctgcatattcttgccactgtctccgccagtcgttgtgaacgttacgctatgaactggtcgccgccgccgacgacgacgcgaggcatctgctcggagaaatatactcctaccatgagtccatgactttacagtactcgtagagtctcataaacctttcagccaaatataaagtcgacgtattaattggtcggtattttcatatcgaaaatagtagctcttgacccccaaaaaaaggaactgctgggtagctcttggccaataattatttctcataacaaaaaggagatgactaagaaaaaaataagaggtagtgcttgatcgtattcaaaagagtgtacaatacacgagaaaattttggcaccgctaccattctctagccataaagtagtccctccacagcccagattccaggcaccaacaacaaccccaacagacgctgacacatcgggcccacatattaacgggccccacacgcagcgaccctccggttcatctccacctcccaaaagatcgatgccctaacaacttggaagcccatctcgcctcgccgccccccttcatattcaccctccgccgcctcgtcaattccacgcgaacgcgagagctctcggaaagcaccaccaccagcacagagccagcgcgagagagagagagagggagaccaaaccccatcccggatctctcgtcgtcggcggcgtctgcgatggcgctctccgaccgctcccgcgagtcgctcctcccgagcttcctctacacctcctccgccgcgaggtccttcgccaccggcgccacccgcttcccctccccggtgtccccagcttccccggctccgggtgccgtcgggggcggcgcgcccatctcgatccaggctcccagggagaagatcgagatgtactcgccggcgttctacgccgcctgcactgccggtgggatcgccagctgcgggctcacccacatggccgtcacgccgctcgacctcgtcaagtgcaacatgcaggtgagttgggggaacgcctggatctgtgaccctgctggctttggcgcttctgggagccctgctccttcgtagatctggtgatatttagttttgttcgatggttagaggaacgtgtggttgcgaacttgtgatatccatctaggaatctaggcatgtcgccatccgtttgcgtaaatccagccgcgcgcgctttgctgtgcatacagctttgactgtcgttaaaatctgtagtttttatttgtcccgtcaatgttcttcgtcggttccaatgtgcttgcttctcattatttagttggcgtagggattgatgaggagtagatactagagtagctatcgatgttaaacatgttcagtactagtgtttctgcagttgaactggcgtatgtagaaactggagagttgattcacctgccctcttatttaagttacactactaatccttcttctttacttggttgcaaattattccgctaccagcaattatatttatctactgttaagttccaagctttttgttagtgttagtgtcgtggagcaaaatgcttgtgtatcttttggtgaagatactttatatttctcactttgataatactttatgtttctcactttgataagtcgattggtgcatctcccttttgccggtctctactttgtttattggaatgtagtttgattctttgagatggttgggtaggcaggtaaaatgatcggtgaatgtgcgatgtccagtcaatgtttgttttaagttgtaattgaaatgtttctattatggattttggactgacaagttttggttgatttttttcagattgatccagcaaaatacaagagcataacatctgggtttggcgtcctcttaaaggagcaaggacctagaggcttcttcaggggatgggtgcctaccttgcttggttacagtgctcagggcgcatgcaagtttgggttttatgagttctttaagaagtactactcagatattgctgggcctgagtatgctcagaagtacaagaccctaatttacctcgctggatcagcttctgctgaggtgattgcagatgtggctctctgcccatttgaagctgtgaaggttcgtgtgcaaacccaacctggattcgctcgtggactgagtgatgggctccccaagttcgtcagatctgaaggcgctcttgggtaagtataaataacatgtttttatcttagaatctgatatgtggcaactctttctctagttttatgcgccttgacaaatctcattccttgataatgacaggctttacaagggaattgttcctctgtggggtcgccaaatcccttgtaagtattagtcactttgctacattgatattatttttaatgttttcatttatgtaactgctacacgagactggcactaaaacctgatgttccaggacttgcttgtgtgataattctgcactatcttgtttttctttgatagttgcaatatccaacactgcttcataacttgctaacttgtcaactgaattttctgtacaagtgaacttctattgcctccatggctcatgctgatattattcacttttcttttttttattgtcaatattttttttcatagtttatatggtttattcacttaagttctgtttacttattcatggttgaaatttaattcatttagttgaactagggttggtcagattacccatgggttgtcctgtgtccacccctaaacactggctatttcctgaaacaacacaaaaataaacccttcacatctgttactattttctgttggtagagaactccgtttcaaatttccttaaattaactgttctgttttggataatgtagttatcagtttaggcggaagtttactactactaaagtgttttgtagtttctgctatatgtgtagttccgcagattggctatcctcagttagcttttgttaacatttatatatatatgaatatttattgaacactctaaagtatgaaccatcaactgtgtatggattaacagtagctgtcaatgtaacagctatgtaactattatgtgataaatttatgcgtacggggatttgaacacagtgtggcatggcaccaatgagtttttgtttgtttatttttatgagagctatgctgtcatgttatttcttctatgcatccattgaatatttccatcgtgtccagatactatgatgaagtttgcctcctttgagaccattgttgaaatgatctacaagcacgctgttcctgttccgaagtctgagtgcagcaagtctttccaattgggtatcagtttcgctggtggttacattgctggagtcttctgtgccattgtctctcatccagctgacaacttggtctctttcttgaacaacgccaagggagctacagtgggtgatgtaagcatgtcttctactaataaaacccattatgtgcaagttttatttcttatcttgatgttactttcatgttggttgactgcatatgaaagttgcatttctgtatgttcctttcatcagagtccatcaaagttgtagttaatgttacataactgctcccatcaaatcttcgtaaacactagaaaagttatagcacaagagaggtttatttctataggcggattattaaaaatagtctgccagtaatgatgatgaacttgtgtggttaaatgagctgtcagtatcctaataaatatgggatatccgatatatttatgtactaagctcgacaggaccaccatataccaagttctatatggaatcaagtttcatacatatggcgaaagtcctgcatatatatggaatcaagtctcatgtattctattcatgttcttatcatgttaattgaatgtacatgtttgttgtattatcacaggctgttaaaaagcttggtctttggggccttttcactagaggactgccccttcgtattgttatgattggaactcttactggtgctcaatggggtatttatgatgcttttaaagtcatggttggactgtaagtattccttttgcttgctaattaatttaattgttagaacattaaaaggcttttgaggaatcaaggacttatggcccatttatatattttcagtccaacaaccggtggtgttacgcccgcgcccggtgcagcagagaaagcattgcaagccagtgcttgattcttatgcagagataatggcgatgtattcctgaagatccatctttgttgtggctggaattgtatcaattacttgagtttagcacctaaatcttaattttagtggatgattcttgtgtcatccttttgatgagaggaactcattaatcaggtgaagtaggtcttttttgcccccgggaaagtttgatgcttgatacataataaatttttggacagcaaggctgttagagctcaggttttggcatcacctgtactgaggaatactcacatctttgtgttccttaaaagcatacataccttgaatcaatgctaccctattttttttgttgcaagtcagatatatgtgtgtgaaactgtcaataccaggaatctcttgcttccggtggtgtttcatttctacacgagggctgtgttcgcatgtggatgatgggaacatagtgcctccacacggaaaacggagcattccattagcacatgattaattaagtattagctattttttttaaaaaaaaatagattaatttgatttttttaagcaacttttatatagaaacttttttttaaaaaaaaacgcaccgtttagcagtttgcggaaaaggagggatttaggttgggagaggtccgaacacacccgaggttggtatctaaacaccagttgaatctaaactctaaaggcatttttctgccaagtcggctgccgtagcttgatgtgcttattttgaccaggtggcagaacttcattctatttcctttcttagccttcaggattttcgttttgcaactgtctttctaatctgaccactgtttgcatcgggggcaaaatggaacatgccatactaaaatcctcttgatctcggcggcaaagccctctgaagtctcttgtccaatgcaggccacacagtttctcttctttgtttcgcggttgctgcttgacctaaacctttgattgatcttgacatccagcgctagttgactttcgtatgtgcagtgttgcggcgttaaagcggtttttgtatttccctggtgaaagtcatgcaagtggcgtattgacaatcaggttttctacggctacatcatgtataagcagacgatcttcgtccagaattgtccgtgctcagcgatgctgccgtacaaatgtacaatacatacctgggatgtatagcatgttattatgcatccataatcataacctgctgcagaaggaacgtgcagctatcaaactggcaataggatatgtacaaaatcttgatgcatgcatcaagttgattcggaaaacaattgcaacttgcttcaaactcggcgaaaaacaattgcatcgaaacatgtctactacttaacatcaaattgacggtttgagtgtacaagctcaatgtctagttaacagcaacttgccggttgattgtacatcgacattctggatgaggtcgttgtttagatcatatgtgttactctcactttctcaaaataatcatcataaatgtttatgcaccaagaccaatgataatttaaatcacatcaattaagacaccatacacacattttcctacatatcgagaagaaaagagaacagagaaaagaaagtgggctatagatttgtagccggctgcaacacgtactccaagacgttatatgtgtataagaggtgggaccgggtattagtggtgtagtatatttttatagttaactattgtataaatgtgctattagattagctatagataatttggagccagtagttggctatactattaaactttctcttagcatgcacatattctcctatgctgtattaattgtattttgataaaattcgtgttcatgcgattatatgatgatcaatttaagaaattttaaattttattatatgattatcaatttgggaaggagggagtattaatactgcttctgatcatagatgatgccttgagaagcctcagttacaggagaaaaaaaaattgcttatctgagcgatgccatgtgatttgtttgtgctcatgattaagaaagtaaatcagccgggtttaaaaccaagtgcggttttcctatcacgtccacttgcacgcctgcacgttggttgctaactaatcaaccaaatctgcacgcatgtgatgagctgcggatcatgtgccgatctccacgcaagcactacgctacagcgagcggcgccggagaaggaagctgctgccgtcgtgctccggctggccggccggtcggccgcgacgccgcgtacatcacgcgtgacgtcttcacgtatcacaccacgttaaacaagctctcgcacactcattccagagacgagtaaacaacagagaaataaatggagatcagcatggtgcccctaccttgcctagcctccaacggacaaccatataatttgtagttaagtacctccctgaacaagagatacatttgttaactagagttagagcaggtacaatagcagactattagtcagctgtaaacatattttaatgagataaaagatgagagagaagagcagtggactccaagacgcaatatgtgtatgataggtgggactatattaatagtatagtaagcaactattgtatgaattagctataaataaattggagctagtagtgggctatactattaaacttgctcttagacgaagtacaggcgtactgatgacgatgatgatgttgatcgtgcagttctctcgatctataccactgtaacctgcccacaaaaagggtcaggttcatatgaccaacccttcatatattttggtttatcccccctttcaaaagacgctagctctcctcactgcttgtgatctattttgtcaggacccaggattgattccaccttataatcaccataaaatatgtgatcatgtactaataatactactcctcctaagtctaaaatatccaccaaactcttaactaatcagcaaagataaccaacacactggctggccagtagacatgcatatgaaaaaaataatatgattgcttcgaatcgaaccgctccccgcgttgccggcagccgattcgatggatcgccacgttcaaacgccgccgttggctcgcacaaagaatcaaggctttcccttcgaacttccaaaaattcggtcacaatatgcatgtagcattaggggttggtttgttttgaggcctatattggccttaccaatatttagcaatttcaatagtgtttattgtctatttggtgtggagctaaattttgacatgcctaagaaaataggccatttcaaccgttaatttaggctattttggcttcaatccaaacacaatttttcctttgccaaaattagccatgccaaaagttaccaaaatttgacattgacaaaaattggtaaggccaatttaggccacaaaccaaaccagccctagatatagacaaaaaaaactaattgcacaatttgcatgtaaattgcgagacgaatcttttgagcttaattacgccatgatttaacaatgtagtgctacagtaaacatttactaatgataaattaattaggcttaatagattcgtctcgtagttgacagacgaaatctgtaatttattttattattagtcaatgtttaatattttaaatgtgtatccgtacacttaaattttttttttgaaaaacaggcggcagcgacaccaactctctagccgcacgctgcactcgcgagtcgtcgtctcgccgcattattattttttttcttcgtctcttgcacacgcagatcccagcgcggccaatggcgccacccgagtcaaccccctctcgcggcacaaacccacccaccccgcaatcgcaatgccatcgcgtcacgccgcctgccgctcccgcctcccccatgagatgacccctcccccgccgccgtcccatgtgctcgccaccgtcgatgcggcggcatccgctgctccctctcctcgccgccgtccttgtcggcgccgccgtccgcgccgggaagatcgccacggaggtggtcgtgccggacttcgtggcgtcgtacctgctgttcattgacacctacggcgtgttcctccagtccggcggcggcggcgcgttccaggccgtcgtgtacaacccggcggggcagcaggaccggtactacctcgccgtggtgcacgcgccgtccaagacctgcgtctgggtcgccaaccgcgacgcgcccatcaccgaccgcgccgcgccgctgcggctcacggcgagggggatctccgccgaggatcccaacgggaccgtcgtgtggtcgacgccggcgttcgcgtcccccgtggcggcgctccggctcgacgaatccggcaacctcgcgctgctcgatgggaggaaccgcacgctctggcagtcgttcgaccggcccaccgacgtgctcgtgtcgccgcagcggctccccgtcgggggcttcttggcgtcggccgtgtcggactcggactacacggtgggcggctaccggctcgacgtgacggcggccgatgcggcgctgacatggaacgggtcactgtactggctcctgtccatcgacgtcaaatccaccagagatcgcgacggcgccgtggcgtctatggcggtgaacggcaccggcctgtaccttctcgccgcggacgacaccgtcctcatccagctccccttgccggacgccaagctgcgtatcgtcaagctgggcgtggaagggaagctggtcatcacaagctacgcttcggcgaacgccacgtcgccgtcgccgacggacgctgggttcgtcgcgccgaacagcgggtgcgacctgccgctctcctgcggcgcgctcgggttctgcgcgcccaacgggaacgcctccagctgcacgtgcccgccgctgttcgcgtcgtcgcatgacggtggctgcacaccggccgacggctccaaggcgatgaccgtcgcctcctgcggcggcgccggtggtgatgccgccccgacctcgtacatcagtctcggcaatggtgtcgcgtactacgccaataggttctcacggccagacatggtcggctccaacgggtcgtcgtgccaagcactctgctccggcaactgctcctgcctcggttacttctacgacgagtcgtccttgtcttgcttcttggtgcagcaccagatcggctccctggttaacgccaactcgaggcgaggcgacatggtcggtttcatcaaggtccagagctcgcagtcaccggggtcgccgagcggttcatcttccaacaacagcacgctcatcgccatcctcctgccgacgatcgtcgcgttcgtgctcgtcgtcgtcgtcggcgccgtcatcgtcgtgtcgtggcgcaagcaagagcggcgcgcggggaggcgggcctcgcgatccagggacgtgcagctccggcgccaccgctcgccggcgtccgactcggcgcaccttgtctacggcaacgacgacgacggcaacgacattgtgatccctggactcccgacccggttcacgcacgaggagatcgaggacatgaccaacagcttccgcatcaagatcggcgccggcgggttcggcgccgtgtacaaaggcgagctccccgacagctccgccgtggccgtgaagaagatcgaaggcgtcgggatgcagggcaagcgcgagttctgcacggagatcgccgtcatcggcaacatccgccacgtcaacctcgtccgcctccgcggcttctgcgtcgagggccagcgccgcctgctcgtgtacgagtacatgaaccgcggctcgctcgaccggacgctgttccggccggccgccggccagccgctcgagtggaaggagaggatggaggtggcgatcggcgcggcgagggggctcgcgtacctccacttcggctgcgaccagaggatcatccactgcgacgtcaagccggagaacatcctcctcgccgacggcggccaggtgaagattgccgacttcgggctcgcgaagctcctcacgccggagcagtcggggctcttcacgacgatgcgcggcacccgcgggtacctcgcgccggagtggctcaccaacacggcgatcaccgaccgcaccgacgtgtacagcttcgggatggtgctcctcgagctcgtgcgcggccgcaagaaccgcagcgagcacgtgagcgacggcgccggcgccgccaccggagacgactccaactcctcgaacgggacgacgggcagctcgtcgcgcggcgcccggagcgattacttcccgctcatggcgctggaggggcacgaggcggggcagtacgccgcgctggccgacccgcggctggaggggaaggtggtcgccggcgaggtggagagggtggtaaaggtggggctctgctgcctccacgaggacccgcagctgcggccgagcatggcgatggtggccggcatgctcgagggcaccatggaactgtgggagccacgcgtgcagtcgctcgggttcctccggctctacggccgggggttcgccggaccggccgacggctcgggcggcagcggcggcggcatcaagcaagccatggcgggttccaatggggaccacacaaggtcggggacgacgacggtgacgacgatgagcgggtggccgtcgtacatgtcgtcgtcgcagctctccggtccaagatagggcggcgcacaccggcgagaagattgtgttgttagagatagattatacggttgcattgatcattttggttgatttgtaaacagagggattaatttgtgcattcgtgaggtctatacaaattttgtcctgttttcccatctgcttttctcaagaaaaatggaaggataagtgagtttttttttctttttgggttgaagccgatgaaatcgaactgcctggttggtggaaatggttgaccaagtgaatcagtgatcaaaaaattctaaaggagttcgtaaatgttttgactttcccacatctctcatttcaaatggattataaaactcaacatatatgggacgggattttcatccctccaaaagatgttgtctcgttacatacatgttatttaaatagttataaaatttttttaaaaaaattgccatcacagattaatatgaaatgtatcactccataaacatttgtggagtgatatattacatattaatatatcttataatttttttaaaaaaaattataattatttagttgatatgcacgaaaggaggggatatgcatgtgtatgcctttgtaagtttatcgtgtgccatgcaaatacgccattcgcgtcgattggtactcattggtactatttacgagacctatttagttgatatgcaagaaaggaggggatatgcacgtgtatgcctttgttagtttatcgtgtgccatgaaagtacgccatttgcgtcgattgttactcgttggtactatttacgagatctgaacaagcaactgaattgcatgcgcgatgcgtgcgaaatgaaggacgaaacggaaaaaggcaagttttccgcctagtctccctctcgtcctctcgttgccgtccccgtcgccgtgcatcagatcatttcatcaccggcaagtgcagtcgcccctttaaatctcagctccacttgtctcgttgccgacgcgtgtgtttgctgagacgccattgtcacatcggttgctgcttccttctcggaagatagcaccaccagaggtcgtcgttgggttgtaatggcggaggtgcagagcgtgcaggcgctggcgtcgtcgctggcggcgctgccgccggagttcgtgcgttccgagcacgagcggccgggggcgaccacgttccgcggcggcgacgcgccggagatcccggtgatcgacatggcggcgcccgagtccgccgcgcgcgtggcggaggcggcggcggagtgggggctcttccaggtggtgaaccacggcgtgcccgccgcggcggtggcggagctgcagcgcgttgggcgcgagttcttcgcgctgccgcaggaggagaaggcgcggtacgccatggacgcgtcctccggcaagatggagggctacggcagcaagctgcagaaggacctcgagggcaagaaggcgtgggccgacttcttcttccacaacgtcgcgccgccggccatggtcaaccacgacatctggcccagccatccggctggctacaggtacgcgtctccatccatacatagctcgccatgcgcgccggaagcggaagctaatggcgaccgggcgcggcagggaggcgaacgaggagtactgcaagcacatgcagcggctggcgcggaagctgttcgagcacctgtcgacggcgctgggactggatggcggcgccatgtgggaggcgttcggcggcgacgagctggtgttcctgcataagatcaacttctacccgccgtgcccggagccggagctaaccctcggcgtcgcgccgcacaccgacatgagcacgttcaccgtcctcgtccccaacgacgtccagggcctccaggtattcaaggatggccactggtacgacgtcaagtacgtccccgacgccctcatcatccacatcggcgaccagatcgaggtacgaagctctcttcttcctcctcatcttcgcctcccgcgcattgcgtcgaacacctgacatgcatggagctgccatgtgatgcgatacagattctgagcaacgggaggtacaaggcggtgctgcatcggacgacggtggacaaggacaggacgcggatgtcgtggccggtgttcgtcgagccgccgccggagcacgtcgtcgggccgcacccgcagctcgtcaccgacgggagcccggccaagtacaaggccaagaagttcaaagattaccggcactgcaagatcaataagctccccatgtaaatttgtaattgggccatggaaacatcgcccccatgacacccaagtaccaagagtgctattgctggatgtggacgctgctcaatgtgatgctagttaagttgctctgattgctaatctgctgctttctgattcgtaatcaccttcggagcatctaaattcagattttaaacaaactctttctgaattgccttccatgccgacaccggcatgtaggccatttgatgcgatgggagcatggagtaatgtttttccatctcttgaacagtacacccgaaagttgacggagaatgggtcgcttgatggtgataaaatcggacgattcattccaccggcctacaaccaccatcaaatgatttgtcgatcaccgccttctctccctgcatgattcccttctttctctctctccagtctctcttatgcatataactagttttatgtttttctttcaaattatttattcgatctataatatgatatagtcactgtaactatatttttataacaaaatatgacatgactatattctgatgataaaaatatacatgtttcaactgtttagatatgaggtttcactttcacatgaaagaagttaatgtttcaattgtaaatcaaccatgtttagatatgaggtttcactttcacatgaaagaagttaatgtttcaattgtaaatcaaccatgttgcgcattttaagtttttggattacaatggatccgtgcttaatgttgcataatagttattgagatgtttcactagtttgtttgcaaatgttgcacgtaatgttcttagagtgtttcagcgacactagttcatttgcacatattgcatgtagtgttctttgaatgtttcagcatgcatttcgttatgtttcagcatttacaattccatgtcgcatgtatgatatgttttaattaggagtataatcataaatttttaatctaaaatataatcacttgagattctgttccagagattcagttgcaataaatataatagtgtaattagattttaaattggataagtaatttaagagagaaatggtttagttgaaaagttacttggagagagcatggaggaagagagctatagcactatagattttttttaattgaaaatataagcatgcagaggcaaaggaaacatgcatgcgacaagacaggcatcaagcatccattggagaagaggagggcgtccgattttgtcggagaaaatttgggcgcccgatccatagtttcttcaaatattgtcgtagaaaatcaagagcttttaattatctatgtgatttcaatatgtcaacgcattatattatagtcttgccaaaaaaagaatcatctaaattagagccaaatgtgtctcgattctgtttttgaagctaatgatcaagtaaatcgattgtctggtagtcttctgattggcaaatttacagttttttagcttgcctcggacgttagtgtaccagtttgcccaattttcaaattcttacattaaaatgcgtctacctactaaattcttgtatcttgtacaagtacaatctggcaataatttcaatcccttcctcccttgccactggtgaggtcgaaggggcgccatggcaggtcctaggatgatgaggcaaccgtagatctataggggacgcaactcctgagggaccctgacaaatggggtccagcatcatgagtccacatggcctaactcaatgctttctaagagcaggtacaatagcagactatttaccagctataaacatatttttaataagataaaatatgagagagaagagcagcgggctacagatctgtagccagctgcagcacggacttcaagacgcaatgtgtgtatgacaggtgagaccatatattaataatatagtaagcaactattgtatgaattggctattagatcggctatagatgaattggagctagtagtgggctatactattaaacttgagttgggatcctctcctgtaatgcatgtgcagtaagtgccattgacatgtgggcccggaataggtgggacccatatgtcagtgacacgtactgcaggtgcagtataacagtggatttgcattgctctaagatggagtcagggatctgacgagttgatgactccgacggcagccatcggagacggaagggacggaaggagagctggaggctggagatagtgtagtaggcttcttttctcagtaggtctttgaggcccaacaactaatggcctctgatttcgttaccgctgggccgtttccttgagcaccggaggcccacatcgagttgttatggaccttttcaggcccatagtcttcgcgttttggatcgaggaaaggcccgtatcagaacgttcagccatttcggcccaccccaatatgggtcgcaaccactggtaggcggtagcgatccaaatctggcaatccctggccccatggacatcagattccacggcggcaggcggcagaatggacattccaatatgccatcgtcttcgtctctcgtagtctcgtgaagaaaagatcacgtttataattgtacatacatgttactatttacttactgtgttaactccgaattggatcgacatgtcataccaaagttaggttcttgacgcagacggtttcagtgaccaaactggacaagcagaggtgtcctggttatctgatacgtacaggccagattagcattgacttggcatactctggagcaggcaaaattcacagaatcgcttttactgaccagattacaccatcattaacataataaagatgcttgtacagtcaggggcgaagctatagcaagttattggggtcagtagaccccgatgatttcttctgagtcccttatactcctttttattttacagctatgaccccggtcaaagaaaacactagaccctggtgattgtttcgttaaagctcaactggtggcaaggaacgataccattatcagctagcaaatagaaaattagttagcaattgtgattatatatcagtctacatagatatacatatacattttagactggcgctcataaagtggcccttatttaggattaattgctccagtagccaactaatcctattattatttcttgattatcatcacaatttggttgaacctagtctctcaagtctgaatttgaggaaattagagttttgaaatataaacgtctgatttttcaagttcagttacatgatcatgatgcatgagcctgggggaattgttgacgaaaaaatcgaacacaccggcctgggagatctgcttagctcctgtgcaggtccaaaaattaatgaggtgcgggcgtgccagtcagtttgatcctacaactgacaagatatgtaaatggtagatcaaaacagccgatcggctgacaagcctatggagtagttccagccgatagccgataatagccgatgccgataccagccgatagcgatagggtttaagcaatcggctatatgtccaatgtagataatgatataaaggcaaacggctgatgatgatgtaataaaataacaatacaatccaatataaaccaatcggctagcaatgatatgataaataagcatcgatccgaaagttaaagcatacatcggctggaggtccgatgtcataaaatccacaagattatatttaaaaattaaatcttattgcgatcggctaaatccaatatgtatgcagtccttgtaagccgatgcaacgtccagataactcatcggctgaaaccccgatgaaacccttattggcaatcaagaagcagactagaaattatggttctaagcacgacttagtagatcaaacttaactgatgtagcactaagtatgaaaagaaacacaatatctagacaattaagccgttgactgattttcagggtggtagatgcctaggctaatctaatctagtaaggcgatttaaccgatactggcagaaaccctaaagcgagagatagccgatagaactaaattgagatgctaggactagattaacatagacatatgataaatagccaagcaaatatattatctaaaccagagtaatccaagaggtcgaatgtcctgatgcagccttgaacgacgccgacgtagatgagacaattgcctgggccaacggaacattggacttaccccttcgccggagatcgaacaccgatgcagccctgcgtcaggtgccaagtcccgccggacgataaaataaagtagaaaaggtaaaaggtggcgatgcgccgaattgtattgatcgtgaggatatattacatagaccccgggtgtacatatttatacccatgggttgatacaagtccttgtcagacaagaaagaaactaacctaaagataaaaggaaaatataaagtccttatcggacactaaacacactttcctaaagataaaaggaaactaacaaactattcctaattaatagataaactgtcatgccgcatcctctttaaactcggtcacttaggaataagcttcctttagtagattgatttccttaaccgaatatagcaggaatccgactattggcgacttgataactcccatcgactgattccgagatgctacagccgataatgattctaagccgatgacgtctttgccaattaccaaatttcactattaacaggaatataacaaaggtgattttcaccatataagaggttgttatattcttttcccaaatagtgtaacctagtacaataatgatgtggttgtaattgaggccctgtttagttcccacacaaaaaatttacgccatatcacatcgaacgtttaacacctgcatgaagtattaaatataggctaaaaaattagctaattgcacatattgcgactaatttgtaagacgaatcttttaagcctaattgctccatgatttgataatgtcgtgctacggtagacactttctaatgacagattaattaggcttaataaattcgtctcgctgtttactgacggattatataattagttttttttattagtgcccgatcaccccatgtgataccctatataatatccgatgtgacacgctaaaactttacacccctagatctaaacaccccctgatatgtaaaaggtaactactactacaacaatagacttaaaattattagaagctatagccaattgttaggatcgttaattaatagtgaccccggtgaccatctatcctggcttcgccctgattttactatgactaatggccagatcactgaagaattgagatttttcctgagctgcttctttgcatatttgctagtagaagttgttactaaggcgtattcttcttgtaagcgacgctttacgtcgttatcttgtaagcgacgtccaggaagaccaaagactcgatgctactacattgccggtctatttttggagacgtggttatctacttattttccatttactaatgatgtctagtgctttttcagtggagagtaagatccaaaatggttcatccatttcgtctgaatttgcgagatatacacacaaagtgacatacacctgtttctgtttggaccataatttccatgtggatccacatccactgtatcaaacagcacacacgtagttgaagtgagtgtagcacgagtgcacaactggttaggtttcttgtggtgaaaccaacccaccttgatacaagttttaaacttaacacagtactcatttatgactaattatttttttagtgagatattcatggtgacttcgtcgattttaagatatatcggcataatcttctaaacgtgctcataggggtagggtgtgcgtgtgtgtttaggcgggatgagtctgcgtattatgaacgcttacaattgtaccgtgtttctaaaaaatactgcacacgtgtagcaatttaactatgaacaaaaacatcacaccatttttttaagtaaaaacagtaggaaattaaggacaaattcttaggagtatcacgcggtgttttccaccaaatttgtttgcttgaggagcccggcggggatcgaatcgaacgccaagaccaagaagaaatggaaatggaagagaagtagctagccagccattgatgcctcgttagttgggagatcactccaatgcttcgtgagcctcacgtaacagccggtgatgcatattgcatagctagtttctgaccgagatggtggggggtgaaggaacgcatcaagcaataatcgagctgcagcaactggggtggcttgttacggatatggtgatagcttccaaggatgaaattgccatgtcactctcttaattgcttctattgaatcattctttcaggactcgttttccagccaaatgataccccatctcgatcgataatacctatgtctactgctgacgaaatgtacacaaactttttttgccgccagctgaacaatgcctatactagtactagtagcaaggttatgacaaaggaatcgcattgttaattgtcagataaatctgtagttaatgatgaactgttggctaggtcgctatcgttgcacgcatgacaggcgcactagctagagatcagtacatctacgcttctccgtgagaactgtgactggccaatcccctttatgctgagaaatattgcaagaaagaaacttaagatgcacgtcgcataccatgcacgcacagcaaaaaccaccaaataaactgttacgaaattgtgaaatgcctcaggatttcaaatatcgcatcttacaaatgtacgcaaaaacaagagtctgacttggctgaaaaagatattgtgtgtgtgtgtactcgcgtggacatgaacacggttttatatatcatcgttgatcggactgatcactttgaactggttaattaaactcatccaagctttgcactaatctcatacgctaattggcagagttgacacggctaggtcagctgctaattgcgcttatatgcctctacctaattgcattgcatgaccacttctatataaacatcgctgtgcttcgacgtacgggaagagcaacgagctgtgtcgacgctagctaagccaacaccaacgaagattcgaagctcgcggttttcttggctttggtcgtaagcatcaaaaatggccggagctggagaatacggcggcggcggcggcggcggcggcggcttcggcggcgacttcatggtgctgcggccggacaagggcggcatcggcgacctgttccacctgctgtggtcgtgcaaggtggcggagaacgccgccgtggactgccccatcggcacggagatcgccgagcgtcggcggcggtgggcgctgttcgtgtcgctggtggcgcagatgctgctgctgtggacgaagaagccgatggcgctgctcggcggcgggacggagtactggatgaacctcctcaacgagaatggcggcagcgtcttcatgctcatcaccaacgctctgcaaggtacagattttaactctgtacaggttaactagctacctagctagcttggcttgcatgttcttctgcagttaaacttgcaagaaaaacttgctcctcgtacaaatacagctgtcagttacatttatcacggcctcgtagatttgcatttatgattatttcgctttcacgttcgtgcgtgctccgatcttgagtttgctctgcatcacagacaagaacatttcctcgtattacaacgtagcagtatacagctagcagctaacttccatcctgatttctactcctagctagtgttcaatgttacaaagcaagggagactcgatatttaaggctgtttttcagttttttctaagcaaatttatcatattccgtgtttctgggctgcttaattgattgcgcttctctaattagatatgcaaaaaaataagcgctagttttttgtttttttttgtcgtttttgccctatcattttctatttcaacagttgaagatttctcgtagactagctacttaaaatatgttcttcattgcatcctctgttcatcgaggtataatgaagtaatgatataagcgaagaagaaaaaaaaagatgataattgctatctctgcacttctgcaggaaaggtgaaaatgccagacaaatcatccatcaattaccgatcatgcattggattgcttgacacaagaatcgatcttgacgagaagatcaaaccagaggatagaaactaccacgctgccctgtcgatcatggctgcaaaactagcctacgagaacgaactcgtcgtcagaactgttgttcagaaccactggcaggtcagtgaaaattcgttcaaactctgcatagtcccaaatcttgaaatcgccgtcacatttttaacctctcctcacgagtctgtttcttctgcagatgaatttcgtgggcttctacaactgctggaatggtaaaaatacaactttttggaaaacattataatgtcgtttgattttttttctagtcaaactttttttaggtatgaccaaatttatagaaaatacagtattattttcaacacaaaacaaacatattatcaaaatatattcaatgttcaatttaatgaaactaatttaatagtttagatgttgcgaaatttttctataaatttagtcaaacttaacaaaatttaattagaaaaagagtcaaacaactttacgaaacggagggagtagtaaattcgtgcacattgtgagttgcatatgccattttcaccaactcgcttaatttgttccattttttgtgcagaattccaggaggactacacgacccaggcgttcatggtgtcggacaaggcggaggacgcgagcctcgccgtggtggcgttctgcggcacgaagccgttcgacacggagcagtggtgcgccgacgtggacttctcgtggtacgagatccccggcgtcggcaaggtccacggcggcttcatgaaggcgctgggcctgcagaggaacggcggctggccggagcaacccaccggcgccggagacgacggcggcagcgacaagaagccgttcgcctactacgtcatccgcgagcggctcagggcgttcctggcggagaacccgcgcgcccggttcgtggtcgccgggcacagcctcggcggcgcgctcgccatcctcttcccgaccgtgctggcgctgcacggcgaggaggacatgctggcgaggctccacggcgtgtacacgttcgggcagccgcgcgtcggcgacgaggggctctgccggttcatggacgggcacctggcgacgccggtgagccggtacttcaggttcgtgtactgcaacgacatcgtgcccagggtgccctacgacgacacggcccttctgttcaagcactttgggacgtgcctctacttcgacagcttctacaaaggccatgtcagtgtccaactctagtctttctacctatagtactacggatctaatatgagatgtgacacattctagtattataaatctagatagatatatgtttagatcttataaaaaccaacttagtatcagatataatacatcctaatataatatatttgaatatgtgtctgtttagatttgtagtattagaatatgtcgcataggttgtttttttattaattgagcgagtacgttgttagtagtgtagggccggcctgttgacagattgcattagattgggttgtttcttggcatctaatccaatcccctgaaagagcttggaaaggggtccagtgaccaatatacacacggtcatgttttcaaggcaagcaagcatggcttgcaagcaagaatttggtgttaagaacaatagaaagtgagaagcttcttttctcgtcatgggcagcatccttgccttgcttgctgaaagcctggaactggagcccactttggtgtgggatggagagaagaggatgatgctgcaaactgtgccaattggcagatgcagcatgtgctagttgtagcccacaactgtgttccaactgaacttggtgactgacgaggattggtgttgtggcgatgcaggtgacggaggaggagccgaacaagaactacttctcgctgctgacggtggtgcccaagtacgcgaacgcggcgtgggagctcgcccggagcttcgtcatcggctatgtcgacgggccggagtacggtgagggttggctgatgaggatcgccagggccgccgggctgctgctgccgggcctgccgccgcacgcgccgcaggactacgtgaacgccaccaggctcggcgccgcctcgctcgagccgctccgataggtagctcgtcggcgtcggcgccaacacatttagtagtaaactagtaacaggcttgtgattcatgattcatgaagtggaatgcaacatccacagtgtaaattcatgccttaaacacaataatatgattcataaagtggaatgcagcattcattttcagaattcttgaacaagacagtgtagattcgatgtaaattcatggcttaaacacaataatatgatgaaaatcggtccggttggcatacaacaatgtttccaagatagcatggctaacatcagtcaatccatgggtcaggactcaggacgagcaatgcattacctcacagatgtcacccaagtgatgaaacatcagatgactcaagtcacatacaagtctgatcacccttggcacgcaagctatacttggtgcaagctgttcttttgcttaatgctgaaggcttcccaaaacgtgctggaagaatacaggatgcaacaagagttttagaatgttgtacggttacatatcttctgatgatgaccgtgaaaaaagtggatatcttgcattggctcttacccacccccacccaaaaaaaaaaaaaatcctcatacacaagcccgacaacactccattggctacagtcagggtagttagataatctcatcagtatcacaacagcgaagcatctctccagcaaacaaaagaaaaggaaaaagctcatcatctatgtcaagccagtaggaataaccatgaatccatgttaggcaactttctccgtggcgggaaggaatgaaagactgtcactgtcagcatccaatttcctcaaaatgagacgagatgcttgattcagtagggccagcattatgcatactctataaacaactagaagaacaatcagcgctgcgccaataaatagtctgtctgcggtctcttcccctgactgatctggtaagcatggttccactaactggtttacatagacccacatcaatcactgaagtaacctttcttttaccatgatcctcatcaaaatgcatatcaaataacatagccaggcacagaatttggtgagtaagtatgtagtcctcatatgacgaaggtacaacctgaaggatgtgaagattcacctgcatcataagtgtagccagcataagcagtgaagcttcactgagaaatacattaaagtgagagcagttagcagtacaaacctcagcttccattgctctaagatcattgtgccattttaaagcttcagtctttcccgaaagcaattgcaatgtgaaaaaaggtggcctaacaggatattccatgctgatcgcaatctgcaatgaaaaatccacagtgagaaagtattgtgcatggacatactttaaggaaggctcacaccaaaagagtaactgaagaatttaccttggcttccagcattacttttggaccattcttcagagttttactcaagaccagggtaaactccctggaagcatagtcctcccaggatttgtctgtagcaaggttgactttttccacttcttggtcaacaaatgtctgttcctctaactcactgtcactatacatcaagagatcaagatcgtcctcatttctaccaaaactgtgtgagatgcttagtttagatggtgtggcgctctttgatatcagggataagcctctagaatggtttcgaacctccggtgacacttcagagtgtgatattttagaaacacttggcgtgttttcagcaggaaccacggccagaagctccccatcctccctggtactctcagtttcttcccaatgcgtcacagatcttcgctccatatcactgtcaacacttcctgcagccccaacaaccatcaaaggagaacgaggtgctggctcaggaaatatcccagtaaatgaccagctatgcagactacacaatggggtacgtgatgcccatggtgcattctcgtgttcaatttgaggccacttcagcttagttaaataatcaagctgccacctgtaatcaaataactcaaaaacatataagaggtcataagtaaaagatacaagatgctactaatcacaaaggaaatgcatagtactcataagaaaaaggagacgagatgttcacaaactttgctcatcaaatatttttcatcaactaataatgtagcacgtcacagaatgacatgtgcaatgaagcaaaaactcatcagccaaagtacatttcctccatctataaggatctaccatccaaattttgttacatcccaaactacaagattgtgaagcagtgactcacgtaagagccatctgtgcaaccttccgtgagcggattctctgcaaaatagtctgtgcacgattctgctgacggtataaagcaagcccagatgacaagtccgcacttctcgatgctctgttagaatcatcaccaacagatagaggcacttctggcaagaaatctataccagctagatgttgtgcccacttgtatggccttgaatccttttcactgaagttcggaacctccccagcataaagtttagccatctgcataaaattgataaaacgactctctttaagataatataacagagaactaaccaaaaacatttggctaccaacatgagataaagccatgatagctcactgctgcctatggccacaaatataaggaaaccaaaatgacctatcaactagagattgtcacagaatgatttgtatatatattcctttaaaaaaactcaagtggtggtggtgaatggtgaatctgccttaacctaccactatgatatctcctgacatgtgggaccatcaaatagtgatatgaacaagtaggtatactgtgttaggtatcaaaacaataataagagaattttatacaaagtatttaaggggaagatatcaaattccaacagcaatatgaattcttggattaatatttgaaatggtaatgatatgattttttttcttttaattccattaaaatgcaagggcattcagctagcaatagtcaaaatcagctgattccaacctgatgaggcaactctaaaccagtgtcatctggaaataagttgcataggatatcatggtccagcccctttgaatcttcaattccaacacaaacaacgttcaactttgccaagtagtcgaatctcaggaccatgagcttacgacgctttgctccagactcttcagtgtcgtatacatggagaataactttaaggggatgaagttgatatgccactactgaattactagcttccttcacaacactttttcttgaccttgaccttcttctttgagcatcttcttcatcatcaattgcatcgtcatccactctattatcaccatttgacaaagtgccagctattgcagatacaaaagacacgctttatcagaaatatttcctagtctaccacctttacagattataacaagtggaagagaaccattagcaatctgattctaaccattatacaagtattgaagcaagcatgcattatttacatgcagcttcaatttgtaatgaggaactaaaatataacagcttccataaaagaccggggcttctatactgctatatgagaacgaactgtttatgctagacacaagtatctactaggaaattgcatctggtcatttaatatgtggctacgctacattgcttttctaaaagtagtaaaaaggatcccttacatatcatacggtacatgagaagagatagaataaatgtcattaattattgcgagtattgcacttctgtaataggaaatcaaataaactatattccaatgagatatgattatatgaaccaaccattttcctgcttagcttgctgttgagcaaacatctgagcatcctttgtgcttccagtgatctccacttcaatattctctccgaatgcttctttctgtcctaaaaactgcgtgtaaactatatatagaggagttggaagcagttcagctgcatgatgctgctttagtttcttggtatgttgcatccccagctgctgctgcactggcaatgatgctttcttcagtgatttcaaatgggttgggaggctcgaaaggaactttttctgatttgcaattgtgtccaacaaactgctcttccgctgctccaatttctcatgtagcttgcatagctctttccgctgtttcagatttcaaacttactttagatatcagaacaaatattgggacccaaacaaatcaagaccacactagcacaaagggagtaagggacttttgtcctagcaagcaaacacatattcaaacaactagaggtgataaacaaattaagcagatcaaatcatatccaaaaacatactacaaaccttgatcactagtcacacaaagaattatcagatttaagaagaattatgcaactgactaaaatcaatatacataaaaagagtttccataacaacaaagcgttctacttaagaacagtttgatatatgagcactctaaactacaaaaataacggtgaatttataaaacattttctatatatacatttgaatttttggagaaccaatcctgcaagccaagctaaatatttacgttaaatttactagcaggtcaacccagctacgatgtgattctttctttcgattattaccctgatccttcagaacaaacccccaatctaaatgctcatacaatcctgtacactctctatgatgctttaatcatttagacgaacaatgaacaaagcacaagaatttatcccatgacaagtaaatctcctatttgtgtaggaactgaatcaactgatcacggtacacaacctggactagctcgaaattgaggcgcttgagcatgaggtcgtgggacgcgtcagcagcgagcgtcttatcgcggatgtccgccggcgcggcgcggtggaactcctccgtcggcacgagctctatgcccgggtacttggtctggaagtcgaggcacgccctaatggccttcacgtagtggttcttctcgtacagaaggttgtgcagctgcagcgtcgtggagtccacgggcgccttcgccgcctccgtctccgccttcaccctgtcctcctccatcagtatctccctgttcgcctgcgcaaatccaaaccctcgagtgagcaaacagcagatctaacgcgaggggttcccggcgaagaggcgttgcggattcgggagcggcacggacctggcgaagcgtgatgaggaggagggacatctgggcgacgagctcccggagctcggttctgggggcgtcgtccttcttgatggcgaggatccgggcggcgacctcctccacggaggcgcgggtctccgcgaggaggtcgtggggggacttgcccttcgaggtggatacagtgctggtggtggtggttggtcgcgccggcgcctcgacatccatggcttcggccgctgctggctccgccgccatcggtccggccggcgctgggagagacgatgcccgaagcggcgagaggtggtgggaagtgaggtgaaacgattcgtggctgacctagagttgtcgtgcgggctaacggttcagcgtttcgggcccaatttgtagagagagaaagagagaattaccggttaggcccagaagggagaaccgctcggcccatctaacctttagacacttaaaggaggcccatgtggcagattttatttggaggaaataagtccactttgattaccttaaaactagtgaaccagtcttcaaaatcgtaatatcggatatctcgatccctcaactactaaaaccggtacaatttaaatcatcggaggtttgctgacgtaatgcctacgtgatggtgttgatttagtttttgtctcacgtgacgcttatgtgatattagaataaaaaaatatattgtctccatctttttttatttgacgtttgagacagctttggaaaatttaaggagtgcatgagattacccttttccccttcgttctttctcccccaatcccactgttgtgtttcttgcacgccactcgccggtggcggaccagcgctccaccctccactagctgtggcatttcttgcatgccgtgccagggtcgaaccagtgctccaccccgtcattccatgagcccgtctacatcccgacgactacgcatctaaccgatcggtagtgaagctagaaagtttccaaagccgcaaatccaactataataagtaggtcatttccaacccaatgactaggatggtatccgtaacattaaataaaactgtcacctaggatgaaaaatgatgtggaaagtgaatacatgagaaaagagaaggaaaccttgtcttatatgagacttggtttctacacaacatccaagacatcatatgagataaatagcattaaatttaaatatatatagtgatgtttgtattggaatagtagtgtctagtaccagttttttaatgatgtagagtttatggaaactatgtgtagtgttttgagttaggaataacctaatatatcaaaatttacagcgtgttcgctgcaacgaacctggggaagaggcggagccggtcgacgtggagggcacgtgcgggtagccatggaggccaacaacggtagcagggcggtgaataagtagtaccgtgattcttggtcaggctgaatcttgggtgtgtgtatttattgagtaatcagctaatcttgatcggtaagcataacacgaacaaattgcgagtgaaagccatgacttcgtgatgtttccctgcaatcatctaaaagaaaacttacaatatgatatctcacttgcggcggcctatctctagtggattcaccccaatgataagggcggagtcgagattgtgcattgtggagaagaagacgaacataaacactccgtgattgtatcagtaaactttctttgccatgtatgatcatcgatcactctctggacgtccgactatcacgagcggttcgtccgtgatctgttgagtttattatacgactacgagcgtacaacggacaggctggtccgtgatgatccagcgcaatcatgtgtaccaatcggccctactacaaaagcgcgaagctttgctttcgcaacccagagccgtgccaaattgcagctgatgtacgcacatcgtataccggaaagaactgttcgtcatgaagagcagaagacgtccgttgacgctgacggagaaccaggcgtgttgatgacttgattgcaaactcgtacggatgctgatgccgatcgatgcccctgctacacgattgttgggtcaccgcattagagcaagtctaacagtacagaatactaccagctccaattcatttataaccaatctaatagccaattcatacaatagttgcttactatactattaatatatgatcccacatgtcatacacatagtgtatcttagaatccgtgctgcagctggctacagatctgtagcccgctgcttctctctctcatcgtttatcttagagcaagttcaatagtagagagagttaactgccggctccaaaattcaccacattatttaagagataactaaacaacggtagatacagcaattggctacacccatgctttaaccaacgcatcctgtcaggtgttggtaacttctgaatgttcaagttctaattttcgattggttatcccgagcggcagtggcagagcccctaggcgctcgtgcttgagccggcgactgaattgtcgtccgctttgttctctctgctttccctctctttatcatatatgttaaaatattagataagcaggctttatacctgctcttattaaaatgtgtttatagttggctaacagcgttattgtacctgctcttactgcgtgacttgatttctccttaaaagcatcaccggccaaccgtgctggatagcatagtgccactgttgtagtatgtcactcgagagaggagcagggggagcacaagtgtcatgattccaccaattccctagactgtttaacgcctctctctccgtgaacctttttcagtaggagtactagctgaccatgatcatgccacagcccacagcacgcgcctagcagtaaaatagtggcaggggcagtagtactgtattagctggagcggtaaatcaagaatgtattatccttctactgcagctgaacaacccagattgtactaacctgacctgtaaatcaataagagatgctagaattacaccatttgaaacaaaaaaaaatcgctcggagcaggaatcctttacgctgggcctgaaagacgccacggagaagtggagaaagcaaagcaaagcgccgtttattactgcacgcgtctggggcacctgccctggcaagcatggcactggtactgtcacggcagtatcatcacccgacctcacagtctcacctcgatggggggcccacacactgtcgcagtgtatcgagcgggacccaccacctttccgacgcacccggctccgcctgacacgccacgtgatccgccgctgacacgcggggtccacgacgcggacggtgtccacgtgttcgcggctgggttttaaacgaagcaaaggaatagtactactccctctaccaccccgacagaaagattcgcgccaagtcaaaaccccgggcccgtgggtcccaccttccatgtctgtactggaagcgagcggtgcgggggacgggcccacctggcagcgagagcgaggaacccatgtgtgagtgtgaaatgccccctcgcgcccggttgaaaccttgccgcactcgtcggcagccgcgtccacacctcggctgctccttcccagttcccccactccactgccaccaccccctctgcttcatcggggaatgcgaccgcgcgctcgagcatgcgacgcctcgagcccgggctagggttccccgactccgcctccgccgccgccgcggccgaccgacgccaccatcccgcacgacggaagaagccgccgccgcagcggcgaaggcgaccggcggcggccgcagcagtaataaacatatcccgctcttaaccttccccttcctccgccgcattgtcgtgttagggatggctgcggcacgcgcatcgcgagtattttagtgcaaggggcgggcgggcgcggtagaagtcaatagatccaatccagccacgcgcgccgctcacatggcggatccgaggttagtggcgaaaccatcccgcccaagcaaaagataaagccaaaaaggagaaagagggcgggcgaatttgaacaaagctaggcaaaagcgccgcatctgactgcttcgtcgcttttctatcattgctattttggtgcgattcgccggcttacggatcgctcgctgtttcgaattcgtctctgctgcttggggtagtgtgagtgtgtgactagtgcggcgactgtgcagtggtgttcggtggttttgatttctcctgattgctgaggcgattgccctctcttggcggtttctgcagccggcggtggggcctcgcggcgcgaccgatccagatccagcgccctcgccgctgcgcgtgcacggcatcggcatcggcagccacgcctcgcgtggcacggcaccgcgaggttggtgggcgggcgatcggcttggtgtgtgctgtgttatcccagtgcccgcacatttgtcgccagctaacctcttccacacgcaggtgaggaggaagaggaggaggaggagtggagaggcgacggcgacgcgggctcggaggaggaggagggggaagcggtcagtgactccttctcccactcgctgagaggtgattaatcttcccttgtagtacggttgctgcttttgtgctctgttgagtgtgattgctgacttcggtttggaatctgttggttggtagagtgccagaagcagcggaagctcagagcggagggggctgcgttgctgctttcaccggccaagcatgagctcaccggcggaggtggtgggagcatagaactgctggtgctctcgccgaggtgcttggttgggggtaatgttggaggaatgagcaagagctccacagcgtcatcacggagcagatcaggcacattcccgagccccggtaccccaaactaccaccggcattgcgctagcaccatgcagtaccctaagggatggagctcagagcgggtgccacttggaggtggtaccaataggaggtatgggggcagtggggttgttcttcctttcaacaatgggaggaagctgccatcaaaatgggaggatgcagagaagtggatcctaagtccagtttcctgtgatgggattggaaggatgtcagccccggcgcctcaccatagacggcccaagtcaaagagtggcccacttggccacccaggcggaataccgggtgcttatgcggctgcttcgccgtttgtgccctgctttgatggtgttctggcagcggctaattttgcagcacattctcctttttctgctggggttctcatgccagagcacgtgcgcaatggtgacttcagcagtggaagaggtagaagtggggatgatggcagtagccgatcttactctgcagagaaggacccatatatcttgagatcagcaagtatacatgcgtggacagagacacttatggaagcatccgcctttgctaatatctcagaagaaactgcacaaggtttgattacggcagtcccttctccattgttatcatttatttgttggtatcttgtcatgcgttctgattctgttgctactgcagtctgcacatttgttattttgcataagatttcatgaggacgcttgatataagttttgcagcttgtgtcacttgtccagcgtggactcataattcaagtaacagcttgcctgttatcacaagcttcgaatacgcgactttccaactttctgttgatgttgggataggccaaaagagtgcatggcgtttgtgatatgttttggtatcatcaaattgaactttccactttagtttgtagtggttagtgagcatgcatgacattatgctatttgcatatcctgtcatttttgcagtgagatactataataagaaagatgctcacatgcataacgtcatactactacctgttaatgcatctaaagttcttcaatcaatacagtgtagcacaaaggtggagatttcaatcatacaaccccttggcactcaaatccgagcatccattctgtttagactgatcttacctgttcacatttctaagcatgcaaaaacacctgatgcatatgcacttgaacatttaattctttgacatgtggactggtagattgtttgggaacatttgaatcggcttgtaacatcttgttttttccagttctaaggcctttcaagtgtctgatgtgttctgtgatcttctgtcttcagaaggctagttgtgtcgtttagatggacattataaaagactttccataaccatgtatgccatcagatagtgtacatcaggattatgttatttccatcttgcttaacaatgaaatggatataattagatttttgtcaaccaaaataaaaatgttatggcatttttatgtattggggattttccacagttaattcaacaaccttcagatgtatcttcatatatgctaattaaatttcttaacaaatttgtaccctgcgcacagatgataaattgcaaggcctgcgaggagaaactcctgccatttccagtccaataataaagaaagatgttgccacacaaatgagtcctgatgacagtatatcgtcttctccaaaagcaagacattcatgttccagtttaccatcaggacatcctattaaagaaccaaatagtaatgcacttaaacctgaagtccgagatgtccaggtagatgatcaagtaactgtgacccggtggtccaagcgacatgtaacacgagggtctgataggcggtcaacaaatattgtcgagtggaggaagaaaacaattgagactcgagctccatcttttgatgaaaaagaaagagaaagctgcgtatcaaagtaagatattttccccatgtttatcattttttttatttgtaaatttgatttatgcctagagaccagcatacagtcatgtacttcatattgtaactcataatcctatactgccaacctactgtcagtgccatagtgactatacttctctgttggtttgaattttgaaagtcttatgttctttttgttgaaacctgaaagagaagtctatgccacactccaggtctcctgctgaagctgatttggttgtatgcttgtacatatacataggcaagcggaattcgatttgactcttatatggtctgccaataagtggcaaattaaatatttactcattttccttcttaagaaacaaatactatgcaacaaatttgattttaatgcgcaaatctatttcaagatgccataggatcacaagccagtaagccacaggttcttttataaagttattttcacagcattccaatttataatataagggactagactgtgaaatggttatttttttttatacggtctaactagctaggtggcagaaaaaaatgaataaaagacaaaaccatactaatataatcaagaaccaatgttgtatggatgagatatccacttagtcatatgtaaatttagccttttttttatctataaattttctcagtccctactttttagtattcagttatgcaacctaaaccttgtgcctgtttttccctttgaacagaagaaaaatatgtttcccctacttctttctttacccttcgtgaataccagaactccggacagataatagtactacctccgtatttaaatatatgatactgttgactttatttggtctttggtgtgcaactttgatcattaattttctattagaatataatggtaatatctaacaagattataatattataaaagtacttattaatgaaaaatctacccatatgatttttatgttttcatactaaatattttgagttctattgatggtcaaagtttaaaaagtttgagcagataaagtcaatagtgtcataatttaaatacagagcaaaaaaaaagagagaaaattttgcagtgcttagtatgtaatattgacttactaattaaggccacaaactgtgacttgttctattgctgagactttatttctgtcaaggtgcaagagggaggaagcgaagatcactgcttgggaaaatctgcagaaagcaaaagcagaggcagcaattcgaaagttagaggtagtcttttgtacttctgtaccataaaaatgcatgcttgtataattgattttcctgaaggtttactttttctttgattatatggaattaagtctttttaatgtaataagttgtggttacatgttctgccttctgtactttcagatgaagcttgaaaagaagaggtcatcatcgatggatagaatcttgggcaaactacgcactgctcaaaagaaagcgcaagacatgcgtagtgcagtttctgtgagtgaagatcaatgtggagtgagagcaaccaagaaagcatcatacttgaggagaacgggcaaatcattcagttgctgtttcacctatcgtgcttgctagttgtgacatagttggtaccgtgggcgtagcaatggatgtacctttgtagaaactttttggtgagtttttgctcgtataatggtaaactaattgtggtgcaatgtactgttgtggtgttgcctgtcttattagagcatttttacttgaaaatttattaacatttcgcatgaatcttcaggacgttgcagctcatgtcagccaacaaatcagaattaatcaggaagtcagatttttccttgctgtggcagctggaggtgacggggttatttaaagagaatttgcatggtctgatcgatgaaatacctgtagtgccagtggagtggtataaatcagtcatcgagcaaaatctatattgtagttaatttcgtggattattgctcccgttattctgtgcctacaatcaatctctgtacacccaatagaagctccttcgagttcgagagctttatgctagtcaccaccagattggccaggttcagtggttctcattctgattgatatgtatctttccatgggattctgtaagcaaagcaagccttggggcttgtactgatatattgtattgaaagaggttatgagagctgcaagctacgactgcagcttgctctcttgtccagttttgctctttgaagcccgtgtggttctgtttagatgttactatatcttatgcatacaagttttttgtgtacatactacgcacattaactaaaaagtttcaccaaaagtttaaagattggattttatgtgtagatggaatattactaaaggtacattatttttaaagaattttttacgatatttgttagttggtgtgtacaagaaaagacgacttgtgtgcatacgatacgtttcctttttagacatccaggatgccaatagttatttgtgattgtctatttagaatttcagattatcctttgctcacccagaactgatgtagagttggagtttagtcaatgttggcaacatttgggggagactgcaaagtaactgctgtagcactagctatacatgagtatataaagtgatgattgcatgggcataaatacattgatgaaaaaacaaaacgaacatatacaatccatatacaatccgctggggccaaaattttgtatgcaggccattgaacgccaggttgctcgcttttttatggtacaaattgaagttgtgttgggagtaccttcatggcatagaggttctcagagtttctctttgcataagtaggagtacagcgttcttctattttgttgttctatgggttcaagttgagttgaaccagaaccttaggtcacagcctgacccctgataagttaaagtgcaatagtccggttgtatgacgttaatttataccagaacagaaccgtcctatacgagagctatttatacgttcgagcatgggacattggaacatactttcgtcttcctccagctaacggcctcgcattctctacatagcctaatctgcaggattggtttcatgaaacccattctagcttacaccacaaaccatctttacatatacaggagagttagtttcatgccggctgccgctacaccagaacaggaaaccctgcgtggccatgatgtcatggccggccggcaagctttagccatatctatatataaagaagcacttcatgcacaacggcagtacacatatccaaatctacgttgtgttcgatcgatcactgcaacatccattataatacaacatagatcgtatcatggggagcaaacggcgagtaatcttgctgccaactttgggcgtcgtcgtcctggccatcgcggcagccgtcctcttgcacgccggcgaggcggccgacgtcgccaacgggcaattcgcgagggcgagcgggacgcggttcacggtgggtggccggccgttctactcgaacggcttcaacgcgtactggctcatgtacatggcgtccgaccccggcgaccggagcaaggcggccggcgtcctccagcaggcggcgagcctccgcgcgacgctggtgaggacgtgggcgttcagcgacggcggctaccggccgctgcagaagtcccccggcgtgtacaacgaggacatgttcatggtatcgttgcgtacgtgttgtgtacaccatgcatgcgtacgtacgtaatggtgacaattttggataacaatgttgtcgtgtgattcagggactagattttgtgatagccgaagcgaagaaacgagggctgtatctgatactgagcctggtgaacaactgggacggattcggcgggaagaagcagtacgtgcagtgggctagggatcagggacacaacctgggctctgacgacgacttcttccggagcgacgtgaccaaacagttctacaaaaaccatgtcaaggcacgagctaacatccgatacgctgacagtttataacctgaaaaaaagagaggaaaaaacatatctgacagtaaaaaacgtcctcgattagtcgatttgacgttctgctcgcatgcatgcaacaggccgtcctgaccagagtgaacaagataaccggagtggcgtacaaggacgatccgaccatctttgcatgggagctcatcaacgagcctcgctgccagagcgacctctccggaaaaacacttcaggtaaacaaaactcagttttaaccctcgtttaattcgtcaccggcccgatcacgccatgtgttgcaagatgtactaatttgtgatcgtttgatcaatgtgcttgcaggcttgggtcacggagatggccgggtacgtgaaatccgtggatccgaaccacatggtggagatcgggctggaagggttctacggcgagtcgatgcacaagaacttcaacccgggctacaccgtcggcaccgacttcatcgccaacaacctcgtccccgctgtcgacttcgccacgatccactcctaccccgaccaatggtatagcacacgaatgacaaattaatccatccatccagtgtgatatggttaatttaactggtgaaaaatcatattgcggcagggtgtccggcgcgagcagcgacgagcaggtggcgttcatgaggaagtggatggccgaccacatccgcgactcggcggcggtgctccggaagccgctgctggtgacggagttcgggtggtcggcgaggtcgaacgggtacacggtggcggcgcgggacgcctacttccgcacggtgtacgacgcggtgtacgcgtcggcgcgggagggcggcgcgtgcgccggtggcctcttctggcaggtgatggcgcccgggatggagagctggaccgacggctacgaggtggtgctcgagcgcagcaagtctacggccgacgtcgtcgctcaccagtgcgccaggatcgccggactcagcccggcctagtttgccaattcacgagacagcgataatttatctacacgaagataatcaggagaggatatattgttattattatgcatagggagatattcagaggagcttaatttatttttctaatcgacaatatcgcgatgaggagactttgcgatgaggtagatgttgattttcttggagagaataatattttatacacgtatactgaattattccctccgtccctaaatatttgacgccgttgactttttaaaatatgtttgaccgttattttttgtgaaatatgtaaaattatatgtatatataaaagcatatttaacaatgaaccaaatgatagaaaaagaattaataattacttaaaatttttgaataagacgaacgattaaacaaatttaaaaaaatcaatgacgtcaaatatttatatacggaggaagtacttgttattactccactcgatgtactttgtccaaaggaaaaagtaccccgaaagtccctcaacttgtcattgagttataaaatcgttccccaaccacaaaaccagacatatgacatcctccaacttataaaaaccgtgcactgtaggtctctcagtggttttgacaccgattttattctacgtggcggctgagtcagcatgggaccccacatgtcaggatgccatgccagcaccctccctcttcccctcctttctctctctcacctctcgacgcggaacggctatcctaggaaccacgccgacgaggtgtccttctccacgacgcacgacggggaccggagcagcgacgacgtcgtggcgattgcaccccacgtcctcctcctcctcggcgagggcaccggagctgctgtcgtggtgcatgcggaaccgtgggaggagaagatgtagacgcggaaccgtggcgacgccgacggcgaccgtttctccttggagcagtcgtactcgtcgagcatgtgggtcaggtcctcgtcccaggtgacgaagacgagcacgtcgaggtcctcggcgacgaccgccacctccgtcctgaacatctcctccaccttcttcttcaaatctgcacgcggcgagaagggtatcgagcggggcacggcgaggatgcgggtctcgctgtcgatgtacttgagggcgtcgtcggatgggcagggcatgatgcggccgccgaagctgcagagtatcttgatgcggctgccgccatcgacgcaggctccacgtccgccgccgctgcagatgctggtcgggtggcgtacgtgggcggccgtcgccgtacagctcgcgtggcggcggtacaagcaccgcaagacgctcgcgttgctctccttcatccgcgcgcaggccgctgtcaggcggccgcccatctacgcctgtcggtggcgcgcacgtagccgctgctggcgcgcgcgtagaagcctgcgcccggcgttgaggccctcctgctctcgcgtcgtcgtcgccgccgcctcgtcgcccgtcgtcggccgctggactcccgcctcccccaccggcctcctcccaccggccagctgcccctgcccaactgatgaggagaaaagtgagaaaagaagagagagatagaggaagataggtggagaggggaggggaagaagaggctgacatctgggtcccatgtgggtttcatgttgacttagccgtcacgtaggataaaaccggtgttaaaaccatcgaaggatctggagtgcatgatttttgtaagttggaggatgccatgtatctggttttggttttgcggttgagagacgattttgtaactcgatgacaagttgagggacctgtggtgtactttttccttatccaaaaggcctaatgcaaagcagttaggcccttcccaccaaggccacactatccagcccaatgctaggtgctccctctcacgcggcccgcgtcacggctgattgcctggttggtggtggttccaccacgatccgcaccgtccacctgtcccctcccgcccgcacagatgctcccacctcgcgtcctcccatagggcagtccgtcgcgtcgccacccgtcagcatcgtgcggatgccgccacgtttcgcgtcccccgcgcacaatcctcccccccgtgtggtccccaccacgttgagtccagcatcccaaccaattgaaccaaacacgattaaaataccttatcccactcgacccaccccaccccaccccgcagatcccccacaccactgacaccccggccccactgcgaagcccccgcgagatctgatgaccggagtacgagtggtggaccaatcgctgtgtgcgcggtgcgaaaaggggaggaaggagtatactaaaactttattacccggcacgcactaatcgagattggagggtgtcacttcgtcgctctcgaggccggcgttttaaacgccccccccacacggctcctcgctgccgacacctgtccggtttcctctcctcgcctcgccgcggcgcccgcgtcctcctcaccaacgccagagctccacatcccacctctcctcaggttcccgtctctgatccctcgttgcgttacggggaagcaggcgtggtggttgctccccgtgcggagttttcgattggtttggttgggtgagtttggtgctggggtgttggggattggttggttggagtttggagatggattttccgggagggagcgggaggcagcagcagctgccgccgatgacgccgctgccgttggcgaggcaggggtcggtgtactcgctcacgttcgacgagttccagagcacgctgggcggggtcgggaaggacttcgggtcgatgaacatggacgagctcctccgcagcatctggacggccgaggagtcgcacgccgtcggcgccgccacgacgacgacggcgacgacggcgtccgtggcggcggcggagcacgcggcggtgggggcgccgcccgttcagaggcaggggtcgctgaccctcccccgcacgctcagccagaagaccgtcgacgaggtctggcgcgacatgatgtgcttcggtggcggcggcgcctccaccgcgccggccgccgcggagcccccgccgccggcgcaccggcagcagacgctcggggagatcacgctggaggagttcctcgtgcgggccggcgtggtgagggaggacatgtcggtcccgcccgtcccgccggcgccgactcctacggcggctgctgtacctcccccgccgccgccgcagcagcagacgccgatgttgttcggtcagagcaatgtgttccctccgatggtgcctccgctctcgctgggaaatgggctggtctcgggagctgtcggacacggcggtggtggtgccgcgtcgttggtttcgccggtgaggccggtctcgtccaatggcttcggcaagatggaaggcggggacctgtcgtcgctgtcgccatcgccggtgccgtacgttttcaaaggtgggctgaggggaaggaaggcaccgggcatcgagaaggttgtcgagagaagacagcggcggatgatcaagaacagggagtctgccgcgaggtcgcgccagaggaaacaggtgaaaagtcctttttgttgcaacttgcaactgtttagcatttacttgtcgaattgccttgccttctagtacttgcctgtagtgacatgtgtagcacatatattttcccttttaagcatttcttttcttttcgatgcgacaactaacaaatagtaataaccgtgagaaatgtttatcatcatgctgatcgttttatttgctaactaggatatgtgcctcatatttgcaaagtttatgctgtatttggttcaaacatactgaaatttaattagtataaacgctataaacatatcttttgcacgtattaagcctagcctaaaattagtatacacgctataaacataaaacaaagtggtgtttataaaacataagcatatctttctccttgctaagttgctattgatgttctaaaactttttgtcattttttatggatttaatttgtgcttcctgatatggagcaggcatatatgatggaattggaagctgaggtagcaaaacttaaggagctgaacgatgaactccagaaaaagcaggtactctccatgttctgtttacatttctagtttgagttttgttcgttataatttggaaatacttcttcatgagttgaagtacgtagtacactttggtaatctttaaactttcaaacatatggaattccaatgaagcatttgatgctggcatattattcatttgcctgtgaactgccactctttagattggggatttgatgatacgccattgatttcagagggacccttgtgtcactgtcacatggtggcaagttgctaatcatcaaactaaaaaaattgctgttttgaaatcttaaactatcagtttttgttattctcaattgtcactagtttgccacatgtccacttagtttctagcagtagtctccagagcatttgaccaagtgaggtccttaccaatagaaatattataggtgttttcatatacttcctccatccttaaaagagtatctttttagctatgaacatagacaataccactcttttagtgacagaagttgtattgacgctatactctagtgtagccccttactttatagtctactcttgaaattggaaactaattctaaactgacaagttaccatgaaatatgttccacgcttgaaagttagttctaaacaaaactgaaggcatggtagagtaatcaaagtcggttccattttaaactgtttaaatagtttggtggtggactgctggttagttgcttgccttctttgtacaggatatttcattttataaattgtaatatacgtagcttatcatgcatcttaattgcaagtctaactaaaatagtacttatgaatgttgcattgcacccacacccacaattgtgattatttcattttgcactgtcttattacattctttgaggtttgcccttgttttgtccgcctttcatggtaagtacttctgagaaggaaaacaaaagaaaggctttacatgattcaaacataagtgccttaagacctgacaattctattcccttaggatagtggactagtaggcagtagctactctattcatttgattatgctttagcatttgaacttatttttatgtattctaatgtgcaggatgaaatgttggagcagcaaaagaatgaggtaattgcttatcttggaaaaaaaatcttttgctctggataggtactatgttttgcttattaatgtcaaacaagaaacaaaacgaagctgtgcaacctaggcatgctctgttttactgatagcttacttgtttaccaaaaagttttactctgtaaaatctgatagttttaccctttacatgagtattacagcctaatctgtcaatatcatacatatgctctgctctatgattatttttcgctcgtaatgtatggtgtgaattttaacaattattgttaggaaaatgtatgctgtgtatattaacaattattgattcacttgtttgaatgtcaaacgttatgttctgattgatagctactggtcgtgagttttggctttcacactattaccttatagtatgggattttaagcaatgatgaagtaaagctttgtggggggttgagaaataatgaggcaaggactgatgtcgatgtgattgattgcattttcctacatcaggggttaggtggcagcatttaaatggcttaaactaaaaaagaaattctttgaattgatcagtcaactgccatcattgttgaattataaccatttaaatgatatttcatctataataatacagttttaactaaatgcaacattggaagggcaagcaaatattaaagtttattcaaaaaacagttatttgatgtgtgtatagtttaatgcctatgtttccatcgtagtggggtataactgtattttccacaacataacacttaaaaaagttatgacaggatagacaattgtgaaactgtcaatattgtttgttacaatcaatttaactgacaattttgactgaactttacatgaagttaacacatctctcaacactgtaaaatctgtggatacctccttaggccaatcgttgtaaactctgctgagaagactgactgttctctgtaaaaagggatatgttctcataacactgaggcggcagaatttcaaaccgcactccctccatgtcctagttgtttttccacatcttagaccactagtttgaatgtgtacagaagctaagggagtgccacaaatggtttgaaacttagaatcatcagttttttagaggctactctaaccctgaaaaaatgtggattggacaaaaactgaattactgaatgcttgctctaactaatactggtatgtagcacacatacttggtatttctatttctgagaaagagcctcttgtagactcttgccacttctactcgacataattgtattttggtaaaaaggaaaacaatggagcctctgatgttatcataaactgtacaattcatttttgaaaaagcaaatcaccactcaattctatttaatttatgttgtcctttggttgggttttaatgacttcaaaatggggttccttatttttctgtcagcatactatctgacaattgttcctggtaaatttgggagagaagtttccaagcttttcgtttcctagtttgagattttcctctggcttcaagacaccaccgcgtaaaagtctaataatgcactgttaatggtttctgcaggttctagagagaatgagccgacaagttggaccgacagcaaagagaatttgccttcggaggactctgacgggtccatggtgatcgaagctaaaggcctagttacctgtaactagaacacagtcctttcaatgtgagcagtgatcatagtagttgtaggatggtgaagctgaagacctggttacctgtaactagaacacagtcctttcaaagtgagcagtgattacagtagtagtaggatggtgaagctgccagttacctgtaactagaacacagtcctttcaaagtgagtatagtagtaggttagttcagaatcgccagatcgatctgcccttgtaggccaaccattagtccgtgggcttgtctcttgggcggacaggctgcctgagatattcactcgataggttttagttgtctgagttatatccaagcattgtatgtaacctatttaaccatggtgcctgctacctgtattgtattttgctgctgtaggaacctatgtcggtgttaccatcttgttcttaatttgtgtacttctcttgccattttggataagatgtatctgaacttatacatatgtacttttccttgccattttggacaagatgtatctgaatttacatgaacccattttggacaacgtgtatctgaatttatatgaaccatggcactgggctgtgtgtgtatactgtatagcattgtgccaaatttgtgagaaacggattgcttatcatggataacacttggacaagatgtatctgaatttatatgaaccatggcactgggctgtgtgtgtatactgtatagcattgtgccaaatttgtgagaaacgcattgcttatcatggataacaccacgagcaatgtgggggcgcctggtcatgtggccggccagtgacgcgacatgaatttgggggacgtttcgtgtagctgtccgtctccgtcgtggccatcctactccgggattgatccaactcgctgtccagacacgtgcagcacctgagggggcatctcatttcacctcatcacttcatcggaatagctctcctggagaatctggacaagcatctcacgattctttcaccaattgggtattattagcagcgtcggatagtataacaaacattctcagaggtcacgttagttagtcaggctaaaattctctcagaagtcgcggtaaaatcgtttttgcagcacaggacacacccgcgtgccacttgaagggcactgtcagagccttttctttttacattcactgactttttacgttcactgacagagctagctatagctcttcaattctatcgtgagctgtaggctgtgtttagatacaaactttggatccaaactttcaactttttccatcatatcaacctgtcatacacacacaatttttcagtcacattgtatcaattttaacccaaactttcaactttggaaggtactaaacacagccgtaatgcctgtacgtcgcggcgccaacggacgagcaccgtttgccactcaaaaagagcccgcatcaatgcacgccaattaacacaagattgacctccgggttagtaccagcaaaccttgcacggcgagacggcgttgctgtttactgcgacgccgccgtgcgcctgacgaacgtgacgggtgtgaccctgcgtgtgtgtagagtgaagtgagaaagagacgagagcccccgtaccagttagagacagacagatcgccgtgccaagacgacgacggacagggacgcccaactgtacgtgcctgcgctgcgtgcatccctcctcccccattcggcgccagccggaccacagcctgtcctgcccaccccaaccaaacaattctccgtagaatgcactgcacatcgatgacgaagacgacgatgtacagatgatgcaaagcctgcatcaaaccgggccgtctgctctgcttcacggctgacgctttctcaagaagaatttcaggctttcagattctttcgtctccatgcagattgcagagaacatttcacttttgcatggttgattgttcatcgaattttgagagcaatgagcatgagcaataatcatttttttggaaataaaattagtctacctcatggatttacattgatgattgataaagatctgaattaggggaataagcaagaaatctgctaaagtaaagaaaaaggatggctgaatgactgaatgatattatgataatgttaaatgaacttgaactgttcaagataggatagataggaggaggggagccggccggagggtggaaggcggcggcccaccaaaccctaaattcctttcattttccttttttttttcccgcatccgacgcatcgaggcaggggatattcttttcttatccttctaagttttcgttcttgcattcttctcgatgcaagagaagatgtcaatggcgtggcgtcgccgacgagttcagcaacggttgcgcacggacaacgccaccacctgcgcccactgcttcagcctcatcttcaccgtctccggcgtgtctcctgcaccacatcgatcaatcagaatcgaaatcaaaatccaaaacttttaactaataatcgaataccaaaacatcgagacgacgagacctaaatcatatttattacagaaaagaaaaatctctgttttctctgataagattcacaggtgctctgcatctaggaagtggcctctctcaatctaatcaacaccacgattgatatatatcatggaagtataatcaacaacagcacgattgatgtatcaatgaagtggatgcgacttgcgagtacgaggtaaacacgtatacatacctggagagagtatggacatggggctcccgagcggcgactcctcggacacatccgacgaggaggcgccgcacgagcaggggctcgcggcggcgcaaacctcgcccgcgccgccgccgccgccgccggcgttgccgtgaacggcgtagtagaggtccagcgcggggagcgtctccaccaggcggctcctcccggcgccgcacagcgggcacccggccgcctcgaacccgaacccgagatccatgcacccgcgcagctcgtcgaggtcgtcgtccgtgacgctcctcacccgccgcagcgccgacgacgacgacgatcccttgttcatcccgcgccggccgctcccacgcctcgtccctctccatgtccggcgaccacgagttctgcttctgcagccctagccccacccccgccgccggaaggcccctcctcttccccacgccgccgcagccgccgttcatcagatggctaaccttctccatgacggcggcgagccgtcggcccctccctctccgtcctcctccgcccgtacgccgtcgcgtcgggccgccctcctcctcctcctccggcccccgccccgcgaggcgaaggggggatgtgggagacgagagcttcgaggccctcgaagccgccgcggcgatgggatttttatcctctcctcctcccgccgccgccgccttccttttcctttgcgcggtcagctgcgtgacgtgtgccgacgtaagagggaaagaagcttttatttatatatatatatagcccttgatccaacggtggtggtttgaatcggagggcagtaattataaaggcatttaatttgggtcacggactcacgggaatgaggagcaaatgcactaaaatttcacccgtttattgccgtttaaatcgccgattttgagttcgcccgtttgaatctgtggtgggttcggttgtgatttcagtgcgatgcggtacacactagtatttgtacgacacgagtgccctgctcggctgccttacgagcgcaggtcgatgacaggtgggaccggtagtcagagaaactttatgatgatacagtaaaagataatattttttaaatatatggcaatgtaattagtgtttacaatataataatatgtgtaaaatttatacgactaaaattttttaatacaacataataattgtttatgggacaccgattctaatgcaaacaactcattcattttcaaccaattagattttttttcaaaaaaaaggggcaaaagctttgcctagtatatattgatagaacatatttatagggacaaagagcaaaagccaaaagaaaaaagtctagttagtccgcgtttcctagaatatgaactctgctagtggggttgcccctgccctcacccatgtaaccgcttctttcttgatctttgcaataatggttggtgccttggtggtatggtgtcaacgtgttggaaaatctttgcattacgttcgcaccaaaactcccaagcaatgaggatgattaacgacttcagcgtcttggtcggtctcggcaacctcagcatgaggtgataccaccaatcctctacggacgtgcggttgccccagttctacatgtcgaggtctagaccaatccagcgttggatctcctgccagattcgcttggagaacctgcagtgcgcgagaagatgcgtcgatgttttctgagtggtgtagcatagtgggcagatccactgattcacccatcctctcttctgtaatcgatccacagtccatatcctgttccgtattaataatcaggtgaagattttgcacttaggaggtacgaagggaatagttttatcagtattcaaattggataattagaagagcccatgcttgattttggttttaacatgggaaggttttttaaaaaatcatgccaagatctaatcggttttagcttgactgcttgaaatttgtgaaagtcctgcaatcgaaatagcattgccgttgcttgatcagctaaccacattaggtggtaagagttgcttgcacagaaagaagaatgatcgatcaacgtttacatgattgagtatccacaatccctcatgcatctcactatcaatcgtaatccctctcgacatggattgacaatacaaaaatatctgcagacatatttaaaatccattttcccacccagaaataaacatcagaaaatcaatctgattccgacaacacaatggaacttgtgttctcaccaggatttcatggtttgccaatcgcaattaagcattcctaatcatgtctgatccacacgttcaatgatttgtaccgaggggatgagttcatttcaaacttatttgcaagagtagcttgacaagatatctagcccatttagaatatgacacttcctctaaatacagcaattcaactttatacaaaaaactatggcaattcagcaaccaaaggcaatggaagcacagtagcatatcacagtacactgttcgatcgaaagttctaaacttgtctaaaattgtcaagaaaacgaaatccctgacgtgccttgaacaaggacatgccataatttgcacggcatacttgactttgcttaatactcagtgctagctttcaatagctgcgcgtaatgccattctctccaaaatagttggtgcttttaacttgccatttgggtcatgtttcgaacaaagaattattctgaaatttcattgatttcttttcactgaatgttctagaaagcaatgtaaaccctcctgtatttcaattgattttgtatatatgtaagttgacaaaaattcaagatgcgtgcttactgcttagtcaaattacaacattgctactaaataaatcagaagagagcttcatttgataagcgaggctacttttcttgttagtcaatgtcgtcatggaagaccgcctcttaacttgattacatcatggacggctcccaagtctcaacaaccggtataaagatggtactgatgtgcaatgatatacaggagcaacttgttcttgctcgtcgtttctgattggccaatctgtaaaacaatgagaaggatgacgacctacttcaataatgtccttttataattgcaggtattggggagatttcacggcattggcagccataaagatacgcatatgtatgctctatgatgttgttgcgtctagctgaactgccgagtggtttcgctattgcttttggttggcgattaaacaagcgttttgttttgttttctctgtgtaaaataatgaagtagccagttaggagtacaaccaaactgaacattgacccgttcctaggctgaaattggcatttgcttctaataataataacctgccagttctgaattcagaagaaaataaaagccttaattagtttaaccattatgcagtgacaacacaacttgcagttgtttttcccttcgagtccatgtcatgacagctgactagaagttacctgcattaatcgcactgcgaaatggcaacatagtttcgtgagaagaaggcaagattattcagacaaatacaatactacacctaacaatgacctcacctggaacatctttgtactctttcagaggacttgaccttgggttggaactaacaaggaaccgacactagtttttcgtcaatggtcaatgcattaagtgccattaaacatcaacctggaaggctggaacctcataaattatatctctctcccaaaatttgacagaatcagcaggtagaactcagccacagataatacaggtagcaatataatgcttcctcagtataggtctgttgctgtgggaatagggtattaacgaatcagggttgccgatgcctactggatttgccttcgccatcacggtactgctaatggagaagcatgacttaagctgcacattaatcaaatctggttatatgttggtcatttcagagctgtgcattgcagacttgcagtgcaggagtggtcatcacgaccactgggcgactgggtcctccacccgtatcaactccaacgtgtgggagccaaaagatttaaattagtggagaagccggccggccctaattggctggatcaaaactttgctcttgcatgccttcgatttgaagatattccacaccctttcggcctttcgtttttgtcgcggtctcgacggaatacctgacgatggatcggcagcgatgtcaaacggccgcagctagcagcatgtgcgggaaatcttgaccagttttagcggctgggtttgagctttctccacgaagaaattttcagacgatagatttggaggctgttcgttattattccctcttgccccagctgcatcccattatagggcggctttttttccacatcgcaactgcacccatcacgtacgcagcacgatcggatggtggttggccggataaacggggtcgctcgctggctgttcggttcggctcagtgtgtgcggaggttttctcgtacgtcttgttgcatgtcgcggcggtggtattttagatcgctgacgctcagcgtttagcgttgcgcggtatctccggcgtcggtggcggcgtttggaccgacgacgggcacccgaaaagaaaggccgaagggcgacgacgccccgcgcggcagggaacagctagtagccaggaggcccgtgattgcctacagcccagcgcccagcctgccaagaggagagcggctgggcctcctcagaccgaaccaaacccgcctgacggtgaatggcatgggctgtcccgatcgaaatcacgttgggccaacatggcgattccataaaagagccgaaatgcaccatctgcgcagatgatacgcgtggtgaaaaggaacaaagtccattttggcatccttaattatttgcccgaatctgattcacatttcttaaccataaaattaggtatatcgtctttcccagctatgaaaaccagttcgttgttgcctccccaaccggattgaacaatgattttgtcctatataacatgtttgacccggctttaatcggtggcgtcggaccctatcctatttctctacctctctcctctcaccctcaactctctcgatctctcccgtctttcctaatggtcactagggttggcgtacaaaggatgacctcattggcgggataagcgatggcacgatatgataggaagcagacaggtagggtctagggaaggagtctagatcaggacgaggtcaatgttgggattgtaggcaacgagtggtagtgccggtagaaccgtgtgagcaaatcaaactctggagagcgtggaggaagccatgcacaacggctatggcgaccaaacaaaggtagggacaacgagtagtatagtccgaagcttatatatgctaccgtcataatgttgataaaggagaaggcaaacggtggttggtaacacgggagcttgaggagtctactggcagcacaacgaggagagctctacgcaacctccagatgtatgacaaggtggaggtcacaagcatggtaggtgatgatccagttaggagtaatgcgagggaaagcgaggccaacctagcgatggacacattgacatggagtgagatgtggtgggtagagatagaggcgtcaacgaagaggaggaggagcaagagtgaggtgtggaggtagaggagcgggatgggagtcatttggaaagataacaagcgacaaccatgtgcgcaaagggttacattagcgatagattttatgtgtggtgcagccgtaggcagtgaggagcctgatggtggcgtgggagcttgacgagggcgtcagcatacgagaccttgacaaggctcgaggagatggaggaggaaggtgggagggagattgacaccctcctcgctgttcactgctctttgctgccaaatcaattcaagggagctctgaaggcacgttgtcgtttacattcacatgctgactggaaggggcgaagaggaaatcaacttgtgccaccagcctttgatcttggaggtcgctcaagggctcgtcggttatggtgcgagagaggatgaggaggagagtaggagggggagggggagtggcgaggaaaaatacgagagatgatcacttacacgtagatttatttttaatgattgggctgtcatatagatatcctgttaagaaaccactttaaaatatatgctacagagaattgtttttttaaaaatatgttacagaccaggctacgttcgttgcatcaggttcccaacatcatctccctcgtttttcgcgtacacgcttttcaaactactaaacggtgcgtttttttaaaaaagtttctatacgaaaattgcttaaaaaatcaaattaatttattttttaaaaaaattacctaatacttaattagtacgcgctgatggaccgttccgtttttgtgcagaggggatgggttaccaaccccacaatcgaacacagccctagtttgaaggcgaatcaaaattgacctttccccggtgagtccggctcaggtgcagggaaccctgcacatagtaatatacaggccaaatcaaatcgcgacacctgtacacaaggtaggtccacccaatcaaccaagtaacaatgtaaacggaggtttaaccacgatcccacaaaatcaggtaacagaaccattcacccgtttagtcctcgttaaacctccgttgcatgcgtaattaagtagggccaccctgaacaggtgt

SEQ ID NO: 72644 - DNA, 1165 bp, Oryza sativa
ttcctgcagccctgttatttgtctctactccctctttcctcctaatattatttgttatctatgcatattgtaaaggttacaatagttaagcttatatatgtgggtcctatttatatgggctattttttctatatacattatatatattgttgttgctctaagaataaaatgccgtcattaaaaataaggaaaaatgcatagcaaaaattcctcctatttattgacggagtagtacttgtttcagtagcagttaagacggtaaaatatcccacttcactgttgagagctactccaaattttagaatttttagactcacctgcagttgagaaagcgaaggacctgtttctagacggaaaagaaaaaagaaaaaaaaagagcatttacgagtagtttatgcggcgtgtgggcgtgcgacgtgtggacggaacgagtaggctctcctcttttctttcagaagaggcgatcttttgttgtgctttggactgtgtcgtctcggcagtgagtactacctccgtctataaaaagttttcatactattaggagaagtagagacaaagaaaaaagaaaaaaaaagagcatttacgagtagtttatgcggcgtgtgggcgtgcgacgtgtggacggaacgagtaggctctcctcttttctttcaaaagaggcgatcttttgttgtgctttggactgtgtcgtctcggcggtgagtactacctccgtctataaaaagttttcatactattaggagaagtagagacaaagaaaaaagaaaaaaaaaagagcatttacgagtagtttatgcggcgtgtgggcgtgcgacgtgtggacggaacgagtaggctctcctcttttctttcagaagaggcgatcttttgttgtgctttggactgtgtcgtctcggcggtgagtactacctccgtctataaaaagttattaggagaagtagagacaaataatatattttattcgtcttatataaaattattttattagtatttttattattgttagatgataaaatatgaataatactttatttatgcatgtcttatcttttaaaatttttttatggtttttttaaaaagatgaatagttaaacgctagacataaaagtctaataattaagtttattttgagatagatggagtagttgtttgtacctgtcgctgg

SEQ ID NO: 72645 - DNA, 3266 bp, Oryza sativa
aacggcggcgagcgcgaaggggcaggggcggcggcccgagcggagggacgagaggtagagcgcgacggcgcggcgtgggcggccttggtccgcggcggcgcggatggccagcgtccacgtcgagttgacgtctccggcggcggcgggcatgggagcgtcggtgatggtggcaaactagcaatccgtcgaacagttggtgactgaatttgaactcaaggactgacaatttcgcagctcttttttgtttgataggaacaatttcagctcttcatactagtggataaggctgtgtttagattcaaagtttggatctccttttttatcacatcaatctgtcataaacacacaacatttcagtcacatcatcttcaattttaactaaaatttaaactttgcgctgaactaaacacaacctaagtaacatttttcaaaagcttctcaaataaatgtaaactaggaatacaaaagtcccaatttaactgtgctgttagaaaacaaattctggtcacttgaagagattacagttgggactatcttaaaaactaccgcaagtattttttatggaaaactttcaaatataaatatagtataattgtaatataattacaccttaactatactacaaccaattaaccttattatgacttatttcctccttccctaatggtttgacgccgttgacttttttaaacatgtttgaccgttcgtcttattcaaaaacttttgtgaaatatgtaaaattatatgtatacataaaagtatatttaacaatgaatcagatgataggaaaagaattaataattacttaaatttttttaataaggcaaagagtcaaatatgtttaaaaaagtcaacagcgtcaaacatttagggatgcaggaagtatatagcttgtttatgcctgattagttaacaatcatctttgtctgtacggcagtttttattttacttttgctaaaaaaaattctcctgctctctaaacactcctgactctttcaaaaaaaaaaaaaacgggggtgggttgggtggggaagactactgccattcattgttgcaactgttctctcctcttcacaatctttctgcgattgtacaaggcttgaatggatgctacggctgttgccgagtgaaagtacataagttgtattatctgaagaaacgcacagatttttgcatgaattcagttggttcagatcagtcgaaaatattgttcaataatctctctaagaaaaagaagttgccggcatccgaccatttcaatttcagcgatgagtcacaatccaaaagctgaagaccagaaatgcacgtccaggtcctatgcgttcctgaattctaatacaacgcacgtccacatggaccacatgcaaataaattcctcgcaaaatactggatacctgaacaggtgagcaatagataatagaaacaggagcacaaaacattggaacagcatgagtccaaagttccatcgccaaatcaaatgatttcaaggcctacaaggttagcaaacatctataggacatgagccgaagaattggttgaatcagtcgcattaggccaaacaaataccaccatccaacatgccaaccatattttacactaggaataccttcctaccccgcaaaaaagggcaggaacaaaagaacattctctaaggtaccaaccaccactagctcagagctagaaaagctttacaaaggagggaaagatggcagccatctccggcacacactgcggcagccgccaggtgaggtcaagattttctgggggtgggaaaaaagaaccaaaaactaatttagacatgtcatcatcatcatcaatcaacacctgtgctgctgccacaggcaaaaggagatgctgtggacttgatacatttcacctcatcccacaaatctaaactgtttcttctttctccctatctcctacgatcctaccattctttgggtctaacgaatgtcggcactgctggccaagtcactagagggatggtcagacttctggtttgttagctgctgccggagccgctgatattgtggggtgggttccattgtcttgaggaggcgccactccccactttgggtctgagtccaacggctccaccacatgaacagcaccatcgctcatgccgaccgcaatctggttaggctccaagggatgcgcagcgacaaccatggggtaaacacttccaccactgttggaaaagatgcaaaaatgggcatcaacaataacatgatggtcgccaggactaagattaccatacccaacagaaacacaaagcagtgtaggcatgtaggggactatacatacctagacatggaaggtggtatgtatgcagaaggtgctatcctgcatcgcagcctaagagactctgcttcgaagactccaattgcaccatcacaagtccggcgtagatgaggagaccatcacatgagtatattgcacttgaaattggagcagggagtgcttctcttggggaccactgcatgatcaagcaatgaggtcaaattcaactatcataatcaatgattgattgaatggatcacaaatgtttatcacactagcacgatgtaatataatacatgcatatattaaattacggtaatctgagaactaaccgagcgcaagcactctagctttgcatcatagatcgccaactggctctcatgaaccaccaaaatatgtgtttggtcattgtgaaactgcacccttgtatcaccaactaaagcaccagaacgatttgctggagattggatatatcttgatttcttcttttcccaaccatcaatgctccaagcacatagctgcaaaattccattccaatgaccattgattcagaaacaaatatatagtccacttgccaccgcgatcagaatcttttttttttaacaaaacaggctaaaggatggctagacatgggactaacaagagcatggaggatgaagtatgcacacaaagtgacatttaattctgcacaatatataggaaaattcatacctgagcatcagcacctgaagatacaagcatattcattgactgcgaaaatgccagcccagtgatcttttttgaatgtcccttaagcttgcttttaacctatgccatatggttaagacagaaggaatcaattatcactgaaacaagttctcagctgtttaaattttaatcttcagttagttgaaggtcactgagcatttctattgcacataaggtttataagtaaaaaaaaaaatacatatatctaaaacgtcatctacaaaatctcacaagatctg

SEQ ID NO: 72646 - DNA, 1181 bp, Oryza sativa
atgtttgagatttcacaaacaattcaccttttttttttgtttgatgtagaagtctgggaaactttcatgttctaaatgcattctcagtttggttattgatcgaaaatccaaatggacataaaagtgacattctcagtcaaaaccagcaaatttgtggcctgtgaacacaagccaaatatatctcatgtgcaaaaggatgaacatgggtaccagtacaatgcacatttatccgggacgatcacaaaacaagccatagataccatatagaaagcacagacttaaaagaaacagaatgcagctgggaggtaacaaggtggcaaccatatccaacatacggactgcagtatttgtttcacattacagggcatccatctcgattcctggatcaacatcctatctaaaactacacagctatccaacagatgtcttttcactccagcaagtaaataatcatcggatcggctaaaaatctgaaactcaaaggccattgtagagtgcagaattgcattgcatcagctgcaaaaagatttgcagaagtcaagccaaaatgagagtgacagtaggagaaaagtgtgatacagatggataggattctaagagaaccttctcaaggacttgttttcctgcagccaaatcatcatctttcttcaagagttcaattcgagccttcatggcattgtttttctcttcaacctatgttatcgtgtgaagagaaaaggaaattatcacttgcaaaagatgctctttagccaagttaccaaaaatgaaaatgtcttcgcaggagaaatcatctattagaactcagttgttattcgcatagtaagaagagtatcccttgaaaaattaattgggaatagtgtctatatgtctgcagaaccatttccagggtatattacctcttctattagacttttcaggtattcaacttcatctttcttagcctttgatatcatttgcttggtgtcttcaatgttagtcctgcaaccggatcaaccataatcccaaacatggaatgaagaacaagtcaaggaaatacatgttttatccagacagaacagaatatcttgtgtatttatatgctgcagtttgagaacaaataagagagcaatagccatgcttgtccatttgattgtatttcttagaaagtggacaagagaacaacaaaatttcaaaaagatgaa

SEQ ID NO: 72647 - DNA, 780 bp, Oryza sativa
agagaagagagagaggaagagtgagagagaggggggaagaggggagagagagtgtgtatatatgacaggtgggctcactatgttttaaaaaatgaaaatgttgactggactgccatgcgaacgccacgcagaccaaaaccaccgcggattgagtcgagggggtaattcgtccgatttgtatagttgggggtgaagaatgtccggttttatggttcagggggtaattcggacgaccgcgatagttcccggggggaggggggtaattcgtactttttcctttcattaaaggaggggagacagaaaagtgttagtgaaaatattgatttacctctagtttattgcggaaatttagctaataaagatggcttaaagtgaaatttactctttattttcccaatttattgttcttgcatcgaaatcgagcgagaggataatttgttaacaatggtatgagagcctaccacgatgatatggagagttggcgactatacgtcttcgacggtggtcactacgctacgctcagtcgggacgtcgtggcgatatggccgcgcaaattaagcatccaccatgctaccgttgttgtctcaagactcaacgcaactacgcaagcgatattagcaacaccagtataaaaagaaatgcacataaatagtttggatttaactgttctcacatgcaaataaaagttcttaaaacgatgactctcaaaacacgaaattatccaacctaacaaaacgtaagtgtttcaccacatcttgttgtctcatcaaccacctctct
